United States Patent 10,724,096 (METHODS AND COMPOSITIONS FOR INHIBITING AND TREATING NEUROLOGICAL CONDITIONS) - sequence listing, part 33

SEQ ID NO: 480 - DNA, 78408 bp, Homo sapiens
ttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattctgaaaatgaaaaagtcaatgtaaatatcagttttgtttgctgctgcttaaaataccatcttccaagaactacttgtatgttattcagctaatacaataaatgaaatccttaaagctgcctaattctaagctataattttgccaccttggcctcatgaattagatttaaacaaagccttaaacacataataaacccagaaacgaatggtccaaatgttagaaaaacaatcttttggcaactctgaagtcacacttaaggtctgatagagatttgttactcattatgcctgcaatatgaaaatactgttctcacaatccagcacaccttatcctagtaaaaacactgcagattttaaatacttacttagccatagcatctttaacattcttatttgcaagtcctagataatgatctatctgtgcctgaaagagaggtataaaggaattattaccgttgctaaagaatcttattaaccactactatgtgtcaagctaaaggcttaagaaaccatcacacttctcatttttgtaagacattgaaaatgggcactaatacatccgtaaatcccatgtaatagagtgagtgctctattctgaagtcagcagttagttaggaaattacctgatgccgttcataaataacaggaacactgaagagtgaaatgagagctgaaaagggaaatatacaacttttcaaaaagaacggaatgatttgggaggaataaacactcaaaaaactattaaactggcaactcaagataaccaagcagtgttcctaatgaatgaataaaaacataaggatctctggatgcatctgctgttgaggagccactccagaggaatgaatgaactgtgtgaggctgcagttattagagctaggaaccatttctagcttcaaatcatatcacagtgagatttcataaaataaaggtatccctggttagatttatgactgcaccatcatataaagccaccctttatctggtttatcactgtttgttagtaggagctgtcttcagcaactaaggtagcatttcaataaaccgggaagcagtatcaccaacttatttaaagagaatacaacctcaaacttattttgagatggagtttcactcttgttgcccaacctggagtgcaatggcacgatctccgctcactgcaacctctgcctcttgggctcaagtgattctcctgcctcagcctccggagtagctgggattacaggcgtgcgccaccacgcccagctaattttttctatttttagtagaaatggggtttcaccatgttagccaggctggtctcgaactcctggccccaggtgatccgcccaccttggcctcccaaagtgctgggattacaggcatgagctaccgcgcccggcccacattttcatcccctacttttcatacaatgagaatattctccactaaaatgtctaagctcctggcacacaatctttccagcaatttttcatcccaatggctttgtagacttacccaaaatcagtagtgtcagaccattaaacaaggcaccaacataggtaaatacccacatcaacactgcaaactataagaaaataacattagcccattataaacaaaattcaagtaaagtttcttaattatgctttcaaaagcatcccatctaaatgcctacctacaaaaggcatacaacttgaagactgggtaaagtaccatgagcagttcactattaagtcacgagtctcaattatgaatttcaaaatcctaaaataattaatagatttgacccattttctctggactacactaccaagtagttgattctgctgagatcagacaatataccaagggtgcatcttacccctccagccctaacaacatttaccttttaaatgggaagactataaaggtgttatgagaattgtctattagaattgatttcaaagtatgaactagttgagtgcttgaagatatatgagctgaataattcagacattaatatctcagctgataagcaataattgggcaaagagtacttatcagggaaattacgtttcaggtaccaaaaatatcacctctagcctttgaaggatcaggcacaaagtcagtctgaattttgttaaacattggtcatcatcagttcctttgctttctaattcaaggccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagccagacagtagaattttaggttttatgggccacatagggtttgtgtctcatattattctgtgtcgttgtcataaccctttaaaaatgtacaccacccactcttagctcccacactatacaaaaacaggccgtggcccaaacaagcagtggtttgctaacccttgatctaaagcatatatctttctccatgtattaaacgaactctgactgaatgcttactgaccattaattaagcagtcaaacattagtaagcatatttattacagcttaggaagacactttggatgactctaccaagcaacagttctacaaatagcaacactctggtcaccctaactgaatttaactaatgttcaagtcagtaaatatcaggcattcttaatatctgtcaattgaaaaaaaatttttttaagctgccgtattcttagcaattgctattggaacccctggtagaaaggtttgaaggatgacttcagttagtaaggcttttctctcacagttttatagactcctattgctgaagctaaatataacttttgcacttgagcaagtttactatagagtaagagagttatttttatccatcactatccacaagtctaaagggaaaagtgttgaccttccatattttagaagaaattactctagcaacgaagatgcccttaacatgacagaagatagtaacaaacacaagctaaaataactcctcatttggtcattacagtcactgacaaggcttcactccaagtccacaggggaaaagcccaagacttcacacctgagccactgtaggggctcaaatgtcacttgcctctttgagaacacttcctaaaagccaggctatcccaagacaaagagaagaacacagggaggtctcaaatgtccttagggccaggcaggtgacatacatgtatgtgagaggctgggagagaactgaggcacacagtgatatgcattcttcctctcaaaggggcacttacaaccctgctccatacgctgtggccatgcaaatattccaggccagtgttgccagaaatgtacacttttgtgtgctatcatataatttttaaatgttgcagctatgttgagaaaactgaatacttcggcggcccaaaacagaaatagtggttaagtgtattcagggaacacaccaccaggagagaaaggggtggcagcaagaactaacctagagagtaaccattattaatgggaatccaccacaaatgatggatttgtaacatggcaggaataaggtcaataaacactttaaagaagcaaacaggctgctctcattttggacttaacaaattctacacgattccatggcaaatactttgcaacattatagccaatacttattaactgaagaggtcaaagcttatctctccattgcacagtatcgagactggaggaaggaggcctaaaatgtaatgaagatctaacaaatacttactgaaaaggggcaagggccacatctggtttatctttcttccagggcaataagagaattaaattcactgtgtataacacacctgattaaagagctctgcagatttgtgatgtttcaatttgggggaaggggtatctttaaggcaaacggtgggagagtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcaggccgtttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgcgggtgggaagcgaggggagggaggatttatagtttaatgccacaactttttaaaacagtgatttttgccatactatttgactaggaaaatgatcgttgctcactctataaatacttgaaatcttttctaggacttagaagtttgtagttaattgcaaaggagcaaaacaaacggaatattacacaagaatttaaaaggagaactctgcagaacatgtcttatttttattcgcccaagtcaaccaccaggaaacttggaccaggcacacggatacccatcatttcacaccggtgtttataaaaggactaatgagccctggagtttggttatttttttgatcacattttgaaaggccaggctcctccttcactgcccccgccaaaaggcaataagcaaggaaaaggtttcacatgctagcaagagcggctctaaaatttcaatttctgaggaagatggtttcacatggaaatagtcataattgtaggctgggcatggtggctcacacctgtaatcccagcactctgggaggccaaggcaggcagatcacctgaggtcaggagttcgagaccagtctggccaacttggcaaaaccccatctcttctaaaaatacaaaaattagctgggcgtggtggcggacacctgtagtcccagctacttgggaggctgaagcaggagaatcacttgaacctggaaggcaaaggttgcagtgagcctaagatcgcaccaccgccctccagcctgggtgacacagcgagactctatctccaaaaaaaaaaaaaaaaaaaaaagagctagtgataattgtgacccagaatctaaaaatgtagatataaatttgagggcacacaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaattttaaaaaactcattgttatttaaataagaaaaaacattcatctcaactggagagactggagctattagcaaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgccgtggctggaatgcagtggtatgattatggctcactgcatcctccacctcctgggctcaagaatcctcttgcctcagcctcccaagtagctgggactacaggcatgggcgaccatggctggctgatttttcagtttttttttttttatagaaacagtctcacaatgttgcctaggctggtctcaaactcctggcctcaagcaatccttccgccttggcctcccaaagtgctgggattacaggcgtgagctactgtgcatggccaggaaaaccttcttctttttaaaatgctctctatataaacaaaaactgtggtggataagtgtggccatacacagaagtctctctagaaaggtaatcctatcaagcgtttttataaaaaagcaaagtgatttttatcagcttccttttttcaataaaagctgttttaaggaagtattcagtatttctgtatattcaatggaaacaaacacatggaatctgtactactcatatacaatgacattaggaaagggtttagctaaattcttgtgtggcaaaatcacaaggtttatcgtttatcaaggaagacctttcatgtacattatcagagtgtgcacctgaattaccaagggctttacctttcatggggagaaaaggacagattccctgccttattcatttgcctctagattttgagatctaaatgccaggttcactttaagtgctaacatgatgaggcaactgttacttatttgcagtcctaaatgaattgccagctggggaagtcaccaagcaggtttccttgagctctgggcttgccaaaaacacaactcagggaaaccaatcaagtacgtttttcttctcttctctttttaaaaggattgctaatccttaaggataaattataattttaatgaaagtcctttttttcaatactaagaaacaacaagtgttccagaaaggaaatctgtctcatcatgtgttactttctgttactttcaaattagcagtcactcaatgcaagaacttatcaagttcgatttctctcatttatgctagcttcctcatgaataacataattgcttttacaaaaaaatgtagttttcaaaagaaattaaaatataagatttaacaaagaaattatttctcaaaactttttttaaaaagtcctcatattcgattctcaaatacgtgtgcaaaacagagatttaaaatgtttcttaagatctcatcagcccctttctaacattttctctctcctcttgccccgtatctacacaatggactgtgtatggatgaaaattttctctgaaagaataaataagttttcttttgattaaagacaagtggaaactttatactcaaactcagaaaactagagcataatgaatcattcccagatcaattttaaaaatagatttattcaagaatgacatttctctcaagaaaaatgttaaattgtagacatatagctgccttcactgctatactgtgcaaacatcgaggatgacttttggtgtatctctgttgccgtgtttattgaatctataaaaacaacaagcatctctcctctcccctaagctcaccaggcttttctttgaagtcacctctctcccccaccaatctttgactactaaattcagagatggtcctttgctgtttgaagctctgaattactacttacagacagtatttcttctcagtcaattcctacccacaaaccatccatcttaagcggcatcagtacctcctcctcaatcacttttcacacatgttctaccctagaagtcagctacgtatagaaggtaataatacatgaataggaactggtttcctctaggctgtatgtacaaggttctatttcatttgctccaaaatatttttagttgatctcttttgaaacttattaaccaagcatgccaaacaacataaccgtaatctttttatttacagactaacatcagatcattttaaaacaccactacagatttagtcactaaatgcaaccactctatacgaaagaggtaagtaataaaaggaaactacattatttacccttgatgttattaggaagtaacttaagttccaagtcataaataaaaataagagatgcggctgggcgcagtggctcatacctgtaagcccagagacgcaaacagctgaaaataacgtatcaactactaggttataaaggctaaaatgtttttgttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtccagtgcttcaggcttaaattacacaactgtggtttagtgcctgtttcgtcagtcagaactttgggagagtttatttgcaaggtgagactcttaacagctgcttatgtagcgagatccaaaaactaaagaaaaacttccaatgattaccagttgaagattagttgaagtgtttcagaatattaaatcttatctagaataagaaagagtccaagatatgaaatagctttcatgtacataagtgctagactgtaaagcaaagtcagaatgaataaatctgataatgcattagacgatctttatgcttatagtcaaaattccgattaatttcctttccttttaatctttatgatttccgaaagtattactatatatatatataatttttttttgagacagagtttcactcttgttgcccaggctggaatgcaatggcgtgacctcagctcaccgaaacctctgcctcccgggttcaagcgattctcctgtgcctcagcttcctgagtagctgggattacaggcatgcaccaccacgcctggctaattttgtatttttagtagagacggggtttctccatgttggccaggctagtctcaaactcctgacctcaggtaatccacccgcctcggcctcccaaagtgctaggattacaggtgtgagccaccacacccggcccacaagtatgatttataacttattctcctttaaaaaggaatacaggactctctgtattaagtatgaccagaaaaaaaaagggaatagcacttcttcatccttatttgattggattctgaattttaaaacacaagtttacagccatgtgatttaattaatatttatcatttacttgaatatagaagaacagaattttacactcaactctcttgatactaaattctgggtatatcaaaaatgaaaggcaaaataaacttaccttcagagaatcaactaaatcatcaactaagaagaggcgcctgagttcctttatcgtgcagttcacatgaccaagagcagaattactgtacttctgaaccaactcctcagatatagcaacttcagattccagatatgccctagaaaacaaaacacatcataattgtcactaattggagtgattttcccctaaatgtcaatcagaaattatatatctgtaagaaattaagaaaatattctactataaaagccaactgtttccaaattaggggcaatataaaaactcagcagtaaggggtatttccttgatatgcactgtctgctgactagcacagaaaaagcatacactttgaagccagactgatctgggcttgaatctgatgctctgccacttacctggctaggtaattttgcaaagttatttattcttccctctaaacttagtttcctcatttataaagtggagattatcatgagaattcagtgagaaaagtgcctaatgcaactgagcacaaggatgcactcagtaaatggtagttatgactatggttgtttttttttttttcttaaagttgacactatgttgtctcatcacgttttcctaacaaagatctttttcatttccaaatcctaaactctctcagactaacctttaggggaaattgttcaatatgtcaagcaccagattgtaaagtggctgccaaaagcacagtagcaatcctagcaaaacataagagttacatcatctagatgttttaatccataccgagatggctaaaattgttaaatttaaaagtattgtattggtaataaataaataaataaataaataaataaataaaaatactatactggggaaaaagtcaagtccacaggaatgtaagaaacagtttcattactgtttcaaagaagccattttatcttggcagggtacaaccaactcagaagtgctgagtgttccctcgtatctgttggaagtagtcctcataacctccctatgtctcaggatgccagtttcttacagtggaaataacatcttagacaactccttgtcccatagttttacctctgcaacatgccccaaatatgtctcctggtttttattcacagtgccatcactctattttaagcacttactatttacgagctggaatattctatcactctccaaaccaatctctgatctgcctgcatccaaatccattccgtcagccaatgccagaataaccttatgtgagctatcttagatagtgctgtctaggctgaactcaagcaagagttagaagacctgccactacctagctatacaacattgcaaaaggcatttaacttctctgggtaagtgctccaactctgtaaatttgagaaacagactttcctcagttccttcaggctcaaacattctgtgattctatgactccaacttttcaaccagggacatcctcctaaatctttccaaccttacttccaactactctttatgttgcagccagaaatgagtcattcactaagtattttttaaccttaatgtagcccttattaatcatatggttttcccaatctgcaatgctctcttacctctggtgataccttatttagccagttagccccatctcaaatctcacccatacatagagccttatctgccaatctctttcataaaaccctgatgttctctctcactcctgtataattctaacaatgctttcttttgtgttagtcttatagtatttactagattcagctctgaaatatagacacatgtatacttgtatatttttcctactagagtataagctgttatggaccaggaatgtatctttactaatacatggtctaacacactgttagacaattattaacaaaaaactgaattattaatatcaagttaaaaatactcaaatactcgcactgatatttaaaccagcaattatttgtttacccaaatttgagaaatataggaaagtggctgatataaccctggttggtattctgcttctttgtaccactgttacttgttcttgctgaagacaagatgcctaagcagaagccataaagacagtactccccatcaatgacatcctgtagatatttacactaattcaactgacatttatgtgatattaatacaatgccagcactgttcatcactcagtaaccacaggtattagatacaaaccacataatatcacctctactagtatgattaaggggtactaggaaaaactgtccaacaagcttaaactggtatgttggctgaatttactttataatgactataaaaggactttaagaatataaagtgtttctagccaggcacagtggtgcatgcctgtagtcccagctacttgggacattgaggcaggaggattgcttgagtccaggagttcgagactagcctgggcgacacagtgagacccatctctttgaagaaagtttaaaaaatgaataaagttgtttctaagaaggaaataaatcactaatattttccaaaaacctcaaaaatcaaatgatgtgtaaaattggaacggtagaaaatttagaagttttggcttgacaatatttttacatatttcagcataactaattaaaaatcatacttctttatgatttgtggcttgataataatatgactcggccttttttttttttttttttttttttttgaaagagtctcgttctattgcttaggctggagtatagtggcatgatcacagctcactgcagccttgaactcctgggttctagcaattttcttagctcagctgcctgaatagctgggactactggcatgcatcaccacacctggctaatttttaattttttgtagagatgggagtctcactatgttgcccagggtggtctccaactcctggcttcaagcaatcctcctgcctcaggatcccaaagcactagtattacaggcatgagccaacacgtttggctggctctgccattttcaaactacaatttcaagttactgaattccaactttttccccatcaccccataaaatggagtgataccacctatctcacagaattatcacaaatttaaaataaacttattaaaatatgtacataaaaggttagacacataggagctattcaataaatgttggtctctccccctaaacttgtataacatcattacttcatcacaaagagaaagccagagaaaaatcaccagtctttacaataaacaaaataattcagtaggtctcctctttcaaagtctgtaaatccatttaagtttacccattaatatcaactggatcatgttgtaggtaggtacatagtcatatgcccaaacagatattaccttgccacaaatagttttttcctttgtttcccctactttcaagctaacaagttagaaatagtttttaaattatctcaatctatttgaagaaaaatgatctccttatgcaaaacaattaacatttcaaaggcttagttaatgcagtaggaactgaattttcggatcatttggggtcagggttaggaaattctccaaagagctgggtcttgaaccaaactaagaaccaaataaaaagtatgactgaggcagctaaggaaggcagcatgaacatgggtacaaaactctggaaggggtaaatgagagacaagacaaagacatatggacttcatcctacagtctatagagggccggtgcattttcttttgttttttttctctttagaaaaaaagtggtacttctagaaaaattaatcggacatcatctgtaagaactgaagtaatccgaggtaactacaagtcaatgtagtaacaaatggagtccaattaggggtcagcaaactttctgtaaagggccagatagttaagcattttaggctttcacgtccatatggtctctcttaaaactactgaattctgctattacagtacgaaaccagctacatgaatgagcatggctgtgttccaacaaactatttacaaaagcaggcagcagactgcatttggccatggccttgctttacaggcccctggttagactgaggaagcagtggaaaagaacaaaattttgtgattttcctaacaatatttagtgattttctttatatgagatgaaaacaaagataacatcaaaacaggagcctgaaaactagcatggtagtggtgttatggatagaaattaacaagtttgaggggaaaagttcatttaaaaacgtggtgaattagtcgttgtcgggcgttggttggggagttgaactgttaataagtaggaagtttctttttgtgcgatgaaaatagtgatggttgtagaattctgtgaatatactaaaaaccaatgagttttatggtatatgaattatatgtcaattaaaaaagagggggaaaaacacgcagagtatgaggtgagggcagaagactcaagctgaggttgtgtctccatagcaactatataatgctatagtatacttgtgaaaacaagggtagaagatgatagttgagagacaaggagatgctgaaataaagctctccaaaaaataattaaaaagtaaagccttaagaaacgagaagaaactagataaagaaaatacataaagaaaagcataacagaaaacatcagcatactagaaagatacgaaatatcagaaagcacgttatcagacagcataaaaagcaataaagaatatcctcatcaaacctacccatgttaaaaagatacaacactcattcaagtaagataaccaatgcttaactctaataaatattcctaacaagtagcagagttagtttaatgatacataaacagtctcctccatcatgagcctttaaaacgacttttagaaaatctcaaaagcagatgtttttggtatagctcaagcaaataactgcaattatctttaacaaaaaaatgcatgcttgtaactctatagacagtagatgaagtcttaataccaatcctgtttacactattgccaatgcatgccttgttttccagacatctcacctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactaaaaattgaaaaagaaatctgaaattagaatgttattttatcaatttggatttgctccatctatgaaaacaaaaacgctactacataaagtaaaatcaaacctaaaaatttaaagaaacactaagttaaagaaacactaactttataacccacattttaaacccactcttagttgtatattagtataacacctttatttttgaccacgaaatgttttttattcaaatttatttctgcataaccaaatcattctagccatacacaatgattaaatgtctccaaagcctagaagacttctaatccaaaacaaggagttacttaaaataatcttgggggctgggtgcggtggttcatgcctgtaatcccagcactgtgggaggctgaggcaggtggatcacctgaggtcaggcattccacaccagcctggccaacacggcaaaactccgtctctactgaaaatacaaaaattagtgaggcatggtggcgcatgcctgtaattccagctactcgggaggctgaggcaagagaatcgcttgaacccgggaggcagaggttgcagtgagccgagactgcacctctgcactccagaatgggcgacagagcaggactctgtctccaaaaaaatcatcttggggtttttcatctcatacaatgcatgctatatattcaaataattcaataaatatattccaataacagaaaaaatattaacacactaaaatgagatacttcagtgataccaaaatatatttatatgcagaaaataaatttaaaaaggccgagatacaaaaactacacatatgaatgagctttttttcttatttgatttttttgtgctagtaataactctgctcttaagatctgtcttttagaaacaaaattgtaacttaacctggctatcattaaaagaagaatttcctacaaagaaaaagacaaaacaaacagcctttcgattacctgaaaagctacttccttctaagagttgatagatataatgccataaaaatttaggggtcaaagaaaaaagaaaagtaaatgtgttacacatttacataatgtttattaatagtaaggagtcagacaaagcccaatttagcatgtctgctcttggacatggccacagggccactgaggggatcaagtaagcatagcctgatgtctcaaaatcgggttatgctcaatgcaaggagaaccccgaagtgtgccaaagtgctcttgaattcataggctgatgtaattaatctctctctgaactgtgaacaattgggagaaaaaaatttatagtaaatatggatatactctttctaagaagaggtgacatcaaagaaaaatcacagttttagggctgctttggttttgatccccaaggtcccctaagatgtatgtaactttcctttgctcttaagggtacttctgtagggaaaactatgtatgtgaactgcacaatgttggatattagtacaaagcccttaactgctgctagtatatcatgagtactgtttaggatattttaaatgcccatcactgtgtccagtacatagcagggattcaaacacttatttcagttgcctaaatggtctggcttgaatgctattaatttaacattctatatatgatttcgaagtttgttttcaaactctgatttcaactatttattcaaatattcccaaacttgtttgttacagcccctgcctaaaacatctaaaggcgcttagtgctattccactagtttctactattgtactagcacaactgaggactgacaagaacttgaaatggcctatctataggttgtcaaagggacattacgaataatgtcatattgaataaagagataagagcaacgctaataggtttctggcaatcagcaaacacttaatgaggtgaaactgttcaagtaactcaacctagcagaatgagaaaactcattctgattcttgaaggtcttgtccaacattacaattctaggaaagataagacatataaaagcaagtcaatgaaggtataaaataaacattgcactgctataagaactcagaaaagggaaaaactggaagaaatgttaagactgtgaaatactgtaaatggaaactgagctgggtcttgaagaatgaatgcgacctagaaaacctaaaggtacaggcctaactgtaagcatctttctgctaacagtggttctaataattaatgcctttttttttattaggagggtacagtgagagaacacggggagtgatgataaagacagcccttggtaggatcactctttcctgtgaggctgcctttgtaccctacaacggtgacttaatacacacaaacagaaaacttaggttctatagttgggtcacctagactaaaaaaatggttgaataacttacgagctacgtgacctcaggaaagtcactaaagtcctctatatttcagtttcttcatctataaaatgtatattaaaataggaatgaacaaaaggcataaagtttctagatagaaaggagaaaaaacttttgagatttactgcaccccagggtgacaacagtcaatagttgtatgtatttcaaataactgagagtaaatttcatgtctcaccacaaaaataataggtaacaaggcggtactttaataagtttgatttaatcacaccacattgtatacatgtcaaaacatattgtaccccataaatatatacagctatgatttgtcaataaaaaaataggaatgatctcattgagatgtgattcactagatttttcattagtaagataattaatgtaaagcacttaatagagtacatagcatacaataaattcttaataaatgtcagtgctatttgttgctgttattattaccacaatcacaatcatcttactcaatacttaaatagtaaatacataaagaagaaaatttcaaacttattattaactttaggttaataaactatactgttgtgttatattgtaaacatgttactttataaaccatatgggaaagaattttaaagcttatctaagtttttactattatagggtaagtaaaagctaatagcccaaaggaatcagcaagtaaggtgtacctcaaatatatttttcttttactttttttttttgagacagagtctcgcactgtcgcccgggctggagtgcagtggcgcgatctcggctcattgcaagctccgcctcccaggttcatggcattctcctgcctcagcctcccgagtagctggggcaggcgcccgccaccatgcccggctgattttttgtttttttagtagagacggggtttcaccgtgttaggaaggatggtctcgatctgctgacctcatgatccgcccgcctcggcctctcaaagtgctgggattacaggcgtgggctaccatgcccggcctctcaaatctatttttcatatgaacaaatgctcctttataaaagtggttctcaaactgctcagaaacattaattaaccttcaaaatcactattggtgagaagttaaagtaaatgcagatgtacttgctattttttaccatcattaaaaactactcagtaaaacctggccatgaaatcaatgactttagatttgagaggtttgcactgtacaacataaattaatgtctaatcaaacttcctaatattataacagagttactgtttaaacaggtgtagtgactatatatgaattatttataattagtctataatttctacctaaatgaatatggtagaaggaaatatcaggactgggattcaagagacccacatcctagcatgtaccagctcagcaattgtgtgattttggatacgactccaacctctctggccttcagttttatcgtccataaagggcattaatcttctaatctctcttttcccttaaggaattaacatgacccacagtcagtacaaagatacacacattagtactgcattcaaattccctgtcagtggatccaaaccgatgaagttttactactggggcattatctgtgctcaatataattttaaaatatttccttcctttttagatctagatttttttggggagaaggaagcttaaatatttttattcataccagtcttctgatttgaaccttcctagaaatatcttaagtaccagacattattaaaactttaggaaaataacaaattcatattcctacaatttttcaagcaattataaactctatcattatggcaactgtatgagagaaactttttaaaagtttgaaaaatgatacgcttaagcctgatagatgttttgattgctgatctacattctccaatctccacacctcctttatgccaaacactgcagtagcctatacaacattatctctttcaattattaaaacctaatgagccactatgcaaagtgggttatgcctgtaattccagcactttgggaggccgaggtgggaggccaggagtttgagaccaggctgggaaacacagagacccctcatctcttaaacaaacaaacaaacctaatgaaaggtaggcttgaaagagtgaaacccagctcctacatgactagacccagatcacatcattaataagtggcagaacatggatctgaacccaggattcctatggataaaaactcatattctccattgtatgatgccaaattgaaggcttagctgattaaagtgcttcaaaatgttatacgtgtgcatgcataacaaatgggcaaagtgtaggcagataattacaacatgcaagatgaatcataaaggccaagaagaaaagctaagtgaaattaacaagatagtttaatcaataagggacaaattttaatgtgaatatttcacctactgttagacccaaaaaccgagaacagggctttactccaatatatttgataagtactttcccacagtagagaactataattaagttgttgaaaaatgacttttaaaaactatgtgaatctaattaaataaaatcagggtatatttatgcaagagaaatgtgtagccattaaaaaaaagtgatacagatctacattatcacagaaacatgtccataatgataaatgaaaacagcatgttacaaaaagactcacagtatattctcacttaagaaattaaacatatggccgggcgtggtggctcacgcctgtaatctcagcactttagaaggccgaggcaggtggatcatgaggtcaggagatcgagaccatccttcctaacacggtgaaaccccgtctctactaaaaatacaaaaaaaaaaattagccgggcttggtggtgggcacctgtagtcccagctactcaggaggctgaggcaggagaatggcgtgaacccgagaggcggaggttgcagtgagccgagattgcgccactgcactccagcctgggcaacagagcgagactccatctcggaaaaaaaaaaaaaaaaaagaaaagaaattaaacatataactatgaagtctgaaagtatatctactaagcagtgtttttatctctgcataacgggattatcaatgagttttacttgcttctttactcttttctgtgccatctgaaatggtcccactctaatggcaagcatgaatcatgactataatcagaaaaaaattcaccccattctgtttctattcggtactactgaagagtcttatgagtgttatttttcccagtaggctttcctattggaaaaagaacaccctgtctgttaggttaataaatatttggatccagccaacagttaaaattctagcagtatataactaagttgatgattctggtgttctgcgttgaatcaagtcaattttcccaaagttaatgataccagaatagtcatgtataaggcccagcagtactcaatgatagtaagccctaacctaccacttcctttcctcttgtcatatggttcctaggaacacggtcttttcaataaatggaaaagctctgaaaattacatacgtaagcccacacatactgaataaaaatatgtaagcagctacatgagagtagctcaaagcaggtatcatgacagacatactgaaacaagtactaggaatgctctggtggagccatcagaccctttagagccctggaggaaaacaaaaagggaagaacagccaagagaaatgagacaactaggcactgatagtcacacataagataatatgaatatatcctagaataggaacacctgagaggcaatctacactgccaccaaccccactgtgcaaagtacagaagaatttccatctttttccgtaaagaagctgaaaagattgttagtgaagctgcaagaatgaaaaaaatattagttgataccaaacagtgtggctgacttaattgacatttgccaacaaaatttctagtcccttacagattcctcaaattggttttaataaaaaaattttgaaagattgtttatacaggataaatgattctcaataggaggaatgtatagaactttattaaaatcccttctgagaaatatagtgtttttctgagaaaaatactgttgcttctaatggtcaacaagagaattattagttaatttagatttattagttaacttagaagtttgttcaatcctgataccaaaatcagacaaagacatcacaagaaaggaaaactacagataaatatcccttatgaatatagatgcaataatccccaacaaaatacaagcaaactggatcgagcaacatataaaaaagattatacaccatggccaagtggcctttatctcagaaatacaagattgattaaacatacgaaaatcaatcaacacaataaatcatattaataggataaggacaaaaaccacatgatcatcccaacagatgcagaaaaagcatctcacaaactccaacaccctttcaagataaaacatttaacatactaggaacaaaatggaacattatcaacctgataaagagcatctacaaaaacccacagctaacatcaaactaaatggtaaaaatctttccccctaagactaggaacaagacaagtacatccattcttgccacttctggtcctgggggtgctatgcagtgcaactggccaagaaaaagacatacaaggcatccatattggaaaggaagagattaaactctatttaaagataacatgatcttatacagtaaatcctcacttaaatgttgaggatagctttctggaaactgcaactttaagtgaaatgacatgtaacagaaccaattttaccataggctaatttatataaacaagacttcattttctatggcatatttctggtcacaaaaacatcatcatattctaaataaaggtcgggcgcagtggctcacgcctgtaatcccagcactttcagaggccaaggcaggcagatcacctgaggtcacgagtttgagcctggtcaacatggtgaaaccccatctctactaaaaatacaaaaattagctgggcatggtggccggtgcctgtaatcccagctactcgggaggctgaggcaggagaataacttgaactcaggaggcggaggttgcagcaagctgagatcacatcactacactacagcctgcatgacacagaaagaccctatctctaaaaaaaaaaaaaaatctaaataaagactcaaaacacttctactattaaacactgaaataaagtaagctatatatacatttaagaaagattttttaaaacacaatttttggtgaatcagtgatggtggttgtagtggtggtgggttaaatcaaggaacaaatgtctgcaaagcaaatactgtggtaggagcacctcctaccaccaccacacagttcagaaacaacaaatatggagggatctctaagtgccttcatactgcatcatttattgttgtgcatttgcatgattattatatactttatgggtttttattttataataatctgtattcattcattcattcgttcattcattttctaagctgcttattccagttctgggtcacgggtggccagagcctatcctgacatctcagggtgcaaggcaggaaccaaccctggacaggacaccattccatcacagggcacactcatacacacacccccacactcattatgagacaactgatacacaccagtgaacctaatgtgtacatctttagaatgtgggaagaaaccacagagtacccagagaaaaccccatgcagacatggggagaacatacaaatcccatacagacagtggccccagcaaggaattgtttttttttctcttcctcatgcacattataacgaaacaacactgaacaaaacaatgatatgagggtctgttgtatgtattttaaaaattctaaggaatccacaaaaagctactagaaataatgaatgagagtccagcaaggctgtaggacacaatatcaatatacaaaaattgtatttctatacactagcaataaacaatctgaaaatgaattaaataattccatttgtaatagcatagaaaaaataagatacttaggaatacagcgaaaagaatttcaagacatatgaactatacataacacactgtcgaaagaaattaaagatgacttaaataattggaaagactcctgttcatgaattgaaagacattaagacagtaacactcctcaaattgatctaaaatacaaacactatcaaaatcccagctgtcttttagcgaaaattgacatgccaattgcaaaattcatatggaaatataagggatccaaaaaatcaagaaaaacttgaaaaagtacaacaaaggttggaggactcgaacctccctatatcaaaacttcctaaaaagatatagtaatcaagacagtagagtagttacacaaggacaaacaggtagattagtggaatacaactgataacccagaaataaaccattacatttatggtcaactgactttcacaagggtgccaaggcaactcaataagaaaaaaacagtcttttaaacaaatggtgctaggacaactggatatccaactgcaaaacaaatgacgttggattcttctacttcatatcacacataaaagttaactcataacggccgaaagactcaaagttaagagcttaaactagaaaactcttttatctttgtttcttatctttttgttgttgttattgtcgctgagacaaggtctcactctgtcacccatgctggagtggagtggtgcaaaagcaggcagcctcagcttcctgggctcaaacaatcctcctgcctcagcctcccaaagtgctgggattgtaagcatcagtcacagcacctagccagaaaactctttaagaaaaaaataagtgtaaattttcatgactttggattaggcaattgtttcttacatataacaccaaaagcagaaacaacaaaagaagaaaaaagataaattggacttcattaaaattaaaaactttcaccacaaataaagtggaaagataccacacagaacgagagaaaacacttgcaaaccaattctctgataagagacttgtactcagaatatattgaaaaacttttacaacagtaaaaaacaatttaaaatagacaacagatttgaatagacatttctccaaagaaggtacacaaatggccaataagcacatgaaaaaatactcaacatcatttagtcattataaaaatgcaaaccaaaaccacaatgagataccacttcataccccctaggatggctataatcaaaaagatgagcaataaaaagtgttaacaaaaagtgatgaagattagaagcctcatagattgctgatgggaatgtaaaattcagccactgtgaaaaacaatttggcagttcctcagaaaattaaatacagagttatcttattacctggcaattccactcctaggaattttcacccaagaaactagaaaacacaaaaacttaacacacaaatgttcatagcagcattattcatgatagccaaaaagaggagacagacaacccaaatgtctatcaagtgatgaatggattgttttaaaaaaaggtatatccatataacagaatattattaggccataaaacgaaatgaagtgcagtagtcctcccttacctgcattttccctttccctggttagagtttcctgcagtcaaccacagttaaaaattaggtgagtatagtacaatgagatattttgagaaagacaccacattcatttaactttagtatactgttaccatgattctctttcattgttaaagttgttaatttcttactgtaactaatttataaatttaactttatcatagttatgtatagataggaataaacagtatatatagggttcagtcctatctgcagtttctagggcatacgctaggggtcttagagtcttacccctcaagaataagggggaaactactgtactgatacatgttacaacccagatgaatcttgaaaacatatgctaagtgaaagaagccagtcacaaaaggccatatattttatgattctgtttatatgaagtgccttgaatatgcaagttatgaattctgtagagacagaaagtagataagtgattgtcaggggctggggaaaaagggaagaggagtgactgctagagggtgtggggggctttttttgggaggggggtgaagaaaatgtcctggaaatagatttaaaactttaaaaaaatagtcatttcaacatacttctctactaggttgtaaactccataaaagaacatgtatgtcttactacctaactttatccccagagctgagcagaaagccaaaaacaactaaattttcaatattactgttgactgattagaatgaatgaataccttatgacaggtcactaattctaattgatttatttaaaaaatgtttctacgctttagacttaacatttattttatttacactattttcagatgtctacatttattaaataacaaataatgctttcaggtaatttataaaaaagaaaacactgttttgcaggcttgtctccccttactagaccctggaaaactgataaatgcctttcatctttatattcccattacctacatcattaatgcttgctgcactgtctgaatagcggccagattatttttagaacagaaacatttaaattcattttcaaattaaaataaaggacacctttcaataagaactacaggatcaccaaaatgctaattttggattcctcagtaatcactttagtggttccttatttttgaaaaaccaaaattaagacaaagagtttatacagggaaagtttaacttttcttggttcctcaagtctccttctatactgcagaataaagggttaatcatacaaggtaaccctattctgtggcctcaaccttactcatacaaaatgttcattaaacatcctttcaaagatctgagatgaatttagcagtacttttccatttacaactttgggggaatgcttatgaattgctaaaaataatgttcatcaattttaacaaacccttgtagtttagaaaaaagtaatttatgccctgcagtccttgccgtttgtctccaagataaaaatgtgaaaaatgactgtgtgtaatagcatctttatcaaaataaaattttaattcaaaataactcagtacacttaaatcttttctttaaaataaaaacttctggctcaatgcacagtaagaagagctgcctacatttggtaatcacaaactgtcatctgccatagctaaaaatagtgtcagcctgcattgtgcatgccttacgtgcagaagtcatccaattacattttgcctcaaatcaaattcttacattcttctttgaacagcccgaagtcaggtttcaattttaaaaagcttttgtctgggaaggcggggcagtggggagttaaactggctgttcctaaaaatactaggacagggaatggctggcagaaaaatacctacttttgaagcaaaagcaaatattaagttctctttaataatgccaggtgaggaatgagaatggcagttaaataggaaataaacaaatgaatatataaatattagaacggtattaaaatttcagttgtttttcacaaccatgtttataataataagtaattatatatttattaagaatcacaacccttaatcaaattcttcccaaatgccaggaaaagtaattagaattcagaattgaacatttagtactacgtaatagtaagcttttgtctcaacacagtaagcattcacctgtcaaaaaactgacaggcgaaggtccacaaaaaggatctgtgcagagtttagctctcttcacaaagacattaagaggaccttaagtcctatttcttttgagtcctatttcttccttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatgtaaagaggtttcaattagcaagtctcagcctgatgggtacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttcccctttctacaataattttgtaatctcccagtctgagcaaggcactgtgctgagtacattgtatacattacctcgaatccataacaactctaaaaagtattatctgcattacatatgtgatgcaaatgtatttgtacatttgtaatgtaaacatattgttaaataaattgtgtagggttacaaactgaaattcaagtctgaccatgaaggtctcactctattataccttttgtatttaaaagactatattaatactcaagtttctttttatgctacttgagaataccaaatgctatttctaccttagtttaaataattgagacaggagacacaatttactaacactacgagtagagttataggtgagaccaataaatttcattaagagattcaataataggaataaaccatgttttgtttaaattgttttctagaagcaatctgaattgttctcaccttaaaaataaatttatactataaataacaatctatgtaattacatatgaactataaaaatagataaaaaagacattggtgaatttaagaatgatattaaaatttttaaataagcaataaacttgacaaacacagcatataaagcaacgaaaataccatttctagaaaatctccaggaaacagaagccaaacataaagatgtgaagttaagtcaatgtttactattcattttattaaaaaaccaatcctacacccaggatagaaccttattattattactgagaacaaacggcctttacaattaaaatcgttgtaaacaccgagtgtgttttcacacacatactcctttccccacataacatgaactaaaagatggtttgtgatttaaaaaatatgcgtctctagctctctagtaaccaacactatttgaggagtacaagattctcttacccaagtttagtattgttaaatggtccctgcagttatgaagttgcataggaaagaaaattttcataaataagaaaacatccactaagtaatcttcaaaattaatccaagctcataaatatcccttactgtttaaattcaccatccagcctcactcattacctaaatgtcttgtcagataaaaccacccaaatcaacagtgcaaaattgcaaatcttcctattaacatgaaattccacaaagttaatgttgtgagtgatgctggagaattgctccaaaaaacactgacagtccaacaggcacttcaaaacggagcctctcacttcaaaagattaggaagagcccccaggaaagtacatttttaaaccactgaacattttttgtaaagggacattatatatgacccactgtgaaattcaaccataaagcaaaagaagccattttgtgctagtatacaattttgtggcaaaaattacattcccctaaatcccaaaaacctgattcatcctctatgtattctaaaaccttatgcacggctgtgattataaactaaattatgttaagaatgaactaaaataaatttattttcatagttattggtttttatgtgccaagataaagtcaatcaaatcttattttatttatttatttatttatttatttaagacagtgtctccctctgtcacccaggctggagcagagtggcatcatcatagctcactgcagcctcgacctcctgggctcaagcaatcctgccacctcagcctcccaagtagctgggaccataggcgtgcaccaccacaccaagctaattttttaaaattttgtagaggcagggcctccctatgttgcccagactggtctcaaactcctgggctcaagcagtcctcccactgtggcctcccaaagtgctaggattacaggcgtgagctacaaggcccagccagtggtctttttttcctatatttcaagtagaaaatgcctcaaatatgttgcaggaacataaaaactacctatggctgtttgccatcttctaaggataacacgaatttctctaagagaaaagtgaagttcaataacaccatacatgcttcatttataattaaattcaccagtttacttcattagttcatgtggttttcaatatttcccttaatcctacactctttccagctttactaggagaaaacaagcaaaaaagggcagaaaacagttctaattttgcactcctagttttcctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaattgatcaagacctgcataaatagaaacctaaaattagaaaataaactggttcaatgtataatttactatagtttaaattttccttcttgttggcccatctaaagcttaaaataagtaggcaccaagtcttagaaacctgaggttactgctcaaaaccctattttctactaacaaaaactaaatggaaaacatactgtcccgtaactctagaaacttgaagcttaatatactggagttgggggaggggaagagctcaaagcaaattactagttcaaaacacagaatgaacctcactagtaagtaaatcagttatatttcttcttccataaccttatataactgttgtacacacaatataaatgttcatcgaatcaatgaacagtacaaataatcattaatatttgataatttggtaatttttcagtttttaaattgctttgagcttcataagaaaatgttatatagaatatggtagtgatatagtatttgaagaaagacgacacaaaatattttagtgtctataatacgtccaatgcctaaggggcagctgaatcaaacaaacttgaaagccatgaagcagattaaaaaaaatacacacacactcagtaatatgtcagccttattcatgatagagcagataaataagtataaatgtggtgtcagatcactgctccaaggatgcaaagaaaagtattgcctaaattaaacatcatcccttagcccaaattctagcaagagatgggaccaagtgaatacagtcagccctctatgtctgcaggttccacatctgcggattcaactaactgtggatggaaaaatgtagctagacctatgatgactgcatctgtaactaagcaagtacagacttttttcctgtcattattccctgaacaatataacaactacctacattgtaaaaagtaactcagagatgatctcaacaagatgtgcgtaggttttacgaaaatactgcaccattttatataagagacgtgggcatctgtggattttggtatccatggtgtagggggacgcggggtggagggctggaaataatctcctgcagatactgagatggctgtacataaaaagggaacttaggggacaaccggagaacaaatttaagaattctattctctgcctagatattctgcctacatcccagcatgtaatccaatcctgaaagatgaaaagaaattattctcctggcccagagaactcccactaggtttaaccttttgacaatacctgtactaaatgactaaccacacctaccttcttccatgattagtgtgacagacaactgcctgccttttttattgcagtgaggacaatacgaaagaagtatacgacattcaataacatgccacaagtagactatgcacaaataaaatatcaaaacatgggccgttttagcttatatacttttcaatctttggttattcaagtgcaaatataaattataaaataaaaacaaaggcttcatgccaccatggacctgtggcatggtcctgtgtgggcctgacaaatatttaaatctctcgttttcttggtttccttgtcagtaaaacaggaaagttggaataaatgattaacagaatgccttatctgcaggaatactctaaaaattctgaatctacagaagttccttcagttgctgaattgttcctttaagaaggggaaaagtgggggaatcctttttctaattgctcccacttgaaatcatattttaaaattttccaaaaatttatgtgggtttaaggccagaagtaaacctggctgaacaatggagttctcagccttttccttcattgacaagctgcaccaagtcaatcagaagacccagtgatgaagccatcactgtttttggccttcaaaaaaatttggaggctggaaaaagagccaagatatttatgtataaataattgtaatagaaagtacaaaatgaaacccctcatgcccttcccttaggggggaaaaaaaagtacaaaatgaaaaccgagagatgggagtgaggaacactgaactacctccccagggaggcttagtgaacacctcaaggagaaccgggcctttgataaggactacttcagcaaaatgaaatgggaagaaagggccttcaaggtggagagaaaaacacaagcaaaggcaaagaacaggtatgtttagaaaacgagtccttcagtgtggctagcgacagggagtaatgacagacgaaattataaaggttggggctaggccatggaatgcctttcaaacatccaggatagacagaagaaacttcatttgaaaagtaagtaaaggaaaatcccttaagtgccatgattagagttgcactttggaagagtaattttaatttcgctgtgacacacataatttagtggaaagatcagttaggggccctggtaaggatgaggagtacacagacttgggtaaataaaatagaaaggctatttccaccattgctcccactgcttacacatcttacaatataaagctggttcttatcaagtaatttaatgagttaacactgacgaaatagctatcttagagtaaaaactgtaagaaaggaatacatactatttaaccttagccacagatccatgatagacactcacattcactgatgaaaataacaatttgtacaatctttctggaaagcagttttgtaaaaggcgcccaaagcctaaataacataacccagaaatttggaaataatcacaaatagaaacaaagacttatgttcagttataatcattttagcattgtttttacaggttgagtattactgtaatatgtgggactagaatatgttggaatatttggaaatattttggaatacttgcatatacgtaatgaggtatcttgggagtgaggcccaagtctaaacatgaaattcattctgtttcatctacatgttatacccataggctggaagtaattttatgcaatattttacataattctgtgcatgaaacaaagattgtgttaagtatttatgtgtggaattttctacttgtggtatcacatcagcgctcaaaatgtttcagactttggagcattttggcttttagattttcagattagggatgttcaacctgtacttgcaaactttagcaataacctgatttaactagatggaattaaaatattgtagtcattaaaatagcgtacagtatttaaaaaataaatacttaatggaggaaaaagactacagaataaaatataccacaaaaccctcccaacacacattaccctgttaaaaagataccccaaaactattctctatgcgatgtgagttttactcttctacttaccttctaaattctctataacacatacctatgtagtgctgcactactaacccaagatctagaaaatgtatctaatgaatgcctaaatattcggttttaacaaagtttagaactgaaaggagagtcgttccaatcagtaggccccataattaattaatgccaaagttcccttgttgggcattttttggccttcccgagtaaggcatttcaaacagcaagacccctgctactctctaccaaaatgtcagtatgagctttattcaaggctttcaaaaaatgaaagtagcttatcataagtaaagatcagagagccctaaaagaatctctacacggaagtatgctgcagaaatggtccaaaactagtttgtcttgagatataattatattgagttttaatgctaggaacatttctttccctatcctacagaaacttctctcaaagattacctctggcacattaactgacaaatccaaagagtactgtaacaataaagaacagtgttgcacctacttttaaaatttaacaagattcacatccatttctcactcatattaaccagcttctctaagtatttaattgcccattccttcttgaaaattctttccccccttagtatcagttacactatcctgcttcttttactgctctagaacctcctcattttccctaaagccgcagacctccataacgcaggttttaggcttttctttcttaatagttctttcagtgcaaatctcctcacatagtattcacctgcctcactctgcatttgactcccaattctttatcattaaacctgtcatttatctgagcttccgagatgttctatcatcacttcaaattcaaagcgtctgaaactcaacttggcatcttttctattttagctctatttctactaatactaaaggactgtcattgccaatatttcactctaattcaaacttcatgttgccccttgagtctttacacctcatccttgtcctgcaaatctataccaaatgccaagtattccttccttgaatttctcaaatctgccgcttcttcttccttcctatttcaggccaaattcaagcctatctactttaaatctgggcacaactacagtcatcctaactggtgtggctataggttattctcccccagttgatcttatgcagcaccctaaaccaactgctatcatttaccattccctactttaaaacttccaaatcctttttatttcttttacaatcaaatccaaaactcaatgtcttctgcggtctggcccagggtatctcttccataaaaccagagaacctctcaactggaaccctgggcagcacgcaaatgaggaaattaaaaccaaaaaggtaagtttcttattctagccaaaatcaaaatataccagaaccaaggcttaaaccctagatcactgtttcccgaatttgcccaacaatatgaattacaccaggatgcttaatatgcagattgccaggccctacaaaatctgatttggtaggtcacgacccaaggaatctgcatttttaagaagcactagatgattctcatctacagagaagtatgaggaaacctaatctagttcatctaaattttctacattccttgaccacaccaatcttatctttcaactcctgtcctaaatattctgttctacccagaaagttatttactgtctcaactatagctttttagtggttatatcattctcctaccccatccaaatccctaggcctacccattccttcctattttaagctcctaaaaatcttttgactaccttaatcaaaattttccatataaccccagtaatcgaatactatgtaaatgtcatttgtcataagtatcctaaacagaaaatatgaagaatatataaaagaatgcaaattattaatgctttcagcctgaaagatcgagtatcttaaataccagttaatcggcaagcaaacacacacacacacacacacacacacacacacaccaccttttaaagaacactgaaatcagagcatctctcaaatctgtcactatgctatactggtggtcagggggagaatgcagtagaaaaatgcctaagtatattttttaaatttacctagaccctagattaggctccttctctgctgtcaaactattttttttttagatgaggaaaaactcattccatgacagcttccaacttctcagtgatttccaacttaaaccttactctgtaatcttaaatattactctgtaataataaaattgtctgctgatagagaaaatactaaaatataatttaaccactgactcagaaaaacaggcaaagttaatcttaccgaccaaaacagccagacaggtactaaaaaatattaggccattccacttacaaagtgaggctccccagagatattcaggagtaaattcaattttacatttgagtacctaaaaataatcaaacaaatctctggaaaaaatatgaactacattggaacttaatttctcctgtctcataatacctttaaattacttcaacaaataaagaacttaagatgttatttaatgatttaagacttaagttattaataaagaaccttaatagttgcagaatgagccctgatacgacttttcacctacttttaaggcctgtatttattgtattattatcatttgtatcattttcacttagcaaaagctaccatatatcaattcatcaatctgtaacgtcaacggctaacaggatgaagaaataaaaatccttctctttaaattcacatgtaaagaaatcctaaaggcaaaacccaaagctgtattgttttctattattttttaagttgcaaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttacgtagaatgtctattttggactacttaaaaatagctctaataatttaaaggtaatttattataagtggtcagatatacagcctaccactttcttttaaagaaaaaaaggtagatttaaccatctacataataaaatattctttaaatattctagtcaacattttaccatttacaggcttaaattcttacacaatgatccactgagatttgaaaggatctgggctttcaagggggaggaaaagggatcaaaatcactgattggttattacaaggacaaaggttagtgacttaaatatagacatgcatttaaaattactgcgtaattatactgtgtaatttgaatgatttcaagatgcacataatctgattaaaagaaagttggtaataattttaaaggttcaaatcagattttcaaagaagaggcttactgcaaacacaatatcttgctacctacaaacctttgcacagaatttcaactacaccaagtaaggttttttaaaatagtcacggaaaatatgtcactgtgaaacacaaaaacagcaatgtgtatttaccacatccaagtgacgaacaaatgaaatctgttagatctatattgtttacaatgtgcaagattagagaacagaacctaaacggcaggactgaaaagactaaaccgaatgccagtgaaacagaacagcatgacattttctggtatacaaccaaatgtaaaaacacgtgagatagccgttttaatcctttagacttcaactcttcagaggtttcactttcaatccaaaatatctaaattccaaagcttattcatagaaatatattagtggtcacatataaaaactgaataagaaattaaaaagcagatatacccttgtccttccaatttttcttctgaccgtccatctcttgtcacgatctgctttgcagctccaattattaattatgcataccaacagaaaagctgtaactgcacaaacctactccctgagacatgaaatacccgtttcctcaaccgaagtctgcagtctcctctgctgcacaactgcagcaggactgaagtcacctgacgtcttctgggtgtggaacagtctgacgcagtgcaatctgtaactaggctactaatactccagcattaatgctttccttctatctgttgattgttttaggcatttgccttgttgctcataccaaatggagctgcatttgcagggagagggcaggctaccaaaagaaaggaaataagggttgttcttagaactaaccactgaatgtatctgaaatgcaattaaagccatatgcagtttttttttctttctttttttaacagatggtcgaattatgctactggttttcagtttcatttaaaactctaaaattaatggttacctaataagataaaaatggactgatcaaatattaatagcctaaatttcaagcttgtgaaatgatgagtctccttaattgctcctaagttcattaagacgtaaaacattcagcattttgcaccttatgaagagataaacagaaaataaaagtcaaattactaatgtttattgaacatattatttgaacagaaaactttagcaacttaatcttcctaatatcttttttcctcttttacaattatggaaatccagagacttacaaacatacacttactcttaatcatcatctgctccaactcaatctttgaatatttattagacacctctacagacagtattaatagattcttagcttggggagatatattcatgggctaatgatataatctgccatgggaaaatgacataaaagcaaactataattttattttattttttatttttttctgacacagggtctcgctctgtcaccaaggctggagtgcagtggtgcaatcattggtcacatggcaacctcaacctcccaggctcaagagatcctcccatctcagtcaccacaggcatgtgccaccatgcccagttaattttttatttttacactttttttagagatgaggtctccctgtgttgtccaagctggtcacaaactcctgggctcaagcaattctcccacctcagcctcctaaagtgcggggattacaggtatgagccaccacacctggcctaaaattttactgaaaaatataaaaacaaatctatgtacagcatttttaaaatctgtgttcaactttataaaactgattttcattccaatgcagtgtctctacttatgttccacaatcaattcacctgatacttatatctgcctaagcagaaaaggcactaacaaatcagctaaaatattttaaaatgcaatttgcgaaaatactataagatacgtagcctatgtacaaaaatacatacttaagactgtatagctaaaatgaaatagagataatattttctggaacctgctatctgtgggctgcaaaatccttaatatcagaagtggcttgatattaatatatactcctattatgtacccaaaaaaactaaaaacaaaacatgtaagacttaaacatagaaagaactaaaattaggaaaatgagaggggaaaaaggaagtggcttgaatatcaatgacacatttatttccctatctgcctctctaactccaaacataaataaagaaaagtaatttttaaaagagcccagtattctcagctcgagttaatatttaactttaaactttattcactgaacccctgcataatgtgatatttgagaacccggtcagcaagccatatcatggcctgaaaatgtctggcctctccacgcaacattcagaatctcaaactatttagtaaatacaaaatactgactttctaataacaagtcccttaaaactgaaagccaataaataacgagcattagaataaaacactcaactatagtactcaaacactattttcaagtcagagattacttcactagtagaagaaaaaagttttactgtgatcaagttactcggcacttaagactacttgtatcttccgtggtacttgatttggcttaacaattaaagaaaaaagtctgagaggggcaagaatgtgtaataagacatacccactcatctaaacattaaacatacttaatagcacccctgacagattaaaaagtcaaaataggagccctgaagtttagtaaacatttcagcctacatagtgacatctacttctttaatttttatggtctttgtaagtgtacaaggaaaactagcttgtggaaatcaactgacattttgcccagttctttctcacaaagtttttcaactagacttgttttaagtttggcaagttaagcaaaaaagtgcttaaatctgaaaaactgatatgacacaaatttgttaaagatgtaaagccagatgggctatgtttattatgaaaatcatataatctctactaaaaatagaaggctttaggacattgcctgacaaaaagtaggcactatgtaagtgctatttacttatcagtatgctaaaaataacaatcaaactaagaagcaacaagacaagtaaggcacatctaagaaagctcatatattaagtccttcaactctaggcaataacccaatctttctaaacagaattgccccctctcatacacaaactattgtcgttgctgtatagttctattattttccagctgagaaaaatgtacatctgcatagtttataggtcctattccacaatgaaccccaacttaacaagtcaaataaagaaaggacataaatctgttaaaaacttatcttcatttattttgttttccttcaactacctaacttttaaaaaaattaattcttttgaggacaattttcaagtagagcacatgtctcaacttgcagaatggcattttgactatttgagacaggaacctcttttcccataaaagcaaaggctcacaaaggagaggccacagaaaactcctttatttatactgcaagccaataaaagtgttgtatgaattctaagccctatttcatattgtgtgtttgtggaggggagaagaggggaaaagtattctccttttcctgaactcaaaatcagctttatacagaacttttgaaataaactgttcaaagttcatatttggcaatttcccactcctcaatgtccatgtccccagtatccccttctcccaagcatgacaaaaaaatcaaagatgaaaacttgcccaaatacatatccataatgtctttcctttgcatcttatgaagggataagctctaaagggtaatatgctgtaaaattacctacacggtttcttttctcacatctcagaccaaaccctcgtttccttcatgcacttacctgttaagtaggaaatacgcataaatcaattcctactaaacaagaaactcttttatgacctcagaaactgtgtgtatgttttttggtgggtttttttttgggggggggggagggtgtagggggggtggtatctaactggcaagatttcagacagtagaaagttatattttagattttagaacaggcagcactaggcaaggtgttaagtccaccccagccagctcttattctaagacattcttccttttccatttctttctttcctctacttctgcacccaggaaaaactcaggtttttgttttgcttcgtttttctttacaacatttagagatgcaagggaaagagggtgggaaagcagcaatcatttggattgaaaatgctactctgaaagttagagactgcttatgtacactgctcttgagagctaaaataatttatactttccagccacagaaaataggcatgttttttaaaaaataagaaacaattatagctacacagtagttttaagcttatttcaaaatttaactattctgagctacacaaaggtatgaaattaacatgtttcaatactgaaaggagttaatttttaaaaccctaccatatgctgtaatataatgccctctatggactaaattacagcacttcaacattactgaattaaatcttaagaactggaaaaagattttagtctagaaaatgaatgacagtacaagttaaaatagcaaaacaacgagcattttaaagtctataaaaaatttaacataaggtaccaaaaatgaatactaaaattcataaactgaaagtgacactatttatgaaaactaatatgctaacttcttacattataatctaaaacatacaaatattcttaaacacccaaagcatttttaaaaattttttatataaaaatatgaaacacttcacaaattctatgcgtcattcttgtgcaggggctatgctaatcttctctgtataattccaattttagtatgtgctgctgaagcaagcatttttttttttttggagacagagtctcgctctgtcaccaggctggaatgcagtggcacgatcttggctcactgcaacctccacctcccgggttcaagtgattctcctgcctagcctcccaagtggctgggactacaggtgcgtgccaccaagcccagctaatttttgtatttttagtagagacgaggattcaccatgttggccaggatggtctggatctcctgacctcgtgatctgcccgccttagcctcccaaagtgctgggattacagacgtgagccactgcacctggcctcaagcacgcatttttaaattctgaattcaagaattaatagtcactaggccctaaacagatcttcttaaactttaatgtcttcatttaagtatccaggtttggggggaatctttaaggtcatttcataatgtttatagtagtatgattaaagcatttgtttgatttggtacaagatgtcaatattcaaaattgtttataaaaattttaaactcatctgttagtgcaaaacgatattcacagctcgctaaatttctctgtccaactgaatttattccacatagtcaattatagatcattccacagacttgatcttccatctgcaacactagatggcaccaacacccgtagtctacagttgattgcccagttcatggaaggcaatctggcaaacattaactttctggcttttccacaagattgctgcctggccctaggcagctagatcagagtatgggaataggaaaacaactctaacaccaaaaaaatacgtggggcaaaataatccctaatcggaatccaaaatcaattttaaatagatcagaactaagtgtaaaattaaaactataagtaaataaaaaatatattttcctttgtgaaaactgaaaatgtccactgaaatgtaaactaaaaatcttttagaaaactgagggaaaactataacacaagagtttacatcctttatatgtaaagaactctcataaaatcagggaaaaaaatgaacacctacatttaaaaatgggcaaagagtatgaacaagcaaaaatcacagaagaaatacaaactgccaacatgttcacattcactaataatcaaagatcaaaaaagcaagtactacttgcacctatcaaactggtaaagggcttttaaaaaatacctagtacagaatgtccagaagaatatttaaggaacgagtcatagtagataactctaggaaacagcactaggcagctggacaacagagagagaggaagaagtgtgactgtcactgtactttctgcattttgtataatgtaaaaatattatctatcaaaaaataagcaatatgaattgttggtgaaagtagagaaatgggtgttttcttcttctgataaaagggtaaaaattagtacaacttttctggtggccaatttttatacaaacccttataaatgctcatacccactaacctaggtttttatttcaaattgatttatggaaaataattcagggatatgtaagacatatttaaatataaagaggttaatagcattatttatcaataacaaaggaacaatctaagggtccaacaatagcaaagtgactggttaaactatacccatactaaggaacactaagtacaaaaaatcagcagcaaaatatttaaagacatggaaatgtttgcattatataagacattactaaagtttttaaaagcttataaacaatatatagagtatgattccaatttcataaaacactattacattcttaaaaatacacatatgcggccaggtgcgctggttcatgcctttaatcccagcactttgggaggccaaggtgggcagatcacttaaggtcaggagttctggaccagcttagccaacatggtgaaaccctgtctctactaaaaatacaaaaattagccaggcacggtggcccacacctgtaatcccagctactcgggaggctgaggcacgagaatcgcttgaacccaggaggcagaggttgcagtgagtggagatcccgccactgctactccagcctgagtgacagagcgagactatgtctcaaacaaaaacaaaaacaaaacacatgtgcattgaaagtagactagaataatatattctaaaatattaaacattgattatgtctgggtaatatgattataatttttttcatctcaatgcttttctacatttttcaaatttgtacaatgagcgtgtattgtatgtcagactgcttcataaactgttgctctaacttcactgatagttatcaagtccttagaaaaaatccttattactaaaatattgaagctcaagtagattaaaacatttgccaagggtcatacagctaaatcagtgaaagggtcagaattagaactcaggtctgtaaaatgcctaaaattaagttatttaaccacattatatttagcaggtatctcttttttatggtacatatttattttcaatctgtattgggcccacagtaagcactaaataaatcctcactaatttaacaatgtcactttttaaaaagtaaatataatcgtttcctttattaacaagagtcaggttctaatttagctacattgtacatctactgatagccttccagttaagattaactacttatcataataaagtccaacttacatcaaaattttccaaatattatttgctcaataaaaatatattttaaacaaaatatcaactcttagtatctacagtacttcagtaaaaaaactcaaaggctatatatactttttcagaaaaatattttaagtcgtaagaatatcaaaacaattcttattcatgaacatatgtaagttcttattcatgaacatatataagtttgcaaagctaatttcgtactatttacctagacaaacaagcccttttaaagtgagtgatcatggtaatactacttggtgaatcctgggtattacatagtttaattataatgaacaaataatcaatgtatggtcggtttacacttcacttaccaatagttccaattagttcagcaagacacaatctatatttcgattacgaactaaaaatattctctgtgcattagtgacaagcaaccaacaaacatatattaagttatcattaagtcaagatctcagcagtttggacaggaaacatgagcacctttctgtaccaatggcctaccaacataaacagatgatagcagttgtccaaagtagggtttttcagtctccacatactagcaacagaatgttaccctagttccaatatccttacatatgtgagaaaatgtagatggcaaccaactttcttgacatcttaagatgtcaagaaatgtcttacattgcctaatggttcaacacaacagatatatgataaaagcagtagcaccttgattgcctgctaaagttaggacaataactgcttattccaaaaccaggaaataactgtgaacggacaaaacctgagttggaatcgcagttcattcttgtgaaactaggtaacaactaatacaaataagaagttagcccaatgtctgaaacacggcagaagctcaaaaacattgtgcttattacataatttaccaggtatccttgaaaaagttacttaacatccttaggcttagattttatcatctataaaatggttccttctttcagattatggtgaagacctaaatgaaacaaatatgtgagagtgcttgttggtcagaagatgttccataaatgatagtcttccctttccagataaaatgagaagaattcagcttttctcaacactttaaaattctcagttaaaaacctaaaactgggagaaagaaaatctagaactgaaacaaatgaagctaattgtatttcaaatgaatatcatagccattagtcagtgggagaaggacgcaggaaaaagaaaaaagaacaaactaatacaagtaatctgtgaataatgtatttgactatatacattccatcttaggcagggttgcagagtagggatttgcaaacaatccagaactcttttatcaagttttttttttattatagtgatatgaaaaaagcattctaaaactcttataggtgtattaaaggactggatataaataatgtattggtggtcttaggaaccagggttctcactataaaagaagagacaaatatgaaatcaggaaagaaagaacaaaccctgtgagaatggattagaattagaggtatctatgtgaactcatttcttaagtatgtatgtgtatgtgtgtatgtttatttttatgtatgtatataagcatttcctagctttatccactgaaagggttaaaatggaaagatccccacagtagcaatgaccacaactagcatctagctcttgatctttaatacctcactattatgaaaatgacctctcattctacattaaaaggaatcaggcatccttggagaaatggctgattccagggctgggacacggtaagcataaaataggcctacaatattttgttaggctagaaagtaagaaatgctcccctcccaaccccaaagaaagaaggttgcatgtccctgagcctacctgaaggaaccctcaaaatatgcaataatttaccaccaaaataataaagttcagtaatgaatcataaaccattggaaagaaaatggaaattcacggatccatactgataattaattagctaattaattcattaatggaaatggaggtctgctgcttaaacaggaatgctgagggtcaaatgaaaaatgtacggggagtactggagttaaaatcatttttcaactctcatggtaaagactggatcaagcaagaatcatcaatggtttactaaattggaggggcgaattttgatagggagcaggatatctgcatgtgttcaagtgtcactcctcagactgcttatcatctgcaagggagaaacaaagacaatataaggaaatcagagctcatcttgcccagacggtcaaaattaacataaccagtgagggactgatgaatagcagataactctagaagtggtgctatgagagggacacatcatcatctatacagtatcataaatgaacccatagcctcaaattaatcactaggaaacatcggacaaatccactaggaggaatgttctattataaagtcgggggaagagaggccctgtgttctttaaaactgctaatgtcataacaaataaataaagactgaaatgggaagtcctacccagagcaattgagcaagagagaaataaaggatatccaaattagaaaagaggaagtcacattgtccctgtttgcagatgacatgatcttatataaagaaaaacctaaagactaccaaaaacttgtaaattctgtaaagttgcaggatataaaatcaataacaaaaatatcgcatgtctttacacaaacaacaaactagctgaaaaagaaatcaagtaggaaactccatttgcaatagcttaaaaaaaaatacctcagaataagtttaaccaaggaggtgaaagacttctacgaggaaatctacaaaacaatgatgaaagaaattgaagaggatacaaacaaatgcaaagaaagacattccatgttcatgaatcataagagttaacattgttaaaaaatggccgtaatatccaaagcagtctacagattcaatgcaatccctaataaaataccaatgaccttcttcacaggaataggaaaaaaaatcctaaaatctgtatggaaccacaagactccaaaaagcaaaagcaatcctgaacaaaaataaagctggcggaatcacactactaaatttcaaaatatactacacagctatagtaaccaaaacagcatggtactggcataaaaacagaaacacagaccaatggaacagaacagataacccagaaattaattaacatatctatagccaatcaatttttggaaaaaaaaaaatgccaagaacattcattggggaaatgccaagaacattcattgatactactactgagaaaaaaaatcagtatttacattccaatagtaagaatatagtttgtcacaaatttctttgtaaatggagggggaggaagaccagaattcattagtttcttgacaaactttacttcccaaaattaataaagcaccatctgcatcacaataccttattcatctctcttgcaaaatcaatctttcttcccaaaactaaaactgatttctgcctacaaaatgtcattttaagaaaacaagaacaggaaagtcctggaggctcacacctgtaatcccagcactttgggaggcagaggcgggaggatccttgaacacaggagtttgagaccagcctaggcaacaaggcaagacctcctctctacaaaaataattagccaggcatagtgacacgagcctttggtcccagctacttgggaggctgaggaccacctgaccctgggaggttgaggctgcagtgagccataatctcaccactgcacttcagcctgggcgacacagcaagaacctgtctcgaaaaaagaaaagaagaacatatgagataataaatgatctgaggaaattagtattttattatttaatagtttaaatgtttaaatgcatatacattaataagacccagaatttttttaaaaacacacttaaatatttcataattagagatggcataaaacttttaagtcatctgagaagagagcttcccttatgttttatcagaccactgctgtattttggtacatttgacttcagtacacttgaacctccctttcacgaagatacacaggtaagtacctatcctcactataacatagatcacaatgtttaactatgtcctcaacagtgtgtctgtaccagctggctgtaagttgcataaagcgcaaaactttgtcttagtttcatctttttccctgccccccccgccaaaaaaaaatctcatatagtgcctgatagaagcatgttaaagcaactcttacctgcttttacacttttttttttttttgtcttttttttctcccttttttgtggagaacggagtctcactatattgcccaggcaggtctcgaactcctgggctcaagctatcctcccacctctccctccctgaaagctgggattacaggcgtaagccattgtgactggccactacttacctgcttttaacagatgcctgttatataatcaagtcaagaaaattattaagttgcaaggacttgagctaatccacccttccttttatagaaaaggaaaatgacatctagagaaacaaagtgattgtcagtggtatagccaagactaaaacctcaggtcacctatattgttttcattatagcaatactgggtttccttcccacaacttttgtagaatatatatattgggtgtatctaaataattctctattccctagtaagttgctatgataactaatatcaaaaaaggttaagtcaaaaaggcaggaaataacaattttctcagagaagggagataaacatattctaaaagagaatgcccaagcattgcttacactttcttccaccattcccattaagctttcaaaggcaatgcccccttttcttcccttacttctaaactattaggctatagatttcccaggtttaacaaaaacaatccaagaaataggtgactcctgaaatactgaaattcctaagggccaccatctactagaggactgctagctttaagttttgggaggaagcactagcggggaggggagacttcaaaggtgttgctacaccgattactccttgctcttcacccagtcatcaccaagctgctctgggcttctgagacccttctttctactgttccctcctaaaccattttactgtgctgtttgaaacccccattccactgtgaaccagctcctctactcctcaacatctttactgaacattcctgcctttacctcgccttcactaaaacctggctgttccttgaagatactggtttccctgtggaacttgctaaatgaaggctaaatcgttctctcatattctacacacctaagggaggagtggggaggtcagtaccctctgctcaccaatgctgcttccagacttttatttcagagaccttgggcaaaagtcttggctattccgctacgtcattctctgtccttcctcatttcttctacctaccatcctgccagttacctcactgccctttaccaaggactctaaccccagtattcctctccacccctagtcctgccatcaccctgggtgacttcaatgttaggtagaagtgcaatacagtatcatggcctcatagtttacttgacctcacctctagcaatcttaatctgactacacagtaggcctttgcctgatggcctaacactggccattataatcaacctgaactgctattcctctgaaattctaaattcaacatccaacacacacacacacacacacacacacacacacaccctgctctcccgcacatgcattctttctctcccctactttgaccacaatctcctatcattctggcatgtatttattcctactactattggttcttaaacctaatctgggccttgagttcactgaccatctactctcctcctacctctcctacctttttctattcacatccttcaacttagatgccacagtccatcacttcaaattactctcctgctatcaccctcaactttcttgacttactgtccttccacagggcccacctgccaaaacacatccttgaatcaatacaatcatttgccttccctgaacccatacctaggttgtttggcacaatcaaagaaaagtcaccctaccatttagaccacctttcaaccttgattaggctcctaatacaatgcctttggtttccctagtcagaggtattgcagatctcttccacccaagcatgatctacttcattcccagcaaatgaactaacatactgctttaaagaacaaacataaaccatcaaataattccctcaactttcagtcacaaaaccctaacagtatcaataccccatactttcctttccactcactacaatcaaagctctatcgttccttctctctaacactaattcttccacctgaactaggcagcacatccccatccccttctgactttctgccagcacctgtaatcagattttccccttcccaccttaaaaaaaaagtcctacctccactgcatactctccttcctgcttgctaatattttaatttttctccaataaaaatctcaaacttcttaagagtaatcaacatttaataaccacttactcaagtctcattcacttctcaatcctagccatgcccatgcacaccacaccatttgccgctgtcatgacaatatcttccctcctttttgaccaacttgcaatccttaactgacctctccagtatttgataattttgaccatttcttccaccttcaagtagtcctcttctcttgattcttcctaattggtatctggggctttaatttctatctctaagcccatgacagacacatacagccaagatctctctcaagagcttcatgtgtataatatccataacttactggatatcttagaggtatgtacatcaataccaacatatccaaaaccaaatttgtatcttccctcttaaacctactttaatctctcatgttccctatctcagtttctcatactgccacccatacaagtgcacatgccagaaatgaaatccagggttcctggggtcatctttacctcttcccctcatcctttatgtccctatccgtcaaacaccaagtcctatgtctctgtgctcatcccactgcctgaatgttcataatctcctctttcttagattacagcaactggtctaccactgttccaatggtgatgagctggactgtactgctgaagcaccagcacttaaatacataagtatattcagtaaatttatcataatcactattttagagaaaacgcagctaaatcagaatgctaataaagagcacatgtgcaaatcaccttgtgcaaatcaccttatgcaaatcaggtatgtggaaaatggatagtcaaaagaaaaaaaggagaatcggtacttttcaaaagaattcataatagcataactcattttatacttttcaacaaaatgtctacactcaatatgcctaactttatacctaccactggaaaagtactatattatatagaaatatttaaaacatactatagaaattttctttaaaaattaaatatggtaatttctgggataacaaaaacacatctgaaaatattttaatatctcttgctcttcatgttatcaagaaacacaagtgaaaaaagaaagaaagaaagaaataggtactaaagccaattcttataaacaaaaatattttctattaatagttccatagtgcaatataaaagtgtaactgtgtggaaaagttaagggtgaatgctgagtgcaagagagttagaaaaagcactaaaacctttaactgaaaaagtggagaagacttcttaccaatgtgacatatgagacactataaacataatataaaacacaaaatgtagtggaatgttccctaaatccaaaagtggcatgaaagcacaaaactgcatatagattggattacctgaagttttactcagctctgctgaaaatatagcagatggtgatctgtcctctttttctgtatcggaaggaagttttttctcagcttctttcacaagaactttgggtttaactatgctctctatctctgcttgagtggccaaagcagaaacatctggaggcaataagagcacctttgatgtagcagacccatttttagaaaagtcatctgagaaactgattttctcttcaactttgggttgtatgttcttcaaagaaaggtcatggggcaattctgtgcaaggcaatgacccagctccatccggggcattagcaatttcacttttgtgggatacttctaggtcagtatattccctggctaatttagaaaatgaatcagttttagaactgatcaatgtagggaactcatctataatttcaattggagatgaatctgaaaacgtttcagtttctcttatctgtgcttccttagaaataaataagtcatcatttgaataaactgcagtactgagctcctccatctgcaaaggaattttctcctttttgctcaatgttgaaacttcatcaggtaacagggtatcttttgtgttatctaaactgagcttaaaagattccaaatatggctttcctccctcaggtggcaaagcactgagtttttccttattttcatattctatcattgactcaaatgaagtctcagtgagactttctttcacaagcatcacagtttcatcttgtttttgtggaacgtcaggtattgaatcatcactaaataagtcaactggttcagaatcaggtgaggaatcttcaactagctcagaatgatcaggcactggctgttcaacttttgccatttctgaataatcagagaaatccggagctggttcagcagaaagctttgtttctttaattaaatcacatgcaatagatatataaggagcttctgtttcttgaagagctgcattaatattttcaggctctttaatttcttcctttattcctgatactttttttagtgatacactcatggcctcttcatatggtggggggttttcaggctcatgttttatgctttcataattaactgaagaagcttctaatggtgatgagctgggctgtatcacggaagcaccagcactaggaactgcagaattcaatggtgcttccataacaatgtcaggcaaaactggtgaaggagtagcttctgactcttcaaatgatgggcaaagctgtgctgcaggatagagtgactcttgcataacttctgatgtttgaaccaagtccatttttgtttcataagcaatctttgtaccagtaacttcattcaattcactttcacatgcttcctgtactaaatctggagtcaggccttcaggcatgtttgccacgacttcctcagtcacctttgttaaattatctgttgtgacataatctgtctcagaatcctgtgctgctacaagaaaagggtttgatgttttggtgctagtattcttctctgttactatttgggccttcttttcttctatttttttttcatcggtcttattttctgaagtaggatctcctaacaaaggaaaaatgtttgttgcaatgctctcagttgctgctgggttaaagggagcacatgtgatatatgctcctgaacgatcctttataccttctggcgtactggggaaagaagtatcatcattactactctcactatctttttcgtgattagtttgctcaaggctatctgcaaaacattttttatccactttactttccaagttgctctcgattttacctccagcagccaacatatcactatcttccttactatctttcacttcccatactcgctcaaatggtttgaagtctgcatattcctccctcataggagcttccactgcaactctcttttcattaaaactgtcttttgctttttctgaagacacaacttcatcctctttaaccaatttagtaagagctgtaggtaactcttgttgattatgaaggatgttattactaactaacttctcttcttcatctttatttttcacgattatttcttccctaggatttgctactattacggcagattctgcttttggagagacactgaacgatgatcccatttctgagtattctaattctgaaaactctgttaaatctctatctatgagtagagtttttgccttctctgagacctctttagaagcttcactgacattttcttgaagtgttccttcagtgggtaatactgttgacaaattaccaaggtattcatgttctttgaaagaagcggctgagagaggagacagagaaggaagagaagcagcagtttcaagcaggacagatgggaaatcctcttgaccagccgaaatagtgttacctggctgctccttcaagtccatattttctgtgaccatggacagaaaggaaagttagagaatgccagtgttctcagagttaatgcaagttttatgacagatccaaaatagtgttagtaaagacttactgtttactaaaatgaaatgttaatagcaattaataagtaacaatagagtagacttcaatcattactgaaaatattaagctattgtaaatataacatatgcatggctacagaggcaattacatgctgtgcaaagacaaatcaagtctgagtaaacctcaaatgttatcaactaagatactaatagctagttttagagaagagaagaatatctgtgaaaagagtttcggtgacagcataggaaagaaggggcactgggtaaatgccatagactggtatttatttacaggaaagcctttctggctatactcaaactgtatttggagaaagggaatggtaaatatgtaaatgtaattcaagggtccaagaattccttatgtacttccaagtattcatcagattttgctcatttttcccttgggcataccatataaaatgcacatttcaacttttccagtagacaaaacattctcggaaccatgctaatttttagtaaacccaaactactctgcatagtgttaacacactaaagagttaaagttagaatacagagaggataaaaggctggcagaaagaacttgcctgcagaggagcgtatcacaggctcagatgcagcaggaagagcaaaaagggtctcatctgaaaaacaaatagaatataacctcagcagaaataaagacagattgaaaggagactaaagataagaggagcaagccagggttcagtttgtaataagttaacaaaaaactttacagagaaagggccaagatcaaaaggaagtcagaaaaagtagtaccattaattcaggttaaatcatcatatgtattataaagctaattaaatgttatccatagaacctatcatttttcaagaggcaatacaacctgtttatgttaaagaaacttatgaatcaaagtggctttaaaatactgttctacttaacatatcacatcccaagctttcactcaggttttcacataggtaaattgtcttgttctattcaggccaaaaacaaaaagctgaatttgaatacaattaacaactacaaatgtttaatcttttgttattggcatatattcaatttaaagaaacacttttaaagaattatgcattttctcttacattctaagttgttacagtcattgtacattgctctttgaagacattagtcctgtgccaatgtccaaatgccagagtccaaaatacaaaaaaaaaaaaaattaactgcctttaggatgacaccattattggttttgcttaaaattaacctaagtgagggctacttgttatttgtatacacaactagtaagtgagagactaaggcaattcaattccagagcccatttccttaatcactgtatgttacagaactgaatgcttatatttcctacaaaactcatgttaaagccccaacccctaaagtgatagtatctgaagatggggactttgggaggtgattagggttaaatgcagtcagggtggggccctgggccaaggggattaatgcccttacaagaagagacaccagagagcttgctgtcatgctccctgtctccccaggcacacacaagaggtcatgtgtgcacacagtgagatggtggtcacctataagccaggagaagaggcctcaaaaagaaatctaccttgccagcaccttgatcttagacttaccagcctccagaattgtgagaagtaaatttctgttcagccacccagcctatggtattttgttacggcagcccaagctaactaatacactctatattggtaatattaactttgtacaatgtcatcttgtacctgcagttgggagatcctaagctaaagatcttccatggtttacactagagaaaggcctctaccatcagacaatttgaaacagcctgagagatgactggaaggtgatattcctttaacagagagaacctaataaatttagacaatttcatctggatggacaagctagacaaggctgatcaaaacagataaaaatccaagaaatgtagctaacatgaatacggacttgtcttccaagcatattacccttaatgaattaggagagctaacttcacaaggtcttatatattttagataaatatatactgggcatgaagtcatacttaaaggattcctagatgagggtgatgacgggaaatttatgatgtgtgtttaaaagggtttcctccaacctagagcactaggtaggatgggctatccagtcaaaggggtaacataatggcttataagatttttaaataaagtgcatatatatgtgtacacatatttaaaagattacttgctatgtgatcttaaattacagtttctcatttgtaaaatgaaggaaagttcccttcagctaaaataatgaattattagcttgtataaaactgaaatttgagggtcaaagagcagaaccaaataattacgcagctgctccatctaaataacagttaaccaattcttaacaaaatggttgtcttttttatctagacaatatagttaaaagccactaattcagaggctagtctatctggaaagtgaactagaaacatatattactgttaaagttagtgggaaaacaaactacatctaaatttgtgccataattttaaagtatttttttaatgtactgtactcttattcctacctagtgcaataatcttttataataaaaactatattcctggaatttttctaagtaaaaaagttttcaaattggtatttcaaagattcattatgtttaagaaaaaaagaaaaatcttcattttgtaaaatgggattcgatccagttacccataaaacaagtactacatttctaaaagctctttaaaaaaatccagaatagttaactatcttctgggacttcaagaatacagttcagactcctaataaagcaatcacagatcatgaaattgaattgcctaagtccaaatcacaaatccatcacttacaactgtaactcttagcctttctgtgcctaatgaaacttgtaaaataaggataataagagtacccacctaaaaatgttgtgaaggagggagagggaaagaaaaaagaagaaacaacttgccctaagtcacagaactaggaggccagagggtcaaaacatctaattcccaagtctttgtgctttataattattattattttttggctaggcttcctcaaagcacgagatgtgcttcatcttctgaaggatgtatttatgtacaagtgcaactggtgcaatccttcttactgtatcagcccctcaagttagttctcctgaaacaaggtaaatcgtcacccagtaaataccttgtaattagcagaaatattgcattgatcaattgcttctattttacaatgtaacaacatttatagaaacattaatgtgggacaggtactgtgctgagccggcacatttgtttcagatgttcattctgttctcaaaactaccctgtaaggtaggtactactgttacccccatttcacatacgagaaaagaggcatttaaatcatatctaattacaatactacaaaaaacctgcattttaaaaccatagaacttctgcttctggctatgagagtaattacaacagactaattcttccaatataagcaactaaaaatatgggcaaaatactagaagcaactatcttgagacactggacaagaggcaggacagcagtgtgaatcctgagaaaagggaaacctgcaagatgactacgctgctttctgtctgaaggcacattctggtctacagtacagagagaagcctaagaataccgcactcttgctaagctgaggaggctgaggagttgtctggaatttgtgagacagggtaacatacaaagtaaagcctcacagaaaaggagctccaaaaatctggataggggttcctcttaaacctctgggtgaatactacgctgcatgtgcacagcacaagactcggcaaggcctagccaagaaacctatggtagagctgcaaattaactggattatatcgaaggtcagaaagtgctgaagacctgatctaaaaattctgaccagtcagaaaggaaagatctctctaaacacctcaagcaggactactctaagcctaaaggatactctagaccaagagtcagcaaaccatggctcatgagcccatattgtattggaacacagccacgcccattcacttctgtgctgtctataactacttttgcacaataaaaacagagacgaacagtttagacaaaggctgtatggcccacaagcctaaactatttactctaactggccctgtaagtctgcagacccctacctctagacccaccctaactttaaaatcaaaacttgaaaggatcaaaatgattttccagcaaattaactgcctgccagaacaaagttaaaaccaccaaatccatgacatgcagtataaaataaattaatggacatgcaaagcagcaagaaaatatgaccataaataagaaagaatagcaaatataaacaaacaaataacgtagacgttggattcgcacttttttttttttgaggcggagtcttgctctgtcacccaggctggagtacagcggggctatcttggctcactgcaacctccacctcccaggttcaagcaattatcccacctcagcctctgagtagctgggattacaggtgtctgccatcacaccaagctaatttttgtgtttttagtagagacggggttcactacgttggccaagctggtctcaaactcctgacctcaagtgatccgccagcctcagcttcccaaagtgctggaattacaagtgtgaactaacacacctggcctggattagcaaatattaaaatgaaaattaaaatagctattaagatattaagtacagaaaaagacagacatatagagtagacagggaatcttggtggagaaatatagactaaaggaccaaatggagatgctagaattgtaaattatattaactgaaaataatcactagatgagcttaaaggcagattagacaatacagaaaaaaagatttattgataaacaaacttaaaaaacaacaacagaaagtatccaaactgaaacacaacaagggaaaagggcaagtgaaaaaaggaacagagcctcagtgctgagagacaatcaaggagttaaaatacctataattgcagtccccttaaaaaaagcaacagtggccaggcatgggagctcatgcctgtaaccccaacactttaggaggccaaagtgggaggaccacttgaggccaggagttgggacaccagtttggacaacacagtgagaccctatctctacaaaaaacttaaaaattagccggtgtagtggtgcacacgtgcagttctagcaactcaggaggctgagatgggaggatcactcaagcccaggagtttgaggctgtaacaagccatgatcacgccactgcactccaccctggacaacacagttaagaccctgtctctttaaaaaagactgaagaagttaaaaaaaaaaaaaaagaaaaaatggcctaaaattggacagaagttggcattttgaaaataccaaccaacagagccacaaagctcaatgtactccaagcagaataaacacaacaccacaaaaaggcacaccataagggtcaaactgaaaatcaaagatagagacaaccctaaaaacagtcagaggaaaaaagcaggtaaacaacaataagaatgacctcacctctcattgatgtaatccaaaaggtaatgaacgcctttaaagttatgaaaaaactgacaatctaaaattatatacagatgatcctcattattcatggattccttatttgctcatttacctgctcactaaatttgtagccccaaaatccatacttgcagcactttcaggacatgcaatgagcagagcaggcaaaccagagcgggtcatccaaagtacaagttcccagctgagatggaacaaggtaaccctaccgccttcttgtttcagctctgccactgacttccctgtttcatatggcccttaagcacagcgctgacatggtatcgagtgtttttaaccacaagaaggctatgatgtgccttacagagaaaacatatgttagataatcttccttcaggcataaattatagtgttcttggccatgagttcaatgttaatgaatcaataatacatattaaataagatgtctttattttttaattgatatataacagttgttttatattttggtagtacatatgatattttgatacctatatgcaatgtgtaatgatcaagtcagagtgactgggttatatatcacctcaaacatttttcttttctttgtgttagaaacattacaattcttctagctattctgaaatatagaataaatcattaactataatttctctactgtactatcaaatactagaacttattccttctatccaactgtatttttgtaccccaggtggctttaaatagaaaaacacataaaacaaggtaatatactgattggttaacaaaaatattatgacaagaggcttacaggagccaagtctgtatttcccctaagaacaatgattcagtatttgctaattccctgtttttggtggctatacagaacatagtgacagcttaaaaaaacagaattggctgtattattcaaaacatatttttttaaataaccaggcatggtggctcacacctgtaatctcaggaccgtaggaggctggggtaggaggattgcttgagccctggggtacgagaccagcccaggcaacaaagtgagaccccaactctccaaaaaaattaaaacattagccaggcacggtagcgtgtgcctatagtcccacctacttgggaggctgaggtgggaggatcacttgagcccaggagtttgaggctgcagtgggttatgatcaggccactggactccagcctgggcaacagagtaagaccttatctctaaacgaacaaacaaaatatatagaaaaagtaaagattaataaaggtatcttcagataaaagctgaaaacagaagctgaaagaatttgtcactaagacacctacaatacaagaaatgttaaatcaagttcttcagactgagagaaaatgatatgagatgtaaactttgatctttatgtaggaataaagaatggcaaaaatggtaaatatatatgtagatgttgaatatacaggtagatgttaatttttctcatttcttagtttcttcaaagaataactttctgaagcacaaattatcacaaaatacaataactataatacatttagaagcaaaacttatgacaataaaagcacaaaggatgaaaatagtatatgaaagtatgttttattacatgtgaaacatgtaaggtggtataatattcttgctattttatgataaattgagaatgcattctgtaatccctagaacagcctcttaaaaaataaagaggtacagctaaaaccccaacagaggagataaatctgaatattataaaatccttgattaatccagaagaagaaacaaaagaagaaaatcaaagaacccaaaaagcagatgggacaaagaaaaaacaaagacacacaaccacacactatcagttaggatacagatgatttaggccccactaccaatgagctaaactgacttttatggaacactacaaccaacaatataatacacattcttctcaagtacatatggaacattcaccaagataaaacatttcctgggctacaaaacaatctcaatctaaaacaagtgaaatcatgcagtctatgttctacaatgaattaaatcacctaaaatatcctcaaatgtttaaaaacgaaactacagaattctaaataatccatgaatcaaagaaaatagggggaaaattaaagaaattctgaatcaaatgatcatgaaaatgtgtgggatgcagcaaagtaatgcttagagagaaatgtatagcttttaaatgcttttagaaaaaaggcttaaaatcgaagtgtaaagcttccactttaaaagagcaagttaaatccaaacaagtaaaagaaaataagtagtaaagagcagaaaccaatgatagaaaacagattaaaaaaaaaaatcaatgaaacaaaaagttgcttccctgaaaagatcaacagaattgataatcaactaaaatgatcaagacagagactgagagacagagagaggaagcaagtattgaaaataaaagagggactgttactgtaggtcctaaaaacgtaagagaatattatgcacacatttatgacaataaattagacaacttagatgagtagacaacttccttgatgtctacttatcaaaatgaaagacaagtttctttatacccagtcatcaaaatgaaatagatgcattccttgaaagacacaaatcaccaaaactgacacaagcagaaatcaaaaatcagaatagtcctatgtgactatacttgtaacttaaaacccccacgaagaaaactaatataaaacatctaatgaatagtaccaaccttacacaaactctttgagcatataaaggaaaagcaaacacttcccataaaatttttatagatttatgcattaataccaaaaccagacaaggatataacacgaaaattaaaattaatttatataacaatattcctcataaccacacatgcaaaaaatcttcaataaaatagtagcagattgaatccagcaactcatagaaagtataatcatcaccaaatggggtttaattccaggaaggtgaggttggtttaacattcaaaatcaaacaataggtcgcacgcagtggctcatgcctgtaatcccagcactttgggaggctgaggtgggcagatcacttgaggccaagagtttgagaccagcctggccaacatggtaagaccctgtctctactaaaaatacaaaaatcacccaggtgtggtggcgtgcacctgtagtcccagctactcaggaggctgaggcacaagaaacgcttgaaaccaggaggcagaggttgcagtgagccaatatcgtgccactgcactccagcccaggcaacagagcaagactgtctcaaaaaaaaaaaaaaaaaaaaaaaaattaaaaaaatttaaaaagtttttttaaatcatataatgaaattcactatagtaacaacagcccgaaaaggaaaaaccatatgatcatctcaacaaatgtcaaaaacttatctgacaaatttcaacacctgttatcataaaaactatcagcaaactaggaatagaaggaagctttctcaacctaagagtcaggatatctaggaaaaatatgcagctaacatcatacttaaaggtgaaagactaatgcattcactcaagattctgtgttaaacaagcaatctaccaggcttctcgtaaagatctgaagagaaaagtaaaactatcttaacttacagacaacaggactgtatagttggaaaatcctaaggattcaaaataaaataaccctaccaaagctagtagtgaatttataaggatacaggatagatgcaaagacagtacacaaaacttaactctatttccatacagtagcaacaaagagaaaatgaaaatattttctaaatatcactcactgtaacaaaaaaacataaaatatttaggcataaatttgacaagagatgcacaaaactgctatactgaaacacactgctgagagaaattacagatgatctaaacaacagagatatcacattcatgggttgaaagatataatattgttgagtgtcaggaaacagttctctatgagtatattgtgtttttacacatcttccctttgttcctatcttttaaaaacatttgtattgtgaacagccttggaaaacagggacagtttcttcttcttcagcaactagcagccatgcttattatatgacacaaaagatttgtttccctaagcttaagatttctgtctataatacaacctgctacaggtgcagatctcactcagccatctcagtgttgctccatgtgaaatggagctgagggaactggcacaagaaaatgctaatattctggctactgtcattgctgtgagtaataaagtcctctgcctctgacccaggcatcttatatcctctgccagcatccatgaaactatgacaggctaacttgttacctttgaagtagtgtaaaatctcaaatcctaagacgtcacttatcccccctactaatctctagattcaatgcaatcccaatcaaattcataacaggcattttatagaaatgaacaagctgattctgaaatttatgcagaaatactaagggacctagaagacacaaaacaattttgaaaaaagatcaaacttgcagtcatactacttaattttacgacttgctataaaactacaataatcaagtattggcataaggatagacaaatcagtagaacaaaatagatatatataaatagacacacttcatatggtcaatttcttttcccaaaggcaccaaagcaattcaatagaaagagaaaaatattttcaaaaaactctgctgggaaaactgcttattatatgtatggaaaagaaacaaataaatctggatctatggtaactcataccatagacaaaaactacctcaaaacggatcaagacaaacaaaagctaaaactatcaagcttctagaagaaaccaaagtgtcttcacaatcctggaaggaggcaaagatgtcttagacatcacaaagaaagcactaaccatgaaagaaaaagtaattatgacttctcaaaattaaaaatttatactcatcaaaagaatcaataaaattaataggcaagctacagactaggagaatatattcacaacacatgtatcagaccaaagatttgtattcataatatatagagagaactcttacaaatatgtaggaaaaaaaaaggcatacaacacaatttaagaatgggcaaattacttgaacagacacttcaccaaagaaaacacacacaaaggacatgtaaaagtcctctaattcattagtccctagggaaatctagattaagaccacaatgaggaaccactacataaccactaaaatggttagaatttaaaaaactgacaatatcaaatgttggtgaaaacgtaaagccaccagaattctcacacattgctggtggaagtggttgggggaacagttaagcaacttcttataaagttaaatatatagttaccccatgactcagcaattctactctcaagtatttacctaagagaaatgaaaatatatgcatacaaaaatgtctatgtaagaatgttcacagcattttgttcatagtagccaaaaactataatccaaacatccaacgagtgaatacataattaaactgtgctattcttagcatggaataccactcagcagttaaaaggaacaaattactgatacctgcagcatcattagtaagtcttaaaagcatcatgctgaatgcaagtagccaagcacaaaatgtatgattccattcatatgattgatgctttaaaatacgtaaaactaatctatgatgaaagaaatcaaaacagtagttgtttgggattggtgttgcgggtaggaaccagagcaaagaattgaaggactgactgctaaggacccaagagatctttctaggatgatagaaatgttctatatcttgtcagaggtgtggataaactaatgtacgcatttgtcaaaatgtaaaactgttgaaacttaaaatttatgcattttactgcatgtaaattatatcttaataaaaacattaaggtgaaaaaggtgtatgggcattcttcaacaaataaattgcagagagagagagaccacaagcaagggagaactcatcgatagattaaaagactaataaatcaaattgatctattgtaatatgtggaccttactcgaattctgattctaactgtaaaaataaaaagaaagaaagaaagaccatttatgacattcagtaaataatagtcaatgtgaggccaggcgcgctcgctcacaccagcactttggggggccgaggcaggtgaatcacctgaggtcaggaattcgagaccagcctgcccaatatggtgaaaccccatctctactaaaaatacaaaaattagccaggtgtagtgttgggtgcctgtaatcacagctactcggagactgaggcaggagaatcacttgaacccaggaggtggaggttgcagtgagccaaacttacaccactgcactccagcctgggtgacaagagtgaaactccatctctaaataaataaatggaaatgtgaacattagctggatgcttgatactaattctattgtattgaagacattttaaccgtagttttaccctcaactcttttagtattccattaaaatatatacatgtttgagtctatcaatcttaaacttaaccatatcccctgcaacatatttcattaacaaaattttaataagggaacaagagtaagtttggttgatgagagagggtaaatgagaaggtatgttgtaggtggcagtttctcagtccttgttcaaaagtgatgtcttatagccctaatccttatggcagatctctgtgcagtacatatagcctataaaatataatgaaatactaacttgatcttctatattctgattttcaataattcacctatgcaagcaaaagcatctaacaaagtttttatcaagttattttatataaaatttggtttttatacaaaattaaaatatcagaatttgataaaataaaactttccataatttaacaatgatgttgatgaattgagactgaagttctagactatgaaagggatttataacacagatacaagcatctttggtaacctcttcagaagagaataaataaaagtaaattcccttattttctgagatcaaaacctctagtagcttaaaaaaaaaaagttgtaacacttttaggtcacctccatctacggttgtcagggcactgagataaatgaactcaataatggcaccttccatttaggcgagtttataaatcaacctacaaagttggggagaaagaacacgtaggcagacctggaatccttaagtaagcttctctctttccacaaaagcagttcacagatctgtaaatatgtcctgtaaggccaatcacaaaactcctctggttttaagagcagaaaattctttacaactaagggcctgtattttttccttcatctgctacctatacctctcataagtacaacctctattcatctttcttgtcctcttactcagccctaggcctagttaaaaaaaaaaaggaatatattaatttttttcttaatattgaacttccaagagaccaccaatataagcagcaactccaaactcttgaacaacaaaactttataaactttctgtatctgtggtaacaattccatcaatgagaaaaacaagctattaaagaaataattatttttgaaaagtagagggccacctatgtaaagagactgctttaaaaaaaaaaaatccagtatttggcagctatagctcctaatacaagagtacagagaatatttctttctttctcaacacaatttttttttttttttggaaatgaaaaagcaggaagacttagctttctttctcagtcaattatcaattgaaaagagagagccaaatacctgtataattcagtatgttacaaggaggctagaatatttatttttaaaagtctctagttcacctaattatatgctaaattttttttaaatacatgttaataaaaaccacgtgtttatggaaaaatacacaatatcaacaccgaatgtatttcaattctccccaaaattaatccataaatgtaatgcaacctactaaaactccaacagagggagaggggacaagataaaaaaaattttaagatgaagtagaaaattatacacacataagatagccaagaaaaatatttatggaaaagccgtttagctagtatttaaaaattatagcacaacagtctgatacttctgtgtgaactgacagataaatggaaaagcagaggaaatatttcacccatactacaagaatatgacaaaaatggtacttcaaagtggttaagaaggataattcaaaataaaaggtattggaacaaatgggaaataatcttgaaatataaaattatttcactacttcactctctagaacaaaacaaactgcaaataaatcaaataattaaatgttaaaatgaaatcataaaaagtataaaagtacttactaggagtaaacatgggggaaaatttttatgatcctcaagaaggattttctaaggattacataaaactcaatgacttttttcacttttatgactcaaagtcataaaagaaaatgataaatctgactacataaaaatttctaaacagaaaaacataccatatggtcaaaatacaaataacaaatcaataaaaagttttcaagacatatgacaaaaggctagtttccttacaatgcagattaagtgaatctacatacatgagaccaaaaacccaaaagaataggcaaaagctgtgatcagaaaaaatttgacacctaagcctatgaaaaatgactcaaatttaaaagaacaatttgctaaacaatgtattagttcactaatatactgtgttggtaaagatataagggaaaaggtaccttaacaggttggtgggaataaaggttggaaccattctttgaatgacactttggcattagctaccaacattttaaatgcaaatatcctttgaagcagtaattctacttgcacagatttatcctacaacatatataatggcatgtattcccaaagaagtgtatacaagagtgttcacagaaatagtatttgtaagagaaaaaactaagtatcaacctaaataaccatcaataagggactgattaaataaaatatggtacatccccagagtcctctgcatctatttttgtggaaaataaagtgaaaaggatatacatgtataaataaatatttatccacagattatctctaaacagatactcaagaaactactaacagagggtggatctacagaagacaatttgtggaaatctgggtaacaggtagaaagagttacttttctgtgtattcttgtagtactgtttggaattgttaccttgtatacataaataaataaatgctttcgtaagatttgggatttttattgagagaagatattatagtaattctagaactatacagaatatgaagatcagcatctttctcattcaacaaactgagtgcctatcacatctaaggcactgcaatgcagacacaatgcatacagtccttttcctcaaagaaaaaggtcacagcacctttcctcaaggagtacactgtctggtggaggaaagaaatcagtaaccataccattaccttatatagaatgatatatactatgaagaggtaagaacagaatattatggaaacacgtgatgaaagcaacttaaaaatcaatgatcatcattccaagaaacataaatatcaatagcttaaatatgaaattatcaactcctcctttggggttaaaaaggatgatgatggcattagtctgagaaaatcttagcatcagtaaagctgggtctcatcattttgcatacctatgtcctgcactagctatccacaaaggtcacattcattcaaacactactgagaactatggttttaccattacagttcccatccctagtgctgtcatcctcagaagaacctgatccctttagaaacaggaacaaaaagtctcaaagaatgtaccataagtatagtatatctgcaacatttacttctatttatttaagggttccagggaagaatcaagaaatagccattcagtttatacttttatcctgggctagcaaagtaccttaaaaaggaaccattaaattgaggctttgaatcaagttattctaataagttgcttgaaggtatattatgaaaataaatggcggggcacagtggctcacacctgtaatttcaacactttcagaagtcgaggtgggagaactgcttgagcccaggagttcaagaccaacctggccaacatagtaagaccccatctttaaaaaaataaaaataaggctgggagcagtggctcacacctgtaatcccagaattgtgggacaccgaggcaggtgggtcacctgaggtcaggagttcaagaccagcctggccaacatggtgaaaccccgtctctactaagaatacaaaaattagccaggtgtggtggcacatgcctgtggtcccagctactcgggaggctgaggcaggagaattgctggaacctaggaggtggaggttgcagtgagccaagattgcgccactgcactccagcctgggctacagagcaagactccacctcaaaaataaaataaaataaaaataaaaataaaaatatatttaggctgggtgtggtggctcacgcctgtaaacccagcacttcgagaagactgcttgacctcaggaatttgagcccagcctgggcaacatggcgaaaccctatctgcacgaaaaacacaaaaattagccgggcgtggtggtacgtgcctgtggtcccagctagttgggaggctgaggtggcaggatcacttgagcccagaagatgaggctgcagtgagccaagactgcaccactatactttagcctgggtgaaagagcaagaccctgtctccaaaatataaatacataaatataaaagtttttttaaaaaattttaaaaatagccagcatggtggtgtgcacctgtagtctcagctacctggggggctgaagtgggaggactgcttaagcccaggaggtcaagggtatagtgagccataatcatgccactgcactccagcctgagcgacagagtaagactctgtctcaaaagaaacaaacaaacaaacaaacaaacaaaaaaacttgccaggcatggtggctcatgcctgtaatcccagcactttgggaggtccaggcaggaggattgcttcaggccccaagtttgagaccagcctggacaaaagtgagaccattgttttttggtttttagatttttaaaaagaaaataactacacataaaacaaagccaattaatggacaataggtaacatgctccttttcagaaatgtttttataacatggcaaatcctttaagtttacaataatatagcactaaaatagcatgttttctaaacactattccatgcagttatttatcagtggttccacatatacccatcacttcattttaaaaaggatttgagagagtttgcaaatcactaaaaaaaaaaaaaaaaaaaaaaaaagaccacaaatttgacactcagttgcccaggaaccaatctgaaacataattcaccatatccatgaggagtatactacttattcccaacttttaaaaataagaaatggcttaaccagaaattattcagaatcacaaaaatgaaagtggggaatggacagggcatgactttcttgtgtttagaagcatccacttcctgggaacttggactttatattaagaactgatacctaatatttaaaccatatgtcactcaaaatcttaaaatttctaatacatgctactacgccaataaaaatgatcatataataaatggcttcatgatagtaaaaactagtaatttttaagccccaacccataatctgtatttatgagcaatattcaattttatacaaattttcatggcaattaaattttggcagtctctgaaactgatttaataagcactaatattcttttctttgtctttacattcatggtttccaagtcctatcaattcgtctttcatacagcctcttcgtaaactaactataaaaacagattcacagccaattaaagaaagcgtgcttcttatactcttatattcctcccttctattccattttcactgaatgaacaaataatgaaatagttcaggccctactcatctttctcagaactactgtaatagctttctaaataattcatctgcttttccttcccacctatcttgaatattgtcaccaattttctaatactgctttcacggtgccttgcctcagttcaaataaccttcaatggctgtcttcccaaagccaaaagctctaattcgagaaggggtgaaaaacaataactttagaaacaacaattaaaaaaaacaattttggtttcataatataaattaccaaaagcaagggcaactggatagcagagcatggattaaagtggaatgataaaatccaaattccttaatttggcattcagtatctttcagaatccagatctacatattttcggtcttaattaaccttggtttagaacatgtccagagaccagttcgaagtcacccttaattatgtttgcactgctctcaaatcgatttctagccagagttttctgcgcatatcctcaaagcctaacttaaccaaccactaagccaagtattttcccatgaaaaatggccctcaagtgagaggttttagtctcacttcagttactgcattgcgatggagatgctctgggcacaacagcaaacagtaaaattacaacttattaacagatgaaaatcagggcttactcataaataacgtaaacagcaatgttaaacagacaagtgtcagtgatctagaaaccctctcttccaggcaggctagtctatgcttctaaccctgctctgcacatttctcacctttgtctcacatcagtcctctcagtagccctgaatcttccaaacttattttagttccaaaatcacaatataattatttaataagcatatttttatttttttaaaaagctaaacatttttaccattgcctgttagagacccccaatgatctgggtgggtaaggccacctcttcactctcccactagtttttctcactagtcttacactagattctcagacacaaagagctcattcctgcctcagggttttgccctgaagttgcttggaaatgttttctctctgcagctcaaatctcaccttctaagcctgtcttagtgtcacctaacctaaaaaagcccccataaatccccatcattctctatgccattatcctgtttattttcctcataacaccactattctgggttctttatttatgtgcttattatctgtactctcccaagggggagcatgtgtcttgcttattgctataccctcaaagcttagaatagatcctgtctcttggtaggtaatcaataatgggttgaattaatgaacaaactcttgaatgcattaagaaatccagacacattgaaaatggttaactatccacaaccataatcacaatgttcttacacttactaaaaaaactaaagtttcccaataggtatcatcaatatggaattagggaactctgtagaacaggcaatattctttccccattgccttccaacctcagcattccaacacacaagattccaagagagtgctgtcaccccctgaatccctaatgttcaaagacagaactattttctttgttcccataccaatacaagattagtatgcttttgtcaatcattaaacttcctgtggccaggcgcagtggctcatgcctgtaatcccaacactttgggaggccaaggtgggtggatcactggaggtcaggagttcaagaccaccagcctggccaacatggtaaaatcccgtctctactaaaaatacaaaaattagccaggcgtggtggcaggcgcctgtaatcccagctactcgggaggctgaggcaggagaatcacttgaacctgggaggcggaggttgcagtgagccaagattgcgtcattgcactccagcctggtgacaagggggagactatctcaaaaaaaaaaaaaaaaaattcctgtttaaaaatatatttcatatttttctcttacctcagtttccctcaagtatgtctttttcataaagaaaaaggaaaagattgagttactcctcatcttctaagacctttaatatggcaattagtgttttgagtagtatgggggtgaggagtccgtcaacatcaaaatattactaaaaagcatcgcaattggcttattttcccccattatggagaagtgaattgagaaaaaaaaaaatcagactgattttcttttaagaaatgaatcacctctaacatcctacaaggctatgaagatttccaagcaggcagttacactacttgattcttgaccttttatacataaaggtcctactgctagtgggacactttctgtccccgaagtagcaagtacttatgaatgtatctaatattatgcattctcaatctctaacaaacgtgatttttttcgcttccaaaataatttcccaagatgaaaacggcaataaaacaacgtgactaataataacatacaatcaggaacttaggtgaatgaaagaacttgaaaactattttacagaccatacatagtcatgcctcgctgaacagggggaacaggatctgagaaatgtattgttaggcaattctgtcgttgtgcaaacctcacagtatacttacagaaacctagatggtagagcctactacatacctatatgtaggctatatggtataatcaattgctcctaggctactaacctatacaggatgttactgtaggcaactgtaacacaatggtatttgtgtagtgtttatctaaacatacctaaaataacactgtacaaaggattaaaagatggcacacgtgtgcagggcactggccatgaacagagcttgccagcctggaagctgctgtggacgtgagtagtgagtgaatgtgaaggcctaggacattaccatgtactactgtacaacttacagacactctacggttaggctacactaaatttatctttagatatattttttcaataataaatcaaccttagcttactgtatcttttctattttataaactttttggctcttttgtaataacgtttaacttaaaacacaaacacattttaaagctatagaaaagaaattttatattcttattctataagcttttttctattttttttttaacttttgttaaaaactaagatacaaacgcattaccctaggcctacacagggtcaagatcaagacgtcgctaggcggcaggaatttttcagctccattacaaccttatggagccaccgttgcaaatgcggtctgtccttgacctaaacgtcgttatgaggcacgtgaccgtattttgattctgtaacctaaaacatatccttctgaaaaacagtatttctaaccaatatatatgaaaatgtctgtctcaaaacatttctctgtgtctcatggtaaatctgccacgagttcaattagccaattcctggcaaggaatccacaggttttcccttctttaggaatgtcaaccattttgccttttatttttttctgtaagattcaattatgatgcactaagaggctgggccaagtccacactaacagcaattcctccgaccctgcagctgaaaccccggcagaactacgccccctcgaacacaatgcctagatcccctttccctggctcggtttagctggtggggagcagtccacatcacaccccggggagctgggcggtggcaggactttaccagaactctctccttcccatttctccacgcaccacaccactggaggcgctctcccttcactgcggttgggtcaatgtggacgttttccactcggccagctccccacgagcacaggaggagggggaggggaagcgcaaaggggccacccacgccagccaggaggtgaggagggagcccggggcagaatgcaggccaacagacccgcagcaaaactgcaccttttccaaaggagcaacccagacgggtagacaaaagcacctcctaaaaatatctgggtgccaaggcctttccttcctcacctcgaagcccaaccaacccgataaatccacaaccctggctctcgggtatatacccggctcctactacgggtgggtgcctaacttccgagaatccgtacgctgggcatcacacagggtgaaagtgggagccgggagcggtgcacgtgttccccgaaaccaagacggacaataagaacaaacccgggctccaagggccgccccacccttctccccgcgcttccaaccagacggggcgccatcgccccgaagtccgcagacaaagcgccctcggggcggagaggagggaccagcccaaagcatctggggctgcacacaaaagagggaggggcgcgaggggcggcgcgaagcgagaggtcgcggcactcacccactgagcccgaggagcccctgcgcttgggcgcggccggggtggaggggggcgcggcgggagccggggctggcggggtccacacgggctctgcctgggggctcacgctggccgggggaggagggggaggccgggccggaggctcgtcgtcctcagggagcttggagggcgagactgcggcagcagacagcggggatggcgcgggcacggtcgacgacaccgggctcgggtcccaagacggctgccgctccggggcgacggggggagcggccggcaggggtccccggggcgccggcggcacgaagtcatttccgaagtccatcaggggcgcgccggcggcaggggcggtgggcactggggccgcggacagcccggcggcgggcttcctctccagcacctccagctcctccaggtcttcgtcctcgtcctcctcttcctcctcctcttcttcctcctcgtcctcgggctccctcacgaactggtacttgaacgcgggctgcggccggggtgggctgtccgaggacgagaccagaggagactggtccaggtcttccatggctggagggtggagatgatgctgcagctgctgccgccgccgccggggccgcgtctcagagccgcgggcggttgtgggggttggggaggactgagaggggctgggccgactgagccgagggacctactgtggtgacggctcccggaacaatgagactgctcctcctgcctccgcgccggtgatgcgccacccgccctgtccccacttgccgccgccgcccagatgagctaggagtgaggccagcggactctccgcccagtttggcgtgactcaccctccccaggggagggcagggact

SEQ ID NO: 481 - DNA, 78408 bp, Homo sapiens; identical to SEQ ID NO: 480

SEQ ID NO: 482 - DNA, 78408 bp, Homo sapiens; identical to SEQ ID NO: 480

SEQ ID NO: 483 - DNA, 38144 bp, Homo sapiens
ttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattctgaaaatgaaaaagtcaatgtaaatatcagttttgtttgctgctgcttaaaataccatcttccaagaactacttgtatgttattcagctaatacaataaatgaaatccttaaagctgcctaattctaagctataattttgccaccttggcctcatgaattagatttaaacaaagccttaaacacataataaacccagaaacgaatggtccaaatgttagaaaaacaatcttttggcaactctgaagtcacacttaaggtctgatagagatttgttactcattatgcctgcaatatgaaaatactgttctcacaatccagcacaccttatcctagtaaaaacactgcagattttaaatacttacttagccatagcatctttaacattcttatttgcaagtcctagataatgatctatctgtgcctgaaagagaggtataaaggaattattaccgttgctaaagaatcttattaaccactactatgtgtcaagctaaaggcttaagaaaccatcacacttctcatttttgtaagacattgaaaatgggcactaatacatccgtaaatcccatgtaatagagtgagtgctctattctgaagtcagcagttagttaggaaattacctgatgccgttcataaataacaggaacactgaagagtgaaatgagagctgaaaagggaaatatacaacttttcaaaaagaacggaatgatttgggaggaataaacactcaaaaaactattaaactggcaactcaagataaccaagcagtgttcctaatgaatgaataaaaacataaggatctctggatgcatctgctgttgaggagccactccagaggaatgaatgaactgtgtgaggctgcagttattagagctaggaaccatttctagcttcaaatcatatcacagtgagatttcataaaataaaggtatccctggttagatttatgactgcaccatcatataaagccaccctttatctggtttatcactgtttgttagtaggagctgtcttcagcaactaaggtagcatttcaataaaccgggaagcagtatcaccaacttatttaaagagaatacaacctcaaacttattttgagatggagtttcactcttgttgcccaacctggagtgcaatggcacgatctccgctcactgcaacctctgcctcttgggctcaagtgattctcctgcctcagcctccggagtagctgggattacaggcgtgcgccaccacgcccagctaattttttctatttttagtagaaatggggtttcaccatgttagccaggctggtctcgaactcctggccccaggtgatccgcccaccttggcctcccaaagtgctgggattacaggcatgagctaccgcgcccggcccacattttcatcccctacttttcatacaatgagaatattctccactaaaatgtctaagctcctggcacacaatctttccagcaatttttcatcccaatggctttgtagacttacccaaaatcagtagtgtcagaccattaaacaaggcaccaacataggtaaatacccacatcaacactgcaaactataagaaaataacattagcccattataaacaaaattcaagtaaagtttcttaattatgctttcaaaagcatcccatctaaatgcctacctacaaaaggcatacaacttgaagactgggtaaagtaccatgagcagttcactattaagtcacgagtctcaattatgaatttcaaaatcctaaaataattaatagatttgacccattttctctggactacactaccaagtagttgattctgctgagatcagacaatataccaagggtgcatcttacccctccagccctaacaacatttaccttttaaatgggaagactataaaggtgttatgagaattgtctattagaattgatttcaaagtatgaactagttgagtgcttgaagatatatgagctgaataattcagacattaatatctcagctgataagcaataattgggcaaagagtacttatcagggaaattacgtttcaggtaccaaaaatatcacctctagcctttgaaggatcaggcacaaagtcagtctgaattttgttaaacattggtcatcatcagttcctttgctttctaattcaaggccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagccagacagtagaattttaggttttatgggccacatagggtttgtgtctcatattattctgtgtcgttgtcataaccctttaaaaatgtacaccacccactcttagctcccacactatacaaaaacaggccgtggcccaaacaagcagtggtttgctaacccttgatctaaagcatatatctttctccatgtattaaacgaactctgactgaatgcttactgaccattaattaagcagtcaaacattagtaagcatatttattacagcttaggaagacactttggatgactctaccaagcaacagttctacaaatagcaacactctggtcaccctaactgaatttaactaatgttcaagtcagtaaatatcaggcattcttaatatctgtcaattgaaaaaaaatttttttaagctgccgtattcttagcaattgctattggaacccctggtagaaaggtttgaaggatgacttcagttagtaaggcttttctctcacagttttatagactcctattgctgaagctaaatataacttttgcacttgagcaagtttactatagagtaagagagttatttttatccatcactatccacaagtctaaagggaaaagtgttgaccttccatattttagaagaaattactctagcaacgaagatgcccttaacatgacagaagatagtaacaaacacaagctaaaataactcctcatttggtcattacagtcactgacaaggcttcactccaagtccacaggggaaaagcccaagacttcacacctgagccactgtaggggctcaaatgtcacttgcctctttgagaacacttcctaaaagccaggctatcccaagacaaagagaagaacacagggaggtctcaaatgtccttagggccaggcaggtgacatacatgtatgtgagaggctgggagagaactgaggcacacagtgatatgcattcttcctctcaaaggggcacttacaaccctgctccatacgctgtggccatgcaaatattccaggccagtgttgccagaaatgtacacttttgtgtgctatcatataatttttaaatgttgcagctatgttgagaaaactgaatacttcggcggcccaaaacagaaatagtggttaagtgtattcagggaacacaccaccaggagagaaaggggtggcagcaagaactaacctagagagtaaccattattaatgggaatccaccacaaatgatggatttgtaacatggcaggaataaggtcaataaacactttaaagaagcaaacaggctgctctcattttggacttaacaaattctacacgattccatggcaaatactttgcaacattatagccaatacttattaactgaagaggtcaaagcttatctctccattgcacagtatcgagactggaggaaggaggcctaaaatgtaatgaagatctaacaaatacttactgaaaaggggcaagggccacatctggtttatctttcttccagggcaataagagaattaaattcactgtgtataacacacctgattaaagagctctgcagatttgtgatgtttcaatttgggggaaggggtatctttaaggcaaacggtgggagagtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcaggccgtttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgcgggtgggaagcgaggggagggaggatttatagtttaatgccacaactttttaaaacagtgatttttgccatactatttgactaggaaaatgatcgttgctcactctataaatacttgaaatcttttctaggacttagaagtttgtagttaattgcaaaggagcaaaacaaacggaatattacacaagaatttaaaaggagaactctgcagaacatgtcttatttttattcgcccaagtcaaccaccaggaaacttggaccaggcacacggatacccatcatttcacaccggtgtttataaaaggactaatgagccctggagtttggttatttttttgatcacattttgaaaggccaggctcctccttcactgcccccgccaaaaggcaataagcaaggaaaaggtttcacatgctagcaagagcggctctaaaatttcaatttctgaggaagatggtttcacatggaaatagtcataattgtaggctgggcatggtggctcacacctgtaatcccagcactctgggaggccaaggcaggcagatcacctgaggtcaggagttcgagaccagtctggccaacttggcaaaaccccatctcttctaaaaatacaaaaattagctgggcgtggtggcggacacctgtagtcccagctacttgggaggctgaagcaggagaatcacttgaacctggaaggcaaaggttgcagtgagcctaagatcgcaccaccgccctccagcctgggtgacacagcgagactctatctccaaaaaaaaaaaaaaaaaaaaaagagctagtgataattgtgacccagaatctaaaaatgtagatataaatttgagggcacacaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaattttaaaaaactcattgttatttaaataagaaaaaacattcatctcaactggagagactggagctattagcaaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgccgtggctggaatgcagtggtatgattatggctcactgcatcctccacctcctgggctcaagaatcctcttgcctcagcctcccaagtagctgggactacaggcatgggcgaccatggctggctgatttttcagtttttttttttttatagaaacagtctcacaatgttgcctaggctggtctcaaactcctggcctcaagcaatccttccgccttggcctcccaaagtgctgggattacaggcgtgagctactgtgcatggccaggaaaaccttcttctttttaaaatgctctctatataaacaaaaactgtggtggataagtgtggccatacacagaagtctctctagaaaggtaatcctatcaagcgtttttataaaaaagcaaagtgatttttatcagcttccttttttcaataaaagctgttttaaggaagtattcagtatttctgtatattcaatggaaacaaacacatggaatctgtactactcatatacaatgacattaggaaagggtttagctaaattcttgtgtggcaaaatcacaaggtttatcgtttatcaaggaagacctttcatgtacattatcagagtgtgcacctgaattaccaagggctttacctttcatggggagaaaaggacagattccctgccttattcatttgcctctagattttgagatctaaatgccaggttcactttaagtgctaacatgatgaggcaactgttacttatttgcagtcctaaatgaattgccagctggggaagtcaccaagcaggtttccttgagctctgggcttgccaaaaacacaactcagggaaaccaatcaagtacgtttttcttctcttctctttttaaaaggattgctaatccttaaggataaattataattttaatgaaagtcctttttttcaatactaagaaacaacaagtgttccagaaaggaaatctgtctcatcatgtgttactttctgttactttcaaattagcagtcactcaatgcaagaacttatcaagttcgatttctctcatttatgctagcttcctcatgaataacataattgcttttacaaaaaaatgtagttttcaaaagaaattaaaatataagatttaacaaagaaattatttctcaaaactttttttaaaaagtcctcatattcgattctcaaatacgtgtgcaaaacagagatttaaaatgtttcttaagatctcatcagcccctttctaacattttctctctcctcttgccccgtatctacacaatggactgtgtatggatgaaaattttctctgaaagaataaataagttttcttttgattaaagacaagtggaaactttatactcaaactcagaaaactagagcataatgaatcattcccagatcaattttaaaaatagatttattcaagaatgacatttctctcaagaaaaatgttaaattgtagacatatagctgccttcactgctatactgtgcaaacatcgaggatgacttttggtgtatctctgttgccgtgtttattgaatctataaaaacaacaagcatctctcctctcccctaagctcaccaggcttttctttgaagtcacctctctcccccaccaatctttgactactaaattcagagatggtcctttgctgtttgaagctctgaattactacttacagacagtatttcttctcagtcaattcctacccacaaaccatccatcttaagcggcatcagtacctcctcctcaatcacttttcacacatgttctaccctagaagtcagctacgtatagaaggtaataatacatgaataggaactggtttcctctaggctgtatgtacaaggttctatttcatttgctccaaaatatttttagttgatctcttttgaaacttattaaccaagcatgccaaacaacataaccgtaatctttttatttacagactaacatcagatcattttaaaacaccactacagatttagtcactaaatgcaaccactctatacgaaagaggtaagtaataaaaggaaactacattatttacccttgatgttattaggaagtaacttaagttccaagtcataaataaaaataagagatgcggctgggcgcagtggctcatacctgtaagcccagagacgcaaacagctgaaaataacgtatcaactactaggttataaaggctaaaatgtttttgttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtccagtgcttcaggcttaaattacacaactgtggtttagtgcctgtttcgtcagtcagaactttgggagagtttatttgcaaggtgagactcttaacagctgcttatgtagcgagatccaaaaactaaagaaaaacttccaatgattaccagttgaagattagttgaagtgtttcagaatattaaatcttatctagaataagaaagagtccaagatatgaaatagctttcatgtacataagtgctagactgtaaagcaaagtcagaatgaataaatctgataatgcattagacgatctttatgcttatagtcaaaattccgattaatttcctttccttttaatctttatgatttccgaaagtattactatatatatatataatttttttttgagacagagtttcactcttgttgcccaggctggaatgcaatggcgtgacctcagctcaccgaaacctctgcctcccgggttcaagcgattctcctgtgcctcagcttcctgagtagctgggattacaggcatgcaccaccacgcctggctaattttgtatttttagtagagacggggtttctccatgttggccaggctagtctcaaactcctgacctcaggtaatccacccgcctcggcctcccaaagtgctaggattacaggtgtgagccaccacacccggcccacaagtatgatttataacttattctcctttaaaaaggaatacaggactctctgtattaagtatgaccagaaaaaaaaagggaatagcacttcttcatccttatttgattggattctgaattttaaaacacaagtttacagccatgtgatttaattaatatttatcatttacttgaatatagaagaacagaattttacactcaactctcttgatactaaattctgggtatatcaaaaatgaaaggcaaaataaacttaccttcagagaatcaactaaatcatcaactaagaagaggcgcctgagttcctttatcgtgcagttcacatgaccaagagcagaattactgtacttctgaaccaactcctcagatatagcaacttcagattccagatatgccctagaaaacaaaacacatcataattgtcactaattggagtgattttcccctaaatgtcaatcagaaattatatatctgtaagaaattaagaaaatattctactataaaagccaactgtttccaaattaggggcaatataaaaactcagcagtaaggggtatttccttgatatgcactgtctgctgactagcacagaaaaagcatacactttgaagccagactgatctgggcttgaatctgatgctctgccacttacctggctaggtaattttgcaaagttatttattcttccctctaaacttagtttcctcatttataaagtggagattatcatgagaattcagtgagaaaagtgcctaatgcaactgagcacaaggatgcactcagtaaatggtagttatgactatggttgtttttttttttttcttaaagttgacactatgttgtctcatcacgttttcctaacaaagatctttttcatttccaaatcctaaactctctcagactaacctttaggggaaattgttcaatatgtcaagcaccagattgtaaagtggctgccaaaagcacagtagcaatcctagcaaaacataagagttacatcatctagatgttttaatccataccgagatggctaaaattgttaaatttaaaagtattgtattggtaataaataaataaataaataaataaataaataaaaatactatactggggaaaaagtcaagtccacaggaatgtaagaaacagtttcattactgtttcaaagaagccattttatcttggcagggtacaaccaactcagaagtgctgagtgttccctcgtatctgttggaagtagtcctcataacctccctatgtctcaggatgccagtttcttacagtggaaataacatcttagacaactccttgtcccatagttttacctctgcaacatgccccaaatatgtctcctggtttttattcacagtgccatcactctattttaagcacttactatttacgagctggaatattctatcactctccaaaccaatctctgatctgcctgcatccaaatccattccgtcagccaatgccagaataaccttatgtgagctatcttagatagtgctgtctaggctgaactcaagcaagagttagaagacctgccactacctagctatacaacattgcaaaaggcatttaacttctctgggtaagtgctccaactctgtaaatttgagaaacagactttcctcagttccttcaggctcaaacattctgtgattctatgactccaacttttcaaccagggacatcctcctaaatctttccaaccttacttccaactactctttatgttgcagccagaaatgagtcattcactaagtattttttaaccttaatgtagcccttattaatcatatggttttcccaatctgcaatgctctcttacctctggtgataccttatttagccagttagccccatctcaaatctcacccatacatagagccttatctgccaatctctttcataaaaccctgatgttctctctcactcctgtataattctaacaatgctttcttttgtgttagtcttatagtatttactagattcagctctgaaatatagacacatgtatacttgtatatttttcctactagagtataagctgttatggaccaggaatgtatctttactaatacatggtctaacacactgttagacaattattaacaaaaaactgaattattaatatcaagttaaaaatactcaaatactcgcactgatatttaaaccagcaattatttgtttacccaaatttgagaaatataggaaagtggctgatataaccctggttggtattctgcttctttgtaccactgttacttgttcttgctgaagacaagatgcctaagcagaagccataaagacagtactccccatcaatgacatcctgtagatatttacactaattcaactgacatttatgtgatattaatacaatgccagcactgttcatcactcagtaaccacaggtattagatacaaaccacataatatcacctctactagtatgattaaggggtactaggaaaaactgtccaacaagcttaaactggtatgttggctgaatttactttataatgactataaaaggactttaagaatataaagtgtttctagccaggcacagtggtgcatgcctgtagtcccagctacttgggacattgaggcaggaggattgcttgagtccaggagttcgagactagcctgggcgacacagtgagacccatctctttgaagaaagtttaaaaaatgaataaagttgtttctaagaaggaaataaatcactaatattttccaaaaacctcaaaaatcaaatgatgtgtaaaattggaacggtagaaaatttagaagttttggcttgacaatatttttacatatttcagcataactaattaaaaatcatacttctttatgatttgtggcttgataataatatgactcggccttttttttttttttttttttttttttgaaagagtctcgttctattgcttaggctggagtatagtggcatgatcacagctcactgcagccttgaactcctgggttctagcaattttcttagctcagctgcctgaatagctgggactactggcatgcatcaccacacctggctaatttttaattttttgtagagatgggagtctcactatgttgcccagggtggtctccaactcctggcttcaagcaatcctcctgcctcaggatcccaaagcactagtattacaggcatgagccaacacgtttggctggctctgccattttcaaactacaatttcaagttactgaattccaactttttccccatcaccccataaaatggagtgataccacctatctcacagaattatcacaaatttaaaataaacttattaaaatatgtacataaaaggttagacacataggagctattcaataaatgttggtctctccccctaaacttgtataacatcattacttcatcacaaagagaaagccagagaaaaatcaccagtctttacaataaacaaaataattcagtaggtctcctctttcaaagtctgtaaatccatttaagtttacccattaatatcaactggatcatgttgtaggtaggtacatagtcatatgcccaaacagatattaccttgccacaaatagttttttcctttgtttcccctactttcaagctaacaagttagaaatagtttttaaattatctcaatctatttgaagaaaaatgatctccttatgcaaaacaattaacatttcaaaggcttagttaatgcagtaggaactgaattttcggatcatttggggtcagggttaggaaattctccaaagagctgggtcttgaaccaaactaagaaccaaataaaaagtatgactgaggcagctaaggaaggcagcatgaacatgggtacaaaactctggaaggggtaaatgagagacaagacaaagacatatggacttcatcctacagtctatagagggccggtgcattttcttttgttttttttctctttagaaaaaaagtggtacttctagaaaaattaatcggacatcatctgtaagaactgaagtaatccgaggtaactacaagtcaatgtagtaacaaatggagtccaattaggggtcagcaaactttctgtaaagggccagatagttaagcattttaggctttcacgtccatatggtctctcttaaaactactgaattctgctattacagtacgaaaccagctacatgaatgagcatggctgtgttccaacaaactatttacaaaagcaggcagcagactgcatttggccatggccttgctttacaggcccctggttagactgaggaagcagtggaaaagaacaaaattttgtgattttcctaacaatatttagtgattttctttatatgagatgaaaacaaagataacatcaaaacaggagcctgaaaactagcatggtagtggtgttatggatagaaattaacaagtttgaggggaaaagttcatttaaaaacgtggtgaattagtcgttgtcgggcgttggttggggagttgaactgttaataagtaggaagtttctttttgtgcgatgaaaatagtgatggttgtagaattctgtgaatatactaaaaaccaatgagttttatggtatatgaattatatgtcaattaaaaaagagggggaaaaacacgcagagtatgaggtgagggcagaagactcaagctgaggttgtgtctccatagcaactatataatgctatagtatacttgtgaaaacaagggtagaagatgatagttgagagacaaggagatgctgaaataaagctctccaaaaaataattaaaaagtaaagccttaagaaacgagaagaaactagataaagaaaatacataaagaaaagcataacagaaaacatcagcatactagaaagatacgaaatatcagaaagcacgttatcagacagcataaaaagcaataaagaatatcctcatcaaacctacccatgttaaaaagatacaacactcattcaagtaagataaccaatgcttaactctaataaatattcctaacaagtagcagagttagtttaatgatacataaacagtctcctccatcatgagcctttaaaacgacttttagaaaatctcaaaagcagatgtttttggtatagctcaagcaaataactgcaattatctttaacaaaaaaatgcatgcttgtaactctatagacagtagatgaagtcttaataccaatcctgtttacactattgccaatgcatgccttgttttccagacatctcacctgaatgggtggccttcatctgatttctggatagcttggatcacacccttgtatatcctaaagctgatggtcacagagagcagggccaaggcaatgtaggctgttacgctcacaatgctgaatactgtcaatgaaagcagcaggaataggctggcaccaaacaccactccagtcttcttaatgtctctccagtacaggaggtcaacaactaaaaattgaaaaagaaatctgaaattagaatgttattttatcaatttggatttgctccatctatgaaaacaaaaacgctactacataaagtaaaatcaaacctaaaaatttaaagaaacactaagttaaagaaacactaactttataacccacattttaaacccactcttagttgtatattagtataacacctttatttttgaccacgaaatgttttttattcaaatttatttctgcataaccaaatcattctagccatacacaatgattaaatgtctccaaagcctagaagacttctaatccaaaacaaggagttacttaaaataatcttgggggctgggtgcggtggttcatgcctgtaatcccagcactgtgggaggctgaggcaggtggatcacctgaggtcaggcattccacaccagcctggccaacacggcaaaactccgtctctactgaaaatacaaaaattagtgaggcatggtggcgcatgcctgtaattccagctactcgggaggctgaggcaagagaatcgcttgaacccgggaggcagaggttgcagtgagccgagactgcacctctgcactccagaatgggcgacagagcaggactctgtctccaaaaaaatcatcttggggtttttcatctcatacaatgcatgctatatattcaaataattcaataaatatattccaataacagaaaaaatattaacacactaaaatgagatacttcagtgataccaaaatatatttatatgcagaaaataaatttaaaaaggccgagatacaaaaactacacatatgaatgagctttttttcttatttgatttttttgtgctagtaataactctgctcttaagatctgtcttttagaaacaaaattgtaacttaacctggctatcattaaaagaagaatttcctacaaagaaaaagacaaaacaaacagcctttcgattacctgaaaagctacttccttctaagagttgatagatataatgccataaaaatttaggggtcaaagaaaaaagaaaagtaaatgtgttacacatttacataatgtttattaatagtaaggagtcagacaaagcccaatttagcatgtctgctcttggacatggccacagggccactgaggggatcaagtaagcatagcctgatgtctcaaaatcgggttatgctcaatgcaaggagaaccccgaagtgtgccaaagtgctcttgaattcataggctgatgtaattaatctctctctgaactgtgaacaattgggagaaaaaaatttatagtaaatatggatatactctttctaagaagaggtgacatcaaagaaaaatcacagttttagggctgctttggttttgatccccaaggtcccctaagatgtatgtaactttcctttgctcttaagggtacttctgtagggaaaactatgtatgtgaactgcacaatgttggatattagtacaaagcccttaactgctgctagtatatcatgagtactgtttaggatattttaaatgcccatcactgtgtccagtacatagcagggattcaaacacttatttcagttgcctaaatggtctggcttgaatgctattaatttaacattctatatatgatttcgaagtttgttttcaaactctgatttcaactatttattcaaatattcccaaacttgtttgttacagcccctgcctaaaacatctaaaggcgcttagtgctattccactagtttctactattgtactagcacaactgaggactgacaagaacttgaaatggcctatctataggttgtcaaagggacattacgaataatgtcatattgaataaagagataagagcaacgctaataggtttctggcaatcagcaaacacttaatgaggtgaaactgttcaagtaactcaacctagcagaatgagaaaactcattctgattcttgaaggtcttgtccaacattacaattctaggaaagataagacatataaaagcaagtcaatgaaggtataaaataaacattgcactgctataagaactcagaaaagggaaaaactggaagaaatgttaagactgtgaaatactgtaaatggaaactgagctgggtcttgaagaatgaatgcgacctagaaaacctaaaggtacaggcctaactgtaagcatctttctgctaacagtggttctaataattaatgcctttttttttattaggagggtacagtgagagaacacggggagtgatgataaagacagcccttggtaggatcactctttcctgtgaggctgcctttgtaccctacaacggtgacttaatacacacaaacagaaaacttaggttctatagttgggtcacctagactaaaaaaatggttgaataacttacgagctacgtgacctcaggaaagtcactaaagtcctctatatttcagtttcttcatctataaaatgtatattaaaataggaatgaacaaaaggcataaagtttctagatagaaaggagaaaaaacttttgagatttactgcaccccagggtgacaacagtcaatagttgtatgtatttcaaataactgagagtaaatttcatgtctcaccacaaaaataataggtaacaaggcggtactttaataagtttgatttaatcacaccacattgtatacatgtcaaaacatattgtaccccataaatatatacagctatgatttgtcaataaaaaaataggaatgatctcattgagatgtgattcactagatttttcattagtaagataattaatgtaaagcacttaatagagtacatagcatacaataaattcttaataaatgtcagtgctatttgttgctgttattattaccacaatcacaatcatcttactcaatacttaaatagtaaatacataaagaagaaaatttcaaacttattattaactttaggttaataaactatactgttgtgttatattgtaaacatgttactttataaaccatatgggaaagaattttaaagcttatctaagtttttactattatagggtaagtaaaagctaatagcccaaaggaatcagcaagtaaggtgtacctcaaatatatttttcttttactttttttttttgagacagagtctcgcactgtcgcccgggctggagtgcagtggcgcgatctcggctcattgcaagctccgcctcccaggttcatggcattctcctgcctcagcctcccgagtagctggggcaggcgcccgccaccatgcccggctgattttttgtttttttagtagagacggggtttcaccgtgttaggaaggatggtctcgatctgctgacctcatgatccgcccgcctcggcctctcaaagtgctgggattacaggcgtgggctaccatgcccggcctctcaaatctatttttcatatgaacaaatgctcctttataaaagtggttctcaaactgctcagaaacattaattaaccttcaaaatcactattggtgagaagttaaagtaaatgcagatgtacttgctattttttaccatcattaaaaactactcagtaaaacctggccatgaaatcaatgactttagatttgagaggtttgcactgtacaacataaattaatgtctaatcaaacttcctaatattataacagagttactgtttaaacaggtgtagtgactatatatgaattatttataattagtctataatttctacctaaatgaatatggtagaaggaaatatcaggactgggattcaagagacccacatcctagcatgtaccagctcagcaattgtgtgattttggatacgactccaacctctctggccttcagttttatcgtccataaagggcattaatcttctaatctctcttttcccttaaggaattaacatgacccacagtcagtacaaagatacacacattagtactgcattcaaattccctgtcagtggatccaaaccgatgaagttttactactggggcattatctgtgctcaatataattttaaaatatttccttcctttttagatctagatttttttggggagaaggaagcttaaatatttttattcataccagtcttctgatttgaaccttcctagaaatatcttaagtaccagacattattaaaactttaggaaaataacaaattcatattcctacaatttttcaagcaattataaactctatcattatggcaactgtatgagagaaactttttaaaagtttgaaaaatgatacgcttaagcctgatagatgttttgattgctgatctacattctccaatctccacacctcctttatgccaaacactgcagtagcctatacaacattatctctttcaattattaaaacctaatgagccactatgcaaagtgggttatgcctgtaattccagcactttgggaggccgaggtgggaggccaggagtttgagaccaggctgggaaacacagagacccctcatctcttaaacaaacaaacaaacctaatgaaaggtaggcttgaaagagtgaaacccagctcctacatgactagacccagatcacatcattaataagtggcagaacatggatctgaacccaggattcctatggataaaaactcatattctccattgtatgatgccaaattgaaggcttagctgattaaagtgcttcaaaatgttatacgtgtgcatgcataacaaatgggcaaagtgtaggcagataattacaacatgcaagatgaatcataaaggccaagaagaaaagctaagtgaaattaacaagatagtttaatcaataagggacaaattttaatgtgaatatttcacctactgttagacccaaaaaccgagaacagggctttactccaatatatttgataagtactttcccacagtagagaactataattaagttgttgaaaaatgacttttaaaaactatgtgaatctaattaaataaaatcagggtatatttatgcaagagaaatgtgtagccattaaaaaaaagtgatacagatctacattatcacagaaacatgtccataatgataaatgaaaacagcatgttacaaaaagactcacagtatattctcacttaagaaattaaacatatggccgggcgtggtggctcacgcctgtaatctcagcactttagaaggccgaggcaggtggatcatgaggtcaggagatcgagaccatccttcctaacacggtgaaaccccgtctctactaaaaatacaaaaaaaaaaattagccgggcttggtggtgggcacctgtagtcccagctactcaggaggctgaggcaggagaatggcgtgaacccgagaggcggaggttgcagtgagccgagattgcgccactgcactccagcctgggcaacagagcgagactccatctcggaaaaaaaaaaaaaaaaaagaaaagaaattaaacatataactatgaagtctgaaagtatatctactaagcagtgtttttatctctgcataacgggattatcaatgagttttacttgcttctttactcttttctgtgccatctgaaatggtcccactctaatggcaagcatgaatcatgactataatcagaaaaaaattcaccccattctgtttctattcggtactactgaagagtcttatgagtgttatttttcccagtaggctttcctattggaaaaagaacaccctgtctgttaggttaataaatatttggatccagccaacagttaaaattctagcagtatataactaagttgatgattctggtgttctgcgttgaatcaagtcaattttcccaaagttaatgataccagaatagtcatgtataaggcccagcagtactcaatgatagtaagccctaacctaccacttcctttcctcttgtcatatggttcctaggaacacggtcttttcaataaatggaaaagctctgaaaattacatacgtaagcccacacatactgaataaaaatatgtaagcagctacatgagagtagctcaaagcaggtatcatgacagacatactgaaacaagtactaggaatgctctggtggagccatcagaccctttagagccctggaggaaaacaaaaagggaagaacagccaagagaaatgagacaactaggcactgatagtcacacataagataatatgaatatatcctagaataggaacacctgagaggcaatctacactgccaccaaccccactgtgcaaagtacagaagaatttccatctttttccgtaaagaagctgaaaagattgttagtgaagctgcaagaatgaaaaaaatattagttgataccaaacagtgtggctgacttaattgacatttgccaacaaaatttctagtcccttacagattcctcaaattggttttaataaaaaaattttgaaagattgtttatacaggataaatgattctcaataggaggaatgtatagaactttattaaaatcccttctgagaaatatagtgtttttctgagaaaaatactgttgcttctaatggtcaacaagagaattattagttaatttagatttattagttaacttagaagtttgttcaatcctgataccaaaatcagacaaagacatcacaagaaaggaaaactacagataaatatcccttatgaatatagatgcaataatccccaacaaaatacaagcaaactggatcgagcaacatataaaaaagattatacaccatggccaagtggcctttatctcagaaatacaagattgattaaacatacgaaaatcaatcaacacaataaatcatattaataggataaggacaaaaaccacatgatcatcccaacagatgcagaaaaagcatctcacaaactccaacaccctttcaagataaaacatttaacatactaggaacaaaatggaacattatcaacctgataaagagcatctacaaaaacccacagctaacatcaaactaaatggtaaaaatctttccccctaagactaggaacaagacaagtacatccattcttgccacttctggtcctgggggtgctatgcagtgcaactggccaagaaaaagacatacaaggcatccatattggaaaggaagagattaaactctatttaaagataacatgatcttatacagtaaatcctcacttaaatgttgaggatagctttctggaaactgcaactttaagtgaaatgacatgtaacagaaccaattttaccataggctaatttatataaacaagacttcattttctatggcatatttctggtcacaaaaacatcatcatattctaaataaaggtcgggcgcagtggctcacgcctgtaatcccagcactttcagaggccaaggcaggcagatcacctgaggtcacgagtttgagcctggtcaacatggtgaaaccccatctctactaaaaatacaaaaattagctgggcatggtggccggtgcctgtaatcccagctactcgggaggctgaggcaggagaataacttgaactcaggaggcggaggttgcagcaagctgagatcacatcactacactacagcctgcatgacacagaaagaccctatctctaaaaaaaaaaaaaaatctaaataaagactcaaaacacttctactattaaacactgaaataaagtaagctatatatacatttaagaaagattttttaaaacacaatttttggtgaatcagtgatggtggttgtagtggtggtgggttaaatcaaggaacaaatgtctgcaaagcaaatactgtggtaggagcacctcctaccaccaccacacagttcagaaacaacaaatatggagggatctctaagtgccttcatactgcatcatttattgttgtgcatttgcatgattattatatactttatgggtttttattttataataatctgtattcattcattcattcgttcattcattttctaagctgcttattccagttctgggtcacgggtggccagagcctatcctgacatctcagggtgcaaggcaggaaccaaccctggacaggacaccattccatcacagggcacactcatacacacacccccacactcattatgagacaactgatacacaccagtgaacctaatgtgtacatctttagaatgtgggaagaaaccacagagtacccagagaaaaccccatgcagacatggggagaacatacaaatcccatacagacagtggccccagcaaggaattgtttttttttctcttcctcatgcacattataacgaaacaacactgaacaaaacaatgatatgagggtctgttgtatgtattttaaaaattctaaggaatccacaaaaagctactagaaataatgaatgagagtccagcaaggctgtaggacacaatatcaatatacaaaaattgtatttctatacactagcaataaacaatctgaaaatgaattaaataattccatttgtaatagcatagaaaaaataagatacttaggaatacagcgaaaagaatttcaagacatatgaactatacataacacactgtcgaaagaaattaaagatgacttaaataattggaaagactcctgttcatgaattgaaagacattaagacagtaacactcctcaaattgatctaaaatacaaacactatcaaaatcccagctgtcttttagcgaaaattgacatgccaattgcaaaattcatatggaaatataagggatccaaaaaatcaagaaaaacttgaaaaagtacaacaaaggttggaggactcgaacctccctatatcaaaacttcctaaaaagatatagtaatcaagacagtagagtagttacacaaggacaaacaggtagattagtggaatacaactgataacccagaaataaaccattacatttatggtcaactgactttcacaagggtgccaaggcaactcaataagaaaaaaacagtcttttaaacaaatggtgctaggacaactggatatccaactgcaaaacaaatgacgttggattcttctacttcatatcacacataaaagttaactcataacggccgaaagactcaaagttaagagcttaaactagaaaactcttttatctttgtttcttatctttttgttgttgttattgtcgctgagacaaggtctcactctgtcacccatgctggagtggagtggtgcaaaagcaggcagcctcagcttcctgggctcaaacaatcctcctgcctcagcctcccaaagtgctgggattgtaagcatcagtcacagcacctagccagaaaactctttaagaaaaaaataagtgtaaattttcatgactttggattaggcaattgtttcttacatataacaccaaaagcagaaacaacaaaagaagaaaaaagataaattggacttcattaaaattaaaaactttcaccacaaataaagtggaaagataccacacagaacgagagaaaacacttgcaaaccaattctctgataagagacttgtactcagaatatattgaaaaacttttacaacagtaaaaaacaatttaaaatagacaacagatttgaatagacatttctccaaagaaggtacacaaatggccaataagcacatgaaaaaatactcaacatcatttagtcattataaaaatgcaaaccaaaaccacaatgagataccacttcataccccctaggatggctataatcaaaaagatgagcaataaaaagtgttaacaaaaagtgatgaagattagaagcctcatagattgctgatgggaatgtaaaattcagccactgtgaaaaacaatttggcagttcctcagaaaattaaatacagagttatcttattacctggcaattccactcctaggaattttcacccaagaaactagaaaacacaaaaacttaacacacaaatgttcatagcagcattattcatgatagccaaaaagaggagacagacaacccaaatgtctatcaagtgatgaatggattgttttaaaaaaaggtatatccatataacagaatattattaggccataaaacgaaatgaagtgcagtagtcctcccttacctgcattttccctttccctggttagagtttcctgcagtcaaccacagttaaaaattaggtgagtatagtacaatgagatattttgagaaagacaccacattcatttaactttagtatactgttaccatgattctctttcattgttaaagttgttaatttcttactgtaactaatttataaatttaactttatcatagttatgtatagataggaataaacagtatatatagggttcagtcctatctgcagtttctagggcatacgctaggggtcttagagtcttacccctcaagaataagggggaaactactgtactgatacatgttacaacccagatgaatcttgaaaacatatgctaagtgaaagaagccagtcacaaaaggccatatattttatgattctgtttatatgaagtgccttgaatatgcaagttatgaattctgtagagacagaaagtagataagtgattgtcaggggctggggaaaaagggaagaggagtgactgctagagggtgtggggggctttttttgggaggggggtgaagaaaatgtcctggaaatagatttaaaactttaaaaaaatagtcatttcaacatacttctctactaggttgtaaactccataaaagaacatgtatgtcttactacctaactttatccccagagctgagcagaaagccaaaaacaactaaattttcaatattactgttgactgattagaatgaatgaataccttatgacaggtcactaattctaattgatttatttaaaaaatgtttctacgctttagacttaacatttattttatttacactattttcagatgtctacatttattaaataacaaataatgctttcaggtaatttataaaaaagaaaacactgttttgcaggcttgtctccccttactagaccctggaaaactgataaatgcctttcatctttatattcccattacctacatcattaatgcttgctgcactgtctgaatagcggccagattatttttagaacagaaacatttaaattcattttcaaattaaaataaaggacacctttcaataagaactacaggatcaccaaaatgctaattttggattcctcagtaatcactttagtggttccttatttttgaaaaaccaaaattaagacaaagagtttatacagggaaagtttaacttttcttggttcctcaagtctccttctatactgcagaataaagggttaatcatacaaggtaaccctattctgtggcctcaaccttactcatacaaaatgttcattaaacatcctttcaaagatctgagatgaatttagcagtacttttccatttacaactttgggggaatgcttatgaattgctaaaaataatgttcatcaattttaacaaacccttgtagtttagaaaaaagtaatttatgccctgcagtccttgccgtttgtctccaagataaaaatgtgaaaaatgactgtgtgtaatagcatctttatcaaaataaaattttaattcaaaataactcagtacacttaaatcttttctttaaaataaaaacttctggctcaatgcacagtaagaagagctgcctacatttggtaatcacaaactgtcatctgccatagctaaaaatagtgtcagcctgcattgtgcatgccttacgtgcagaagtcatccaattacattttgcctcaaatcaaattcttacattcttctttgaacagcccgaagtcaggtttcaattttaaaaagcttttgtctgggaaggcggggcagtggggagttaaactggctgttcctaaaaatactaggacagggaatggctggcagaaaaatacctacttttgaagcaaaagcaaatattaagttctctttaataatgccaggtgaggaatgagaatggcagttaaataggaaataaacaaatgaatatataaatattagaacggtattaaaatttcagttgtttttcacaaccatgtttataataataagtaattatatatttattaagaatcacaacccttaatcaaattcttcccaaatgccaggaaaagtaattagaattcagaattgaacatttagtactacgtaatagtaagcttttgtctcaacacagtaagcattcacctgtcaaaaaactgacaggcgaaggtccacaaaaaggatctgtgcagagtttagctctcttcacaaagacattaagaggaccttaagtcctatttcttttgagtcctatttcttccttcaggttagtatcaatatgatctgagaagataatgtaatctctgtttccctgtgtgtaaaattagaaaaataatacccacccctaagaaattatttgaagctgaattgaaatttcacatatggaaatgcttggtaaactgaacacactggtactaaagctcaagagataaggtcaagaaaggcaatcaaatattatatgtaatgcttagctaagccctgattttttaaaaaaggtgaattcaactttctctgaaagtatatgtaaagaggtttcaattagcaagtctcagcctgatgggtacctgttactgctacaaaagtatctcaaccaaatacctggcaagccagcatctgtcttggctatctcctcttcctttaactagagtttttaaacagatacgtgcaaaatttcaggtccttgtctcttccactaaatctttcctgtcttactttgataacgttacagtgctttggcgaatttgaaccaccacacctaagaaaataacactttacatgacaaacaaatagcactaataaacaatcagcaaaatttctatacttcccctttctacaataattttgtaatctcccagtctgagcaaggcactgtgctgagtacattgtatacattacctcgaatccataacaactctaaaaagtattatctgcattacatatgtgatgcaaatgtatttgtacatttgtaatgtaaacatattgttaaataaattgtgtagggttacaaactgaaattcaagtctgaccatgaaggtctcactctattataccttttgtatttaaaagactatattaatactcaagtttctttttatgctacttgagaataccaaatgctatttctaccttagtttaaataattgagacaggagacacaatttactaacactacgagtagagttataggtgagaccaataaatttcattaagagattcaataataggaataaaccatgttttgtttaaattgttttctagaagcaatctgaattgttctcaccttaaaaataaatttatactataaataacaatctatgtaattacatatgaactataaaaatagataaaaaagacattggtgaatttaagaatgatattaaaatttttaaataagcaataaacttgacaaacacagcatataaagcaacgaaaataccatttctagaaaatctccaggaaacagaagccaaacataaagatgtgaagttaagtcaatgtttactattcattttattaaaaaaccaatcctacacccaggatagaaccttattattattactgagaacaaacggcctttacaattaaaatcgttgtaaacaccgagtgtgttttcacacacatactcctttccccacataacatgaactaaaagatggtttgtgatttaaaaaatatgcgtctctagctctctagtaaccaacactatttgaggagtacaagattctcttacccaagtttagtattgttaaatggtccctgcagttatgaagttgcataggaaagaaaattttcataaataagaaaacatccactaagtaatcttcaaaattaatccaagctcataaatatcccttactgtttaaattcaccatccagcctcactcattacctaaatgtcttgtcagataaaaccacccaaatcaacagtgcaaaattgcaaatcttcctattaacatgaaattccacaaagttaatgttgtgagtgatgctggagaattgctccaaaaaacactgacagtccaacaggcacttcaaaacggagcctctcacttcaaaagattaggaagagcccccaggaaagtacatttttaaaccactgaacattttttgtaaagggacattatatatgacccactgtgaaattcaaccataaagcaaaagaagccattttgtgctagtatacaattttgtggcaaaaattacattcccctaaatcccaaaaacctgattcatcctctatgtattctaaaaccttatgcacggctgtgattataaactaaattatgttaagaatgaactaaaataaatttattttcatagttattggtttttatgtgccaagataaagtcaatcaaatcttattttatttatttatttatttatttatttaagacagtgtctccctctgtcacccaggctggagcagagtggcatcatcatagctcactgcagcctcgacctcctgggctcaagcaatcctgccacctcagcctcccaagtagctgggaccataggcgtgcaccaccacaccaagctaattttttaaaattttgtagaggcagggcctccctatgttgcccagactggtctcaaactcctgggctcaagcagtcctcccactgtggcctcccaaagtgctaggattacaggcgtgagctacaaggcccagccagtggtctttttttcctatatttcaagtagaaaatgcctcaaatatgttgcaggaacataaaaactacctatggctgtttgccatcttctaaggataacacgaatttctctaagagaaaagtgaagttcaataacaccatacatgcttcatttataattaaattcaccagtttacttcattagttcatgtggttttcaatatttcccttaatcctacactctttccagctttactaggagaaaacaagcaaaaaagggcagaaaacagttctaattttgcactcctagttttcctaaaccatgataattttctctttacagaataatcctacctttaatttcattttctctaaggtaaagctaaatatcttctctttaagtatgttggatatacatgactctccctacctgcactcactttaacgatttttcaattgtaaagaatgttaaaatgagaacttctcctatgacaagtctgtatttctgatacatgttgataagcatgtggttattaagttactagaattgatcaagacctgcataaatagaaacctaaaattagaaaataaactggttcaatgtataatttactatagtttaaattttccttcttgttggcccatctaaagcttaaaataagtaggcaccaagtcttagaaacctgaggttactgctcaaaaccctattttctactaacaaaaactaaatggaaaacatactgtcccgtaactctagaaacttgaagcttaatatactggagttgggggaggggaagagctcaaagcaaattactagttcaaaacacagaatgaacctcactagtaagtaaatcagttatatttcttcttccataaccttatataactgttgtacacacaatataaatgttcatcgaatcaatgaacagtacaaataatcattaatatttgataatttggtaatttttcagtttttaaattgctttgagcttcataagaaaatgttatatagaatatggtagtgatatagtatttgaagaaagacgacacaaaatattttagtgtctataatacgtccaatgcctaaggggcagctgaatcaaacaaacttgaaagccatgaagcagattaaaaaaaatacacacacactcagtaatatgtcagccttattcatgatagagcagataaataagtataaatgtggtgtcagatcactgctccaaggatgcaaagaaaagtattgcctaaattaaacatcatcccttagcccaaattctagcaagagatgggaccaagtgaatacagtcagccctctatgtctgcaggttccacatctgcggattcaactaactgtggatggaaaaatgtagctagacctatgatgactgcatctgtaactaagcaagtacagacttttttcctgtcattattccctgaacaatataacaactacctacattgtaaaaagtaactcagagatgatctcaacaagatgtgcgtaggttttacgaaaatactgcaccattttatataagagacgtgggcatctgtggattttggtatccatggtgtagggggacgcggggtggagggctggaaataatctcctgcagatactgagatggctgtacataaaaagggaacttaggggacaaccggagaacaaatttaagaattctattctctgcctagatattctgcctacatcccagcatgtaatccaatcctgaaagatgaaaagaaattattctcctggcccagagaactcccactaggtttaaccttttgacaatacctgtactaaatgactaaccacacctaccttcttccatgattagtgtgacagacaactgcctgccttttttattgcagtgaggacaatacgaaagaagtatacgacattcaataacatgccacaagtagactatgcacaaataaaatatcaaaacatgggccgttttagcttatatacttttcaatctttggttattcaagtgcaaatataaattataaaataaaaacaaaggcttcatgccaccatggacctgtggcatggtcctgtgtgggcctgacaaatatttaaatctctcgttttcttggtttccttgtcagtaaaacaggaaagttggaataaatgattaacagaatgccttatctgcaggaatactctaaaaattctgaatctacagaagttccttcagttgctgaattgttcctttaagaaggggaaaagtgggggaatcctttttctaattgctcccacttgaaatcatattttaaaattttccaaaaatttatgtgggtttaaggccagaagtaaacctggctgaacaatggagttctcagccttttccttcattgacaagctgcaccaagtcaatcagaagacccagtgatgaagccatcactgtttttggccttcaaaaaaatttggaggctggaaaaagagccaagatatttatgtataaataattgtaatagaaagtacaaaatgaaacccctcatgcccttcccttaggggggaaaaaaaagtacaaaatgaaaaccgagagatgggagtgaggaacactgaactacctccccagggaggcttagtgaacacctcaaggagaaccgggcctttgataaggactacttcagcaaaatgaaatgggaagaaagggccttcaaggtggagagaaaaacacaagcaaaggcaaagaacaggtatgtttagaaaacgagtccttcagtgtggctagcgacagggagtaatgacagacgaaattataaaggttggggctaggccatggaatgcctttcaaacatccaggatagacagaagaaacttcatttgaaaagtaagtaaaggaaaatcccttaagtgccatgattagagttgcactttggaagagtaattttaatttcgctgtgacacacataatttagtggaaagatcagttaggggccctggtaaggatgaggagtacacagacttgggtaaataaaatagaaaggctatttccaccattgctcccactgcttacacatcttacaatataaagctggttcttatcaagtaatttaatgagttaacactgacgaaatagctatcttagagtaaaaactgtaagaaaggaatacatactatttaaccttagccacagatccatgatagacactcacattcactgatgaaaataacaatttgtacaatctttctggaaagcagttttgtaaaaggcgcccaaagcctaaataacataacccagaaatttggaaataatcacaaatagaaacaaagacttatgttcagttataatcattttagcattgtttttacaggttgagtattactgtaatatgtgggactagaatatgttggaatatttggaaatattttggaatacttgcatatacgtaatgaggtatcttgggagtgaggcccaagtctaaacatgaaattcattctgtttcatctacatgttatacccataggctggaagtaattttatgcaatattttacataattctgtgcatgaaacaaagattgtgttaagtatttatgtgtggaattttctacttgtggtatcacatcagcgctcaaaatgtttcagactttggagcattttggcttttagattttcagattagggatgttcaacctgtacttgcaaactttagcaataacctgatttaactagatggaattaaaatattgtagtcattaaaatagcgtacagtatttaaaaaataaatacttaatggaggaaaaagactacagaataaaatataccacaaaaccctcccaacacacattaccctgttaaaaagataccccaaaactattctctatgcgatgtgagttttactcttctacttaccttctaaattctctataacacatacctatgtagtgctgcactactaacccaagatctagaaaatgtatctaatgaatgcctaaatattcggttttaacaaagtttagaactgaaaggagagtcgttccaatcagtaggccccataattaattaatgccaaagttcccttgttgggcattttttggccttcccgagtaaggcatttcaaacagcaagacccctgctactctctaccaaaatgtcagtatgagctttattcaaggctttcaaaaaatgaaagtagcttatcataagtaaagatcagagagccctaaaagaatctctacacggaagtatgctgcagaaatggtccaaaactagtttgtcttgagatataattatattgagttttaatgctaggaacatttctttccctatcctacagaaacttctctcaaagattacctctggcacattaactgacaaatccaaagagtactgtaacaataaagaacagtgttgcacctacttttaaaatttaacaagattcacatccatttctcactcatattaaccagcttctctaagtatttaattgcccattccttcttgaaaattctttccccccttagtatcagttacactatcctgcttcttttactgctctagaacctcctcattttccctaaagccgcagacctccataacgcaggttttaggcttttctttcttaatagttctttcagtgcaaatctcctcacatagtattcacctgcctcactctgcatttgactcccaattctttatcattaaacctgtcatttatctgagcttccgagatgttctatcatcacttcaaattcaaagcgtctgaaactcaacttggcatcttttctattttagctctatttctactaatactaaaggactgtcattgccaatatttcactctaattcaaacttcatgttgccccttgagtctttacacctcatccttgtcctgcaaatctataccaaatgccaagtattccttccttgaatttctcaaatctgccgcttcttcttccttcctatttcaggccaaattcaagcctatctactttaaatctgggcacaactacagtcatcctaactggtgtggctataggttattctcccccagttgatcttatgcagcaccctaaaccaactgctatcatttaccattccctactttaaaacttccaaatcctttttatttcttttacaatcaaatccaaaactcaatgtcttctgcggtctggcccagggtatctcttccataaaaccagagaacctctcaactggaaccctgggcagcacgcaaatgaggaaattaaaaccaaaaaggtaagtttcttattctagccaaaatcaaaatataccagaaccaaggcttaaaccctagatcactgtttcccgaatttgcccaacaatatgaattacaccaggatgcttaatatgcagattgccaggccctacaaaatctgatttggtaggtcacgacccaaggaatctgcatttttaagaagcactagatgattctcatctacagagaagtatgaggaaacctaatctagttcatctaaattttctacattccttgaccacaccaatcttatctttcaactcctgtcctaaatattctgttctacccagaaagttatttactgtctcaactatagctttttagtggttatatcattctcctaccccatccaaatccctaggcctacccattccttcctattttaagctcctaaaaatcttttgactaccttaatcaaaattttccatataaccccagtaatcgaatactatgtaaatgtcatttgtcataagtatcctaaacagaaaatatgaagaatatataaaagaatgcaaattattaatgctttcagcctgaaagatcgagtatcttaaataccagttaatcggcaagcaaacacacacacacacacacacacacacacacacaccaccttttaaagaacactgaaatcagagcatctctcaaatctgtcactatgctatactggtggtcagggggagaatgcagtagaaaaatgcctaagtatattttttaaatttacctagaccctagattaggctccttctctgctgtcaaactattttttttttagatgaggaaaaactcattccatgacagcttccaacttctcagtgatttccaacttaaaccttactctgtaatcttaaatattactctgtaataataaaattgtctgctgatagagaaaatactaaaatataatttaaccactgactcagaaaaacaggcaaagttaatcttaccgaccaaaacagccagacaggtactaaaaaatattaggccattccacttacaaagtgaggctccccagagatattcaggagtaaattcaattttacatttgagtacctaaaaataatcaaacaaatctctggaaaaaatatgaactacattggaacttaatttctcctgtctcataatacctttaaattacttcaacaaataaagaacttaagatgttatttaatgatttaagacttaagttattaataaagaaccttaatagttgcagaatgagccctgatacgacttttcacctacttttaaggcctgtatttattgtattattatcatttgtatcattttcacttagcaaaagctaccatatatcaattcatcaatctgtaacgtcaacggctaacaggatgaagaaataaaaatccttctctttaaattcacatgtaaagaaatcctaaaggcaaaacccaaagctgtattgttttctattattttttaagttgcaaccataaaatcttaccaatgtctcaatatggtctcaatcttaaattcaccttttccccacatctttattgaacaaatttttaaaaagacattgtaaaagttactgtaattagctctacatacttttagaaatattgttgccaatcctgctagaaggaaataattttttttaattataaaacttgaatgtagccaggaaaaaaattgcttacgtagaatgtctattttggactacttaaaaatagctctaataatttaaaggtaatttattataagtggtcagatatacagcctaccactttcttttaaagaaaaaaaggtagatttaaccatctacataataaaatattctttaaatattctagtcaacattttaccatttacaggcttaaattcttacacaatgatccactgagatttgaaaggatctgggctttcaagggggaggaaaagggatcaaaatcactgattggttattacaaggacaaaggttagtgacttaaatatagacatgcatttaaaattactgcgtaattatactgtgtaatttgaatgatttcaagatgcacataatctgattaaaagaaagttggtaataattttaaaggttcaaatcagattttcaaagaagaggcttactgcaaacacaatatcttgctacctacaaacctttgcacagaatttcaactacaccaagtaaggttttttaaaatagtcacggaaaatatgtcactgtgaaacacaaaaacagcaatgtgtatttaccacatccaagtgacgaacaaatgaaatctgttagatctatattgtttacaatgtgcaagattagagaacagaacctaaacggcaggactgaaaagactaaaccgaatgccagtgaaacagaacagcatgacattttctggtatacaaccaaatgtaaaaacacgtgagatagccgttttaatcctttagacttcaactcttcagaggtttcactttcaatccaaaatatctaaattccaaagcttattcatagaaatatattagtggtcacatataaaaactgaataagaaattaaaaagcagatatacccttgtccttccaatttttcttctgaccgtccatctcttgtcacgatctgctttgcagctccaattattaattatgcataccaacagaaaagctgtaactgcacaaacctactccctgagacatgaaatacccgtttcctcaaccgaagtctgcagtctcctctgctgcacaactgcagcaggactgaagtcacctgacgtcttctgggtgtggaacagtctgacgcagtgcaatctgtaactaggct

SEQ ID NO: 484 - DNA, 38817 bp, Homo sapiens
taacagatgataaatggagtttttctttattatatcatatttctaaatcaaggaagctgaaattatatacttaaatatactctggtcaaaatatacatgaaccacaaatattaacttctacctaccaacaatttacagttatgttgtatgtggaatttcattcttgtcagaactcacaatggaaataaaatttctattatgggtgagaagatgagggaaagaattaaggggaaaaaatttggacagcacacacttttctttcattccaaaggtgccagtcagaacacagatccatggagttccacatctagccccaggctaccaagcattaattcaatgtaaatggtgtcactacaacatcaaaaagagcagtgctaggcagaggattttgtataaaatcatctaaaactctgaaaaactacaaaagcatctcaagaaaaaaattaggtaaaagcaatggagtttatttcagtgaaattattttaaattagatatgatatattaagctcccatatgccccaacctggtagaaaagttcctctcagtgagaaatcatttattttaatggcaaaatttttacatatcagtaaaatctgttatacttaaaactatgtatacagtacatttctggcaaaaaaccttatacatctttcagttgtcaagacaaagtaaaaatatggttgcataaagtcacaaaaaatataaactgctgaaaagataataaaaaaagattaaaaatcatttgcattgcctcccttacctcttcaatattagtaacaatttgcaaacaacaaaaaaattgtgaaaattctgttgcaaccttgacacacttaaccaaaggttgtcatttcaaatatcctagcttaaaaaagaatttactgcaattgtctgtgcatttatcatactatttatagaagtgcaatatttaaatattttcaaaataaaacacagtaactaaaatgaatcacaataacttataagagaagcaaagtttacaaaattaacaatttttaaaaggtcctatttaattggttcctccttttcttcccccctccccacaacagcgtatatagcgccattacttaattccatatacaaatttgtaactttaaaaatacagtcttctgttaacatcaggaacattatgctgcacttagagaccctaagtaaaattagaatcccctaaagagagggccacataaaaagtaaatacagttttgaactcatatttaaatggaacttctattactttgtacagctttcaaattagaagttgaatagaacaagccctggacaaaaagcagcaagatttttcttttgaattcagtgcatgattctagaagtgcttgagtcaaatctactagagtcaccatttatgcaagctatcatgacatttgagttcattatcatctggttacataagtgctcactgtatttgccaaaaataatcctaaaatatgattcttaaaatagaaaaaatatagctctgttgcaatgggaaaatgattaatacaaaaaaatcaatttcttaaagttaacataaggcaaatataaatgatacaatattatcatacacgataccaattttatctgaggtgactacatcttcatttacatctattgtgtgatgcaattaagaatgacaaaaaaaaatatcagtgtaaatcagaaatcttaggaaaatccagtatctttaaaaagtaatttaagcccaaaacaaatgtgaccacttattaatagaattgatttgttccatattttatcaaaataataataatgttatatccaactaaagagttataaccaagtgtcatatgtaaactttaattggatcctagtttgaaataatcagctataaagaaatttggagttaacttcagaaatttaaatatggcttgattagatgatattggggaattattacttttacaatggtattacggatttttaggagaatgtcattatctgtaggagatacttgaagtattttcacggtgataagtatgtctgtaacatccaaatggttcagggggaaaaaagcatatatacatacacaaacaaacacatatatgcatatatatgcataactagctgtatctatacatatataggtatagagaaaacaaatgacaaaacattaacaactgctgaatctaaatggtagatatacatgtgcttaccaaacagtttttcaatttttctgtttttaaaaatgttcataataaaatttgggggggaagtcatatcagagcacttaaagtttgtaagagatagttttctatgcactgaatcaatttaaaagatacataatcaaataagtagcaatgtgtgcatatactcaataatgactgacatgatgggccagaggaatttgtgaaattggcaaaaataatatgatttatctacagtatatgcaactcagctcttgtaacaaaaagaacattttgtgtacagaatatcgtgggaatattttaagactaaaattagtgctagagtatctgaatatataaattctgtgtttttggacttgtaaagctaaaatgaaatttaaattaggtctgatatctgatatgacttaccatacactacagaattttaaaagggggatatggaggccgggtgcggtggctcacgcctgtaatcccaccactttgggaagctgaggtggtggatcacgcggtcaggagttcgagaccagcctgggcaacatagtgaaaccccgtctacactaaaaatacgaaaaattagccgggtgtggtggcacacgcctgtagttccagctactcaggaagctgaggcgggagaatcacttgaacccgggaggtggaggttgcagtgagccgagaccacaccattgcactccagcctgggtgacaaagtgacactgtctcaaaaaaacaaagagggagggatatggaagaagttatccagactgttactactgctggaagatactagctatttatgaagttaaggagcccagaaaacaaaatcacctataaaggtcttgggaattctaggcaaatatttattgaataaatttataacacgtaatatataacacgtaataatatatgaaggcctttatgtaaattaatatttcaaagccctgtgtacactaaatataaaatagccaaaaatcaagtaagcctgagacctataattcactgtgtatattatgctatatacatactgcacaatgaacaacaaaatgatcttaattcatttctgcatattaggcttttaactataaatcatgttccaatccctgtgcaaattgcattccaaaacgccagccctcggttataattatgtataacttgattacaaatggaagcatttggctgtgacttattatgcatgcttattgctgcaaaagaaataagcaaagttttctgtttattgtgcaagaattttaattagatttgcacacatctcaaaaaattctattgtgtgacttccaggtcttggagttaggtcaacaggagaagagtcaagtgaggtcacagatgaggtaagagaaacttctgaggattttccttgagcctcagcatctgaatcactcctttggcaagatcgatagttgctaactgatcccgatctctgtggagtagcagtccctgatttggcttctgtaatttcatctgggtaaaaagaatttcaatttattatagtctatgaccttctcccaaaaatttttgtaacagtattgaatttgcttctttaagtggggctgctggccagctatcaagagcacgcttattctaaataccttctaaaacagtcaatgagcctgtattaaactattcatcttttttacatatagtatgtattctcaagatagctaaccaaagttgggtacagtatagctactcatcagttgcaatccaaggttaagagcccagtaaaccaacaatctagggattaataaatattattctatagcaataaaaagtaatccctctatattaaaatcatagaatcgatgcacttaaaatttggagggtatactggaaaccatctcatccagcccctcactttattgataagaaaacaaacccagagaaatgacttgcccaaggtaacaaatgaacagaaaggtaagtctagaacccaactctcctaagtctcagctcagtgctttttactttccactttcccttcatatttcatttagtatttcataaaagagcaacaattccaatgaataaaaatcgaagaaaaactaaggttgggaacacagtacaaaaacaaaatgggcattcaattggtataccccagtactagtaaatctaaggttgcaaatttgatccaaatacaagaaaaataaaactcattccgtatttcagactgcattagtatatgttagcagatacgtactatatggacctaaagataaccagacaaactggtttggccaacatatcatggctcaaacctgtgtctttctgctactatgtgtgtactatctttgagtttataaagaagaaaaaaattcaaacgtgaacctcatctaataattctatgcaaccttccataagcaaaggtgatactatatatatatattttaatattttgtaaagacagagtctcagtatgttgctaaggctggtctcaaattcctgggctcaagccatcctcccacctcagcctcccaaagtgctgggctgtttacaggcataagccaccacacctgcactcaacagcgtagcttaatgcaattgaattggccaatgaagaattgccataacttcattcttaactgaaaacttatttaataataaataaaagcttacagaagagtcaatatttatttctaaataaaacattgtctcttatcaaaatgaactacaccaaaaaaacaaatgcagcagaaaactatcaccttaggatcagactacacctggctttaaggattttacaagatgataatcttaaaaggacaatatgctataagattacaagaaaaataagattcataaatgttaatattgcaaaggcacaagaaatcacattttttattcctttgcagttgaattactaggaacaagtcaagaagcctcaaaagaatcaaggcgtaaaataccaagttagtaacaaggtctaatctatgttgttttgtgtgatgtacataccatcaatactacggaaatccagtagataagttctactatccacttggtataactgtagactcattttggagtaagtgcttgtcacaggattcttccttcgtacacgcaaataatatgggtttacaacctagcacatggtataacaaaaaccaagtcaaaagtaattcttctataaaacattttatagactatgggtttgccaaatatgctaataatcaaaatgttatttctttcttaccttccattcataatccaattgtttgattgctctacatacttctgccataatatcatttggtcgactttgacttctaattcctaaatgccattttgctttccttacaccttggtgtttggatttctgtggatttaattcatcaagggtatggcgtgcccttggtgtttcagcaaccaagaatggtactctttcaggatggggccgagtcaggtgatgatcatcaagaaaagaatcaggtgggcttgtcgccaaatagaaatctttggcttcattcattattctcctgttatctattatgagatggtaggcaactgccaaaggatcctggtgatttctgttgtaaagacagctgagaacttcctcttctgagcactcaaacttttcacatacttcttttaaggcttcatcatcaatcatggttgaactatatgatggatcctcaggaaagagatattttggaaggtcctgtttaaaccattcatgttccctgagagaaaaatggcaggatcaggagaaggactttgaatagagctgagactgaaagtaacagtttagggaatttagaatatgacttaatttatatttatattcatactgtattattgtcactttttgcactgaaattttcctcttctagctcgcacttcattgtgtatgttgagggaaatgctccaatttccctccagttttaagagggagaatgtattgacacagcaatggggggaaaaaagttatgggacaaatgacagcgacaaacaatgaaaagaacagcttatttccagcttagaaagagaacatattaggtagcttcattataatactcttttgatataatgttaagtgaagataatgtaacaacaagaaaaatagtagacaactactgagtacttactatatgctaagttttatgctaaacacttcatatacactatctcccctcatcatcgaaacaattatatgaagataatatctctttgttttaaatgaaggaattgaggttaaaaaaaaaatcaaggaacatgctcaaggtcacaaagacagtaagtgacagaaccaggattatgacccagttctgtgtgactggaaaggccatgccctgaatgatttcctattctaattccctaacttcgtatatttaagaatatgtttgacctgaactatgtcactttgctaaaactaaataaaatccagagacgaaaaaaaaaacaagaaaagaacaatggttatcttctgggtcatgggattaaagataattttttattctcttctctattgttggtgtttttctaagttttttcaattgtcatgtattatattttaattggaagaaaataggtaaaatacaaacaaaaacatttcttacctagatatcttaaaatataaattttagagaatgatttgtcctttccctttggtgataaaatcatgccgtgccattcatggtctcttttttagctagtctaaaacgtgtagtaagtggaaagtaatcaagcttcaagttccacatataatctttccttcttcttcattatactaatgctttcatatttactattcctagatccatatctgatttctttcttccttctcagataaatgtgcagtctagccattagaagaccaaaaggaccaaaatttccacaggggggaaaaaaaagaaacaaggcttgcaataaaattgtttaagtcttcatcagaaatggctcactctaatttgagaagaaaatttgtcatcgtcatttttgtctaatttaaactattaggttgaaccagatgaaactggttatactgacttttacctacaaaacaggaattttgcatgtaattcaatgtatactaccaggaaaaacatgtcaattaaatctcattccttgggattaaaaaaagaaaaaaaatacaataattcatgagataagaaataaaatagccacccacaaatttactactgaaaagtattaatcctaacgccaggcatactggctcacacctgtaatcccaacactgggagggaaaggcacaaggatcacttgaggccaggagttcaagaccagcctgggcaaaaatagcaagacctgtcactacaaacaaaaacaaaaagcaaaacaataacaacaaaaaacagccaggcatgatggtggatgcctgtagtctcaactactagggaggctaaagtgggaggatcacttgacccaggagttactggctacagtgagctatgatcacaccactgcactccaggctgggtgacagagcaaaaccttgtctcaaaaaaaataaataaataaaaataaaagatatacatatatatggggcctcgctatgttacccaggctggtctcaaactcctgagctcacatgatcctctttcctcagcttcccaaagtgctggaattacaggtgtgagccacagcaccaatctttcattagcttttttgttaatttaaaaagtaatatgatgttcactgtaaaaatttcaaaacaaagatgtgtaagtaaaaagtgaaagccctccctcttacgaatcttacttccctaaggtaaccagtttactatgtatttctaataacaaaataaaataaatgtgtctatacactctatttttttcacataaaaacaggattacactgtatattctgttctgcaactttttttttttcacataacttttatcatggatactatcagatctgataacttccaaactgctttattacctgatatctttgattgtggccctcttcatgggatccacctgcagcatatgtttcaaaaggctaatcacagaaggatttaaatattgaggggtatagaagatcccatcacatatcttcttaaaaagagttggcacatggtcatcatcaaatggaagggttccacataataaagcatagagaataaccccactgctccatatatctacctctgggcctgcatacaatctgtaacaggaaataacaattggattaaagaatcattttaacctaagattcagttcatcaaaaacttcaaatatggatatttcataaagaattcttaagcagaatatggtttttatagccactactacatgttacaacgttaattccatcagtattatctttgaaaacaaaagtcaagaagtttgtaaattacacaccatggctaaaattctgttctactatttactatggccctgatgggatctgacaatagggccaaatcttgaacaaacatatcactattcaatttaaaaccattggtttttgttacagaggagagattaagtgatatttcatcaactgagaatgttctttagtaatggactctgagcccacaatcccaataacacaagaccccttacaccaaggtgaaaggatcctgaggctgtgaaagaaagccaggcaaattggttcacagagtttttaaatcccgtttgcagtgcattgtagtcaagtgccttaactagctgcagactagttagatcacccattcaaagcctggattcaggaaaaggatttctttaaatttatgtactgctgaactgatcgataaatattattttgaaagtaaaagttctcatacaccaagagcttgaagaaagactttatccaaactagaaaaattaaatttcagtaatagcccattgcatatatgcacagttataacatttctttttatttatttaaataacaactttccacagtctccatgtcctgaattgttttattcctaaaagaattaagatagacaacaccatttttttaaaaattttttaaataatttttgacattaagttaatatttaaaaaaaagatgaaacttgacaaatctaaaattaggtactcctgccttactcacagccatatttttacacaaatctcatttctttgagcagtctaggccaacaagcttataaaaatagaaaatactacagtatttctgcattgagttaatcaagatgcaaaacattcacacaaataagcatggtttgggtgaaaagttattaaaagttcattataaatctagcaaacttcagcttctgttttcaatttcagtagtatagtgaaggacaaagagttattcttaaaaatattaaattctcctgttttccaaactattcaaaaagcgacactgtacaaatatcttcatgttctcaatgctggtagttagtaaattgagaggttaaaattcttataatattgcagtctctaaaaggtttaaagaacaaagattcaacataaatgaagtctaaagattacttcagcccagttccccaagacattttatcatgaaacataaaggtactacaaaatgccatctatgtaaaaaattaaagctacacattacatgtttaatttttcctctaagtaaatagtaatccttttctaactactagatatttctgtattattcaagtttccagtgtcttacctactttttaaacaccctagttttaaactttccatttcttccacctgggaaaaaaattaatgtactctcttctaacaactttaatataatgttgacttgtagtccttaaccctcattcacatataaatgtggttaagaataagccttatctttctttcctttcattagaattaaatatgacactatagactaacaaaatctaggagaaaaagacaatttcaaatgtattgagggaggcagggtatcaaatactaccttcctgaaattacttctggtgcagcatagttgggtgagccacaacttgttcttaaaaattcaccatctgacatcatgtttgaaagacctgaaagtgcacaaaatcagctactcaaaagatttcccaaagacaaaaattaaaatcccattaaacaataaaattgagtttgcattaaaatgataaatcatcattttgttatttgcttcaacaaaatcctatggtctattgtagccaaatattctgccattatgccctaaaatgtgtaatctatttcaacatttaaagttagtgcactgttagagtttaatacaaatatattaagctgttggttattttgcttattagaaaaaacttgccatgtttaagttttattaatacagaaatcactagggaaaataatctataacagatgaatagaaggattaaaattcaaagttcctattaagcctgttctgattctttaaaaaaaaaaaaaaaaaaaaaaacagtaattttgaatttcaaagttccctcacagttttactccaaaaagaaactgttgctccctcaaaaatgcaccctataaaaataatcaactgaggaataagaaattcaaataatttagccaattactattttaaaaaaaaacaaaacaccaaaacaaccagctcaggtttggttggcattttccagttaatctctgaacatttaaatagatatagttatagatatagatacatagatgtagtcaaaactgaggaaaatttttataagaatgttctctgggccagacatggtggctcacgcctgtaatcccagcactttgggaggccaagacaggcggatcacttcagctcaggagttcgagtccggcctggccaacatagtgattccccatctccaccaaaaattaaaaaaaacatagctgcatgtggtggcccacatctgtggtcccagctacttgggaggccaaggtgggagaattacttgagcctggaaggcagaggttgcagtgagccgagatcgtaccactccagcctgggtgacagagtgaaactctgtctcaaaacaaaaaacaaacaaaaaaaagttatctgatttgaactaaaaccaacctaaagaaaagaagagattcctttttctcttaggtttagtaaggtcaatggcaatttatataggaaatacagaaaaaataaattctttttttttttttttttttttgagaccgtgtctcactccgtcgcccaggccggacaggcgatctcaactcactacaacctccacctcctgggttccagcaattctcctgcctcagcctccagggtagtggggactataggcacgcaccaccatgcccagctaattttgtatttttagtagagatgggttttcaccatgttggccaggctgggctcgaactcctgacctcaggtgatccgcccgcctcggcctcccaaaatgctgggattacaggtataagccaccacgcccagccaaaataaattcatttttaacaatcaaaatgttctttaaacaaattataatttactatcatttaaaacatttttaaatttttaaataaatttttttaattaaaaaattgttttaaataattttaaataattaaattcacatagttcacttctggtttttaaggttttaaataattccatcccactcactttccttcttctccatacttgattcttttgaacatactggaaataaagctgctaccttctctttcacaaataatactcttttcaaatagtctctctaatactaccaacttaagttgtttaaaatttaattttaaagatatttaaagagccaggtgcagtggtgcacacctgtaatcccaatactttgggaagctgtggtaggaagatcacttgaggccaggagttcaagagcagcctggacaacatagtgagaacttgtctctacaaaaagacaaaacagcctggcatggtagtgcacgcctgcagtcccagctactcaggaggctgaggcaggagggtcacctggcccagtagtttggggatgcagtgagctatgatcacgtcgctgccctccagcctgggcgacaaagcgaaaccctgcctctataaaataatagtaataaagacatttaaagctaagaaaagatgatttcttagcttttcttctttttgtatcttcatagacaaaacagaatactttgatatactcagtctattactttatgtaatcttttacagttatctgaagaattctaggtaggttcattgaaactataagaacattagaaatgaacgttaagaaactataaaattatccttaccaaaatcagctatctttgcattcatgtgtgcatcaagcaggacattttcaggtttcaaatctctatggaccaccatatgcctgtgacaataatccacaccagaaaggatctgttggaacagacgccgactttctttttcatccagctaagaaaagttagagaggctttttaaaggtgtgtctttcaaagtaaattgtcctatctataattctccaacctataaaattgtcaaaatacatgaaaatcttcccaatgaacttcacttatgagatacttttgacatgaggaggagatacctgcagcacaaaacagaaatgctaagatggtcttggaacccaaatcagtaactcaagtttctaatattatcatttgcatatgactacattgtaacagcttgccttcctctatatctcatgagttatttcaaataatttcaatatctacttgaaatttggcatatttccttttataagcggcaaatgtttactctttcattcttttaacaaattactgaataccttcaacgtgctacacattgctttagacactcattacacagcaatgaataaaacaaaggctaatctagttgatgaaaatagactaataaatatagtcagaaggagtgatactgttttgaagaaaaataaagcaaaatataggtgcagtgagtgatagtggggtgagggacactattttagaccatgaggaagtaatatttaagcactattcataaaccagcaagcaactatgttgctatatgtcctaaaatagaagacattttaacaacaaacaccttaattcatttaataaaatatcatagcattttatctttaatatgcttgctaaaaaaaaaatcttacatagcaactaccttttcatttttgttttttgtgtttttttgggggggcggggttttaaatttatctatattttgagatccagtctcgttctgtcatccaggctggagtgcagtgatgccatcacggctcactgcagcctcggcttccctggggtcccgcaatcctcccaccccagcctcctaagtagttgggaccacaggcacatgccaccacgcccactaatttttgtatttctgatagagacaggactttgccatgttgcccaggctggtctcgaactcctgagctcaggcaatctaccgcttcagcatcccaaagtgctgagattacagacatgtgccactgcatgcagcctgaagtattttttttaaacttctctatgtatccatatattattaccacttttttcaacataagtgacagccattacttggacatgcctgctcccaagaagtcatatttaataaataagctattaatcctctaggcgaaggactccaatatgcaattctctaacacaggtcacaaattagcattctaaaaccagacttacaccttaaagggcatggataatatgggagaaaatacaaatcagtaatttattttgaaacaagaaactattataagataccattcctctagaaaaatactaatcctttagcattctaatacttttatttctagatttgtaggttcatggggaaaaaaaagagtatctgttcaaatatgaaaaaataggagaaaacttgattaaacaaaatataaaaagtaaaatagacaggctacaaaaatgaaaattatactgtattagtaacaagtacaattacaaaggatggagaaagggatgtctataaaggaaggttagaaaagtcaaaatacatttccaattaaatgtaacagattaaatcttttgtctccaactcttgaaacatcactaaaatgacatcagcaataaaacaggcatataaagacaaaaagaacaaaagagacagcagtaatcaagaggagtcaccaaggatgacaatagataaacagtaataaagactaagcctacaagagaaagctaaaacctaagcctataggggtagaaaccagtaaaaaataaacatctgcatacaaagcctgggaagccttagaaattggaaacacagggaactgctcaaggtagaagtgagagatgagctgaaaacaggacaagtgcttgaagtaagaagcttttaaactcacccatattggggaataagacctataatttactctagtaaggctgaaccagctctgctctcaaggacaccaaggcagggataaggcatcctaaggaaaacatgggggctaagacaaagtcaacatactaactagtgagacttgcatctcttttctccactcagctcctggagcactggcagctaagctaaggcctttaaggaaatgggaaggtttcttctggagcaaatatctgatccaagaaaacatatttgttattattagcatttggtatacagtaataaaacagacaagtccctacctattcaagctatgagaaaacccagcaatcagtaagtcctacccacatgagcctggcatttaataccctattcttaaatatttagtggacagccaagaatcaccaaatatctgaagaagggccatgcatcaaagacaaaaatgaataaaatgaatgcagagagcacagaaggtacagaacaagacggaacagaggaagactttttttaaaatgccatcctcagactaggttattatatctgtgaggcaaataacagcagactaaaaaaatgaaaatttcagaaaataagaaacttttgaaatagaaaatacgggtgctgaaattttaatattcaactggtaaaactgaagaaatacccacaaggtaaaaccaagaaataaacaacaacagaaaagataagaaaaatatatatcaattgtgcctgtttcccatttctccaggcagaattttttttttttttttttttttggtaaggagaagcaggagtaaaggggagtacctgaaatagaaatgaatcatgttaagaaatagtaaaatcaaaattaacttggttaataagtttgattttgataaaagtaaatagacatgctatatagaacaaatgaatgagtaatgtaaataacttaaaattgagagaaaagctctcttttcagggctagctacagctctcccacaaaggggcttttgcataccacataacctgggtatgagaaaaagtatgggcagagggcagtgttgagtttttgtatctgtaacttaaggtagtgttcaaaatgtcctacaaagttccttccagctgtaaattctttatatctaattcctacctccttcgtggagcctgtttttactactccaggtacatcagatttctgaaaccaaaaaatgaatgcaatttaaatgtggctagaattgactagcaaggcctagatctttaagtaataataatatattttgtaacgattaattacattaagatacatattcaaagtatttgtataccctggaagcataagtctgaggattatgagttctgggggctcaagccaattccgtcattaataaatcacgttactgtgagcaatcatataagccgcgaggctcagtatccacatctgtataaacaggctaaggagataatctttaagatcctttctagttctacatagtttatgattctaaacaaatatatgactaagggaactggttattaaatagacctcttaaaattggttgctgacattttgatgctagtaaaggataaaggggagttacaaaatacatacagaattaaagcagaacagcttacccttccattcttacagatataatcaaatagctctcctcctgagacatattccatcaccatgaaaatatcagatggtgtactgatgacctggtacctggtgagagaaaacattgtctacaaatattaaaacacatatattcattcattcaataaatatttactaagcacctatagtataccaggtactaggctaggagctagaaaaactgcaggaaacaaaaattctctgctctcatggagttcatgttccaggaaccaggaaacagacactaaataaataagcaatatctcaggtggtggaacatgctatgaagaaaaataaagcaaatgaaggggaatctttgtatacagagtgctaaaggaaagcctctaataaagtaacatttgagctgagcctaaaagaagaatgggaacaaattatgtaattatctaggaggaaagcgaaactgggagagggaatagcaactgcaaaggtccccaagtagaagcctgcttggcatgttcgaggaatattagagagaaataggatgtagagtcaaaggtgttaactgcaggccagaagacacagaattttacaagccatgataaggctttggcttttactccaaggaagatgaaaagctatcgtacgttttaagcagtcatgtgatctggcatattaaaagtaaaactatggcagcaatgtgaagaattaactgtcaacagtaaaggtagccacaggaggttacttcaggatttcatgagacagatggtggctgagaccaggttgacagcaataaaggaactgagaagcaatcaaatcctagcttgattgtgaaggaagaaatgaaatgcatggtagaaagtgaaagaaacagggaagttaaaaatggttcctaagttttagccctgggtcattggctgttagccaagatggtgaaaactgtgggaagagcaggtttgggagagtaataaagagttcattttgggccgggttgagttttaaatgtcttgcgaacatccaaatggaaatgtaaagtcagcagtgagcaaataagtctggtgtaagaagagatcttaaagcaagagatgtacatttaggggtggtcagcatatggatggtatttaaaacctagcactcaacaaatgagaagaggtaagagtgaaacaagtttgagtcagccagttcaggagaaaaacctaagcatctttaagttattgcctgcataacaaagcagaagctgagcaggaaatagttatttgtagactctataactggcaactgtaaaacaacagtaagattactgcccttttgaaaccttggattcctgaaattttgttatctatatgttcaggtataagcaggatggggaaaaaccctttctactaccgcattctcactagtgaggctaactgacatcatgtgggcatttggaggtcaagagtttttactagcagatcactgttggttttacagcaatggggcaccaaacattaccagaagagcatctttccaggagacaggaaagaatgagaagataacagctgataagcacaagggcaaaacatgaacacaggcttaaatgaccatcaatggggttagaaaaatacatgaatgggaagaaacttttatttttttttgggacagagtttcgcttttgttgcccaagctggagtgcaatggcacgatctcagctcactgcaacctccgcctcccaggttcaagccattctcctgccttagcctcccgagtagctggtattacaggcgcccaccaccatgcccagctaatttttgtatttttactggagacagggtttcaccatgttggccaggctggtctcgaactcctgacctcaggtgatccgcctgcctcagcctcccaaagtactggaattacaggtgtgagccaccgcacacagcctaggaagaaacttttcaaaacccttaggaaacaaaaagaagtgtcagtcatttttctcacttgtcacattaagtaggttaacaaaaaagatgaaaagatgactggactatatttaatataaacagagcttacagtttaattatatgaggatgcctgaaaagcttgaggttctgaatttctctgcggatttttcctaccacatcaaggctccgaatcttctgtcgattgagtatcttcacagctactttatgcccagtcaattcatgtttgccaactgtaaaagaagtaatttaataaattagtactaagtatgattaataatatatttacacatattctggcccggtgcagtggctcatgcctgtaatcccagcactttgggaggccgaggcgagtagatcacttgaggtcaggagttcgaaaccaatctggccaacatggcaaaaccccatctctactaaaaaatacaaaaattaatggccgggagcggtggctcatgcctgtaatcccagcactttgggaggccgaggcgggcagatcacctgagatcaggagttcgagaccagcccggctaacatggtgaaaccccgtttctactaaaaatacaaaaaattggcgaggcgtgctggtacacagctgtaatcccagctactcgggaggctgaggcaggagaatcgcttgaacccaggaggcggaggttgcagtgagccgagatcacaccactgcactccagcttgggcaacaagagcaaaactctgtctcaaacaaacaaacaaatacaaaaattagctgggtgcagtggtggcacatgcctgtaatcccagctacttgggaggtgaagcaggagaatcacttgaacctgggaggcagaggttgcagtgagcccagattgcaccactgcactccagtctggggtgatgattgagactctgcctcaacaaaataaaaataataatatatttagacatattataagagtagtcatctagcatcctcagaaaatagctaagcaaatataagttattttctcttttgccagattcatcccaaatgttcagatgtttaagagtgattacataggagaatacataagaaattggtaacagtggtttcttccagaagagaaagctagaagactaaaggaagaggggaaggagacttttttgctgtataccttttcgtatttttaaattcttttaatttttcaccttttaacctatcatacacacagactaaaatttttcttttagtatcatttatatggatattaaaacatatagaaattggtgtaaccagcattatatagtcagatacagaacagttccatcatcccaaaagactctctcatgtcatagatacatttccccatccataacctcttatacctttgaaattctggttcatgtgcatgtggtttctagtttttttggtttctctgtgttttaaattttttttcctgttttttaatttttttttttttttttttttttttgagacagggtgtcactctatcacccagggtggagtgccgtgtcacaatcagagctcactgcagcgttaacctccccaggctcaggtgatcaggtgatcctcccatctcagcctcccaagtagctgggactacaggcaggccccaccacacccagataatttttttgtatttttctgtagaaatgatgttttaccatattgaccaggatggtctcaaactcctcagttcaagcaatccaccagcctcaacttcccaaagtgctaggattataggtgtgagccaccatgcccagcctctatttttttaaatgcagttaaaaataaagggaaaaaaaaaatcaagtcattttatctttccattttaaatgttatcactagacagtcggtggtgacagaatttgggtttaggacataatcccaaaagacacaatcccaaatgccataatcccaaatgttgaaatcccaaaagatcaaaatccctaaaatctaaaattccaaaaatcacaatcccaaaagaacaaaatccaaaaaattgaattctggaaaaataatttgtaaaaagttctctaaaagacacttatttccatttttaaaagatttatttgagaaacataaaaacacaacggaacagttcataggcccctttacacaataaaataggcactaataacatatttttgcaagcataaatactcaggtatactaacaaccattgcatgggtataataggaacagagaaaatgtattcatgaagaaatagattaaaaagcaaaatggataaacacgtatcactatggttggtaatcaggtgcacccagattcataactgcggtcatctgaaataccagacaacctgaatcttctgacaagatcgatcaaaaactgcaatgggtcactaccgtttgcacaaaaactgcaatagagtcacccaaagagccaagatcttgagaaattttatctttcacaaatacagatgaacaaaacggacatctcttcatttactgagcaagtttcaacatttttatgtacatgcacaatgcttacacattacgtcacattgtgataatgcactttcatggagtcaaatatgcaaaaaaaaagtgcataaaatgaattagaattctctaaaagcctttacagaatttatacctgcagtattagaaatgatgcaaagataaaatacatagcatagcaaattggcactatgtgtgaaagggcagaagtcatacctgattgaataatttggcaggggagctttcttatatttttcacctgcatattcacttctatgatcttcaaaacattcacttgtgtttagactagagcggttgtggtctaaatattttgtaagtatatgctgaccatttagaaatctggttattgcttggccattgcaattaagtgattttctgtcttcacaacaccaataataattagcttttaaacttttctctttcagcattaagtagcctggtatacttaatttatcacagcctttttgcaagggaacaatttcacaggtctcttccactgtgctgtaaggaatacagtaagaaggaatgatatttggctttctcaataccaaatccgtattagtcagcattctcgacagacataattctcgacagacagcattcttgagagacataaccaataagatatatatatacatagatatatgagagacgatttattaggggaattggctcatgcgattatagtggctgataagttccaggacaggtcattttcaagctggagaccctggcatgctggtagcttggctcagtccaaagacctcagaaccaagccaaaccaggtctcagtctgaggctgaaagcccaggacccagggggctgctggtgtatgtcctagagtccaaatgccaacaagcctggagttctgatgttcaattcagcagaagaaaagtccgttccagctctcagaaaggcaacaatttgttttctctgggcccccagcagatttaatggtggccaccgctattgagggcagatcttccccacctagtccactcagactcacatactaatctcctcacagacaaacccaaaataatgctttaacaagtttctaggtatttcttaatccagtcaagttgacacctaaaattaaatccatgaatccacccctcgtcaatttggcacccataaaccatctccttaaaccatacttaatttccaaataaatacaataaaaaggcaatcggttccacctaatatgatgcaagtaaaatgatgcaactatctttcatacaaccgaatgtgcactaatttctaccccaggtgttggctttcagcatttcaacatttgggattttaatctttcatgattctgattttcaggatttcagatgtgtgagatttttagaatttagggattctgatttttagagattttgatctttcagtatttcaacatttgggattatggcattagggatttggtcttttggggatatgatcaccagtagaatttagacagtcatgaggctaagtctccaaaaatttaacctttgtgcaccctttctcaggaacctactggagaatatatattccatcaaaatcaggaagaaacccaagaaagatggcatggaatccagcaaagaagggatccaatataggagaaaaactaagagaatctcaaaatggtgaagcaaagtcacagtaacatatggagaaggcctagaaggcaacaaatccagacaggaatgtgacagagaatccaagatagttatttctgagggattttacaaaggcactggaagatgtaagaaattaagctttaggtaaaaaaattaaacaaatgaaaaaaatgagataattcatgaatgccagtaaaattaaagttctgtaagaaataaaacatagtcatagatactgacttagcaaatagtatttacacagccacaattatgaaaaaaccaaatataggttttattaaaagtacgatataactatattaggaggatgggggtgtagtatgaaatgtataagagaaagaaggaaggcaaccctataatcacagctgaaatcaactgtggaaatgaagcacattctaatttctaataaggctttctccaatctccagtactaattagatgtgattaagagcagccaacttgactgttaaagcttgcttcaggaagtatcttttttcttagaacaagtatgttgaaacctaagcatggtgctaaacacatcctccaagaatctccaagctctggcttggcacagactttctcttgacagctgctcagctgaaacaggactgggaaatagccacaatactggataatactggtggactcaagacctggaaagaatactaagacagaatccaatttgggcctgaactcccaaaccatcacaaaccaaccaaactcctatgataccctgctcaactgaacttcaaccccaattaactttaagaaatgactggagcttatccaaaactctggacatatatcctgtcatttaataaggaactggaataggaattcaaagcattctctcaaattcattattttggcattatgtactgagcatctcctacatgccagttaatgctgctggggaaaacagtattgaccaaaagcaacctgggctatgggaccttcccggcctgtaatgatgacaaaaataacagtaaagtgagaaaaagcaaaaagtcttataatacaaaagaataaaacaaaaaaatgaatagacattaaactcatccatgaaatgcatgattgtattagcaaaatttattaactattttcagagtgataagaaaatataggaggtatgaaattagagcagagcaagaagaattttacaatacaattaaaatcatttagaaaacagtaggtagtagcaataataatgtgatgggaaattttatagaacacacaacaaaaaatgaggaggaaattagcaaaaataggagggaaggtggtaactacggaatagggaattgagtataatttaactcatgagtaatacggagcagaatattaatccacctgtaaataacagaagccccccaaccacccaaaagaaggcataataagcagaacaaaatccataaccaatcaagatataccataaaacttttttctaatacttgagcatttcatcaaattataaattaattgttttaaagtatggtggtataacttcttcccttttgaagtaatagaagaaatcacaaaagtatgatcgtatcacagtggcaggaatagaggcagtgccctgacagccatgccaagagatcattcaaattcataaacacacacacaaattacatgatcaggatcttttcttttttaatctgtagttttccttctaagaatttgatttaaaagttgatgaaaaaaatgtgcataaatatgttcattacagtgtattatgtaagaacaaaaggctgaccaatttcagagaacagtttaatacattgttattccaacctaacagactctcataggaaaactatagaaaatgttcttacaaacataaaaaaaaattatatatgcattttacattttttagctacacaaaaaaatcatataaaaatgttaatatgctaaaatgaaaagttattccactgtgatcctttttgaattttacttgctgctttgtattcttatcagttagaaaaaaaatttccaaggccgagtgcggtggctcaagcctgtaatcccagcactttggaggacgaggtgggtggatcacaaggtcaggagttcgagaccagtttggccaacatgctgaaaccccatctctactaaaaatacaaaaaaaattaaccaggcgtgttggcacgcacctgtaatcccagctacttaggaggctgaggcaggagaatcgcttgaacccgagaggcggaggttacagtgagcggagatcatgccactgcactccagcctgggcaacagagcgagactccatctcaaaaaaaaaaatttccaaaggggaaaaaaacaattggaagtagtattagcagattcaccttttttggaagtagagttgaatagggttgaacccctaattccaattgcacatgtgaaagcagtatgtatacaaagcatagattttatagtcgcacagacctcggttttattcctgtttgaaggtacttactagatgtttgacttgggcaagttaaagaaactacaaccttctatttactcatctttaaaataagaataccacatactccataagggtgactataacagatacatggaatagtgtttgtaaagcactttccacaatgcctggcatatagcaagtgattgataaataaatggtagcctttattatttagggttatttattttccactgctcccagacctgttcccccatctgtatctaatcagccctgaattatttgttttaatctctgaatagccagttttatctcagctctgattggtgatacctatccatgtagatgcaatagcattcctttatccaggtacataagtgctaaataaataatagctgtcattttaatgtatctagctcccattcccatatacttcaatccctccaacccgctccaccactcctaccccaccaccactaccaccaatcctcagatttctaccttccaaagttcaactcatttcctgactttggttaatgttcaacagattactatcagacatatatacacataacaccaatccttgacagtgatttcacctactacaggaacacttgtttggtcacagaagaacacagaggaaaaaagcagcttaatttgatgtgagttttaataaacaagggctctttttttaacaaaaacaattttttacaacataaatctagttcctttacaatacataattaaagtatacaacttactagttaatatttgcagcatactcactttgtacccaaacatactgacacactctcaccaacctggaagacttggcattattagcaacattttacaggaaactgaggcacagaaagatgaaataacttgcccaaagttacacagctaatgagtggaaaagccaaaacttcaacccaggtcagactcttaaagttatgctttttccgaacatggttaagtgaaatttgatttttttaaaaagataatcctcagaagacatgtaaaaatacacatccttttaataaaacataaatggaagttaaacatatcagagaaattcttaatgtatatacagttttgaaaagaatagactgaattccttgtagtaataagaattatccagaaatgcattcaatcatacaaattcattcattcaagaaatatttgagtaccagcacctactatgtgccaggcactgctactatgacctccttcctgtatcagaacatgaatccagtgtactgaaaacctgcctcatatcaatttcaatgtcttaggattccacagacattttattttattttatttattttttatttttgagacggagttttgctcttgttgcccaggctggagtgcaatggcatgatctcagctcactgcaacctccgcctcctgggttcaagcgattctcctacctcagcctcccaagtagctgggattacaggcacctaccacctcgcccggctaatttttgtatgtttagtagagatggggtttcaccatgttggtcaggctggtcttgaactcctgaccgcaggtgatccgccccccctcggcctcccaaagtgctgggattacaggcattaaccaaccacgcccagcccacagacattttactaatacattctatcaaaccaatttaaaagttactcaaaaactaagaaagaaagcataaaactaaaagtatacaaaatataaaaacaagtgtagtgaagtgaataacgtccccacaaaatctatgtcaacccagaatctctgattgttatcttatttggaaataggatcttttcagacgtgactagtgaaggatttgaagatgaaatcttactggatttagggtgagccctatatctaatgcctggtatccttacaagaagaggagagcacacacacacacacacagagagagagagagagagagagagagagagagagagagagcaagcgagcgcagccatttgaagacagaggcagagactggagttatgctatcacaaaccaaggaacatcaggagccacaagaaggtgaaagagggctgggcacggtggctcacgcctgtaatcccagcactttgggaggccgaggcggggagatcacctgaggtcaggagttcgagaccagcctggccaacatggcgaaactccatctctactaaaaatagaaaaattagccaggagtggtggaacacacctatagtcccagctacttgagagactgaggcaggagaatcacttgaacccaggaggcggaggttgcagtgagctgagatcatgccactgcactctattctgggtgacagagtgagactccgtctcaaaaaaaaaaaaaaaagcagcagcagctggaagaggcaaggaacagattctccactagagccttcagaagaaacatggccctgatggccctttgatttcaaatttctcacctccagtactggcaaagaataattttctgttgctgtaagtcattgagtctgtggcattgttacggcagccctagaaatggatatagttagtttatcagttgaaaagtggattttctaaagaagtaccaaacagtaatcatagagctgaggaatagtataactgaactgaaaaattcaataaaggggttcaaccacaggctacatcaagcagaagaaaagattagtaattagaagacaggccactggaaatcatacaatctgaagaagaaaaaaggataaagaatgaaaaacagtggtcaggcatggtggctcacgcctgtaatcccagcaccttgggaggccgaggcaggcagagcacttgaggttaggagttcaaaactggcctggccaacatggtgaaaccctgtctctactaaaaatacaaaaaaaaaaaaaaaaaaaaaaaaaagctgccagtggtggtgcacgcctgtaatcctagctacttgggaggctgagtggaaggatcacttgaacagagcaggcagaggttgcagtgagccaagatctcaccactgcactctggcctaggcaacaaagtgagactttgtctcaaacaaacaaaaagaaacagaaaaagaaatggtaaagaaacttcttcaagctgaataaagaagacactaatgagtgacaggaaaacatgaaaagtataaaactcactggaaaaagtaagtatactgtcaaccccaaaacacactaatactgtaatggtggtaagtaaatgaattatatatctagtataaaggttaaaagataaaactattaaaaatagttaaagctagccaggcgcggtggctcacacctgtaatcctagcactttgggaggccgaagcgggcatatcacctgaggttgggagtttgagaccagcctgaccaacatggagaaaccccgtctctactaaaaatacaaaattagccgggcgtggtggcgcatgcctgtaatcccagctactcacgaggctgaggcaggagaatagcttgaacccaggaggtggaggttggggtgagccaagatcacgccactgcactccagtcccggcaacaagagtgaaactccatctcaaaataataataataataataataataataaagctacaataatttgttaaagatacaaattattttttaaatgtatatcgtgacatcatgaacataaaacatggaagagggggagtaaaaatgtagaatgtgtgtatgtgatcaaagttaacttgttatcagcttatataccagttataagatgttttgtgtaagccacagggtaactacaaagcaaaagcctttgcttttgcaaaagataaaaagaaaaaatccaaagtggaccactacagaaagcaatcgagccacaaagggggaaagtaatagagaaagggacaaaggttctacagaaacactagaaaacaattaacaaaatggcactactaagtccttacctatcaataattacttccaatgtaaacagattaaattctccaaacaacaggcatagagtggctaaatggataaaaaacaagatccaactctgcgctgcctataaagagactcacttcaccataaaggacactcatagactgaaaatgaagggactgaaaaagatattccatacaaatgcaaacaaaaagagaacagagatagctatatttatttcagacaaaatagactttaggtccaaagagaacaaagctggaggcatcacactaccatgtttgaaaatatattacaaacctatagtaattaaaacagcacggcactgacataaaaacagacatgtccaccaatggaataggatggatagcccagaataaatgcatatatctataatcaatggatttttgacaaaggtgccaagactacacaatgtggaaaggacagtctcttcaataatgtcatttggaaaactggatagccacatacagaagaatggaaatggacccttatctcaccccttaacaagtatcaacttaaaatggattaaatttaggacctgaaattacaaatctactagaagaaaacttaggcgagaagctccatgacacaggtttgggcaatcatttcttgtatatgatcccctaatgcacaggcaacaaaagcaataataaacaaatgggatgacatcaaactaaaaagcttctgaacagcaaaaaacaaacaaacaggccagacgcgtaatcccaacactttggcaggccgaggcaggcggatcacaaggtcaggagttcgagaccagcctgaccaacatggtgaagccctatctctactaaaaatacaaaattagctgagcgtagtggtgcacacctgtagtcccagctactcatgaggctgaggcaaaagaatcgcttgaacccgggaggcggacgctgcagtgagccaagatcacgccattgcactccagcctgggtgacagagggagactgcatctcaaaaaaacaaacaaacaagcaaaaacaaatagagtgaagagacaacccaaagactgagaaaacgtatttacaaatcatgcatcagatatatagctaatatccggccaggcatggtggctcatgcctgtaatctcagcactttgggaggccgacgcgggtggatcacttgagcccaagaatacaagaccagtctaagcaacacagtgagaccttgtctctataaaacatacataaattagccaggcgtggtggtgtatgcctgtagtcccagctacttgggaggcagaggtgggaggatcgcttgagcccaggaggtcaaggctgcagtgagccatgatcatgccactgcactccagcctgggcaacagagtgagacactgtctcaaaaataaaaataaaaaaaaagacaaacaaatggccaacagatagatgaaagaatgctgaacatctctaatcataagagaaatgcaaattaaagccacaataaggtatcacctcacacctgttagactggctattatcaaaaaggtgaaagataagtgttagcaaggtcacagagaaatggaacacttatacactgctggtgaaactataaatacagccattttgtaaaacagtgtagaggttcctcacaaaactaaaaatagaattactatatgatccagcaatcccattactgagtatatatccaaaggaattgaaatcagtatgtcagaggtgtctgagactcacttatatttggaatctaaaaaagtcaaactcacagaagtagagagtagaatggtgattaccagtagctggggtaagtggggctggaggggaaaaggaagatattggtcaatggctacataaaattacagtcaggaggaacaggatcctggtgttgtattgcatagcatcatgattacagtaaatatattaatttttcaaaagagttaaaaaagggaactttaaatgttctcaccacaaagaaatgataaatatttgaggagatggatatactacttggcctgatttgatcagtgcagaatgtatacatgtatcaaaacatcacattgtgccccataaatatatacaattgttatttattaaagatagattttcttttttatttacttatggtaggaatggccttcattggttgcaataggaagcgaaagaggagacctgaaatcaaatgaaaaagcgtaagcatcctggggagaagcccactggatctcagttctgccctgctcaggaaagttcagtatccaggtgactgagaacagaaccggctggcaccaaagacatgattttgagggggccggagccctttccctttgcctccatacataacaggagcaggaccacacactcagtccctgacaagaaaaggagggtggattttctaaactatgatattcaccattaaaattaacaagttaacagaagtaatattttttgaaaacaggttttctaattgtactacacatgatcatgacttcttaaatggaacacatgtacatgaagactgggaaccaaacaaatgttaacttatgagtatcaactgctccttataccctcacacagtgacagcagtgggagttatttagcaggatagggctttttgctcccagcctatagtgttccagctcgtgtggttttccgctttttgaatttgtatcccagccttcatagtctatcaggagtcaactctttctttttttttttttttgttgttgttgttgttgttgagatggagcctcgctctgtcgccaggctggagtgcagtggcacaatctcggctcactgcaacctctgcctccggggttcaagcaattctcctgcctcagcctcccgagtagctgggacaacaggcgcatgccaccacacccagctgatttttgtatttttagtagagatggggtttcaccatgttggccaggatggtctcaatatcttgagctcgtgatctgcccgccttagcctcccaaaagtgctgggattacaggcgtgagccaccacacccggccttcagtagcataatactttttaaaatatggcatctaatagcttaggagacactcacattatcacatttgagcataaacctatgatggaggtattgtcttttacagataaagaaactgaggctctaagagattctgtaagttgtggaagtaaagctattgtgatcaagttgggacaggtcttccgactcccaagtcttttgacctatccactctccccaccatcactgtgcagtgagagggacaaagggcttggcatggtatcagaaactaaactgttttctcaaaaccaggctaaatattctccccagtgagtaaactcagttgtagccaaactaaatgctgttccatagtcaatcaatgaatgtagtaaatggactctgtcaggcatatgcactactaagggattcccccctttttcaaaattcaaactttattcttcagactgtcagtttttagaatagtgctaaggttttgcttttaaatgaaacggaagacagatattttggccacggaagacttgcacattactcagagcaaatattaccagcattcacaatgtccccctcacaagaatagcagattagtcaactaaatattagctaacaaccatgctattgctatctaaagggaactttgtctaactgcataacattgtaacaaatgctcttctaattagatatataatcctgaagggaaacaagatcatactttgaaacagaggattttaataggacagagaagcagcaaagatagaaatatctactaaagatattctagacacctaaccatttcattcccactttaaaattgaaagaataaaaacgtgttaaggaaatagcttaatcctggggaagggtgggctttaaaagctatagatcgtaatttaagaaagcaaacaaacatttcaagcacaccaagggcattccaaatacccatgagccaccatcagcttaagcaataaaacattacaaatacaactcaagccctgcatgactcctcccagattcccttatccttcatctgtcctcagaagtaaccactatcctgaatttggtgtttgtgtttcccacgtttaaatatttttacatgggtaggaatccataaaaaatatagtaacattatttttcatatttatttttacaaatgtcattgcatatattttgataacacaatacctgcactatacacacagttcaaaagtacaaaagcatctatggtgcaacacaatgtcctcctttacctagtcccctatactgagcaactaacgtaaccagtcttgtgtgtatctttaaagagacatactctatatataaaagcagtcacatttaagatacagatttgcccctgccttttatacataagtggtaggcatattgaacacactgttctactttttcctcttaaaaatacaccttggaaattgttctctaaaatatacaaagttcctccctttttcttccttaatgtttgcaaggtatttcactatatggataaaccataactattactattagaaaggttacttcgaaagttttgtattaatatttacaacaatatggcagcgaataacccattatttcatacacgagtacatctataaaataattcctagaagttgaattgttaggttaattttaataaatgctgtcactctctcatgtagaggtaggataccaatttatactctaccagcattgtatgagtggttctgtaggtttctaaaatttatataaataacagcaaactatacatattcttatacaacttgctttcgaggtctaaccttatatttttaagattcattcacactgatatatatagctctagttcatgtttataatttttacttaaaggaatttttaaataacttctactatgattcattcacaaagtacctatgtagctgaaattgcagttttacacagaaatacttacgaacttaggccaagcatggtggctcatgcctgtaatcccagcactgtgggaggctgaggtgggtggatcacctgaggtcaggagttcgagactaacctggccgacgtggtgaaaccccatctctactaaaaatacaaaaaaaaaatagctgggcgtagtggtgggcgcctataatcccagccacttgggaggctgaggctggagaatcgcttgaacccgggaggtggaagttgcagtgagctgagatcgcaccattgcactccagcctgggcgacaagagtggaactccatctcaaaaaaaaaaaaagaaaaagaaaaaaaagaaatacttgccaacttaatagtttatatgtataaataactcatttgccgaagatacacccagcctaccaaagagaccatcttctctagaaaaactaacaaagactgccattttaatgatattactctgctcatccatgctttttttgggcagagggaaggcccacaagggcacagaacctaacatcttgataactagaaggaaaaaaaaaagatgccttggaaacaataaagacaattcaagcataatcacaaaataaccctagttttctgtaaactttcctctcaaaatgctaccactaagtaaccaaacaaattttttggcctgtaacaggaaacaatcactccgaacttccagcctactctccccgcaaaattaaatttcctataagcatggaatatcatacttagactttttctgcatatcaatatcatatattttattagatccctcttcatgttaaatttaccaatatgtataagtaatttttaaagctttctttactccaaattgtctaaacatatggttaaccctattatttgcaagaattcttgcataattaaggctgttggtgtttaattaccaacatcaccacaatagtggccatttctgtgtgttcactgagtatccatgtccccctttctctctcctaacaacatccatttatgtgtaggtgtctaccctgtccccccacactatccaagtacttagaagatgtctcccagcccagcacggtggttcaggcctgtaatcccagcactttgggaggccgaggcgggtgggatcacctgaggtcaggagttcaagaccagcctggccaacatgatgaaaccccatctctactaaaaatacaaaaattagcaggacgtggtggcacacgtctgtaatcccagctactagggaagttgaggcagaagaatcacttgaacctgggaggcagaggttgcaatgagctgagattgcgccaatgcactccagcctgggtgacaagagcaaaactgtctccaaaaaaaaaaaaaagtgttccctgttcaccacatgcacactaaaatctatctactgctttttgattttttgatgatggccattcttgcaggagtgaggtggtatcacattgtggttctgatttgcatttccctgatcattagggatgctgagcattttttcatgtttgctggccatttgtatatcttcttttgagaactgtctattcatatccttagcccactttttgatgggactatttgttttttcttacttatttgtttgagttcattgtggattctggatattagtactttttcagatgtattgattaggaagattttctcccactgtgtgggttgtctgtttactctgctgttccttttcctgtgcaaaagctcttcaatttaattaggtcccatctatttatctttgtttttattgcatttgcttttgggttcttagtcattaaatccttgcctaagccaatgtctagaagggtttttccaatgttatcttctagaatttttatagtttcaggtcttaggtttaagtccttaatccatcttgagttgatttttatataaggttgagagatgagaatccagtttcattctcctacatgtggctggccaattatcccagcacaatttgttgaaaagggtgaacagggaacacttctacactgctggtgggaatgtaaactagcacagctgctatggaaaacagtgtagatattccttaaagaactaaaagtagaactaccatttgatccagcaatctcttctgaaaagaagtcattattcgaaaaagatacttgcacatgcatgtttatagcagcacaattcacaattgcaaaatcgtggaaccaatccaaatgcccatcactcaatgtatggataaagaaactgtggtgtatacatatatatacacacacacacacacacacacacacaaaatggaatactacacagccataaaaaggaatgaattaacagcatttgcagtgacttggataagagtggagactattattctaagtgaagtaactcaggaatggaaaaccaacacagtatgttctaatcactgatatgtgggagctaagctatgaggacgcaaaggcataagaatgatacagtggactatggggacttgagggggaagagtgggagaggggtgagggataaaagactacaaatatgatgcaatgtatactgctcaggtgatgggtgcaccaaaatctcacaaatcaccactaaagaatttactcatgcaaccaaataccatctgtaccccaataacttaaagaaaaatttaaaaaataaaacaaattttaaaaaaaagatgtctcccacccacccacctctgttgcacacacacatcaaagggtgggtcatactcctccaagggcaatgccatcccccttgctaatgcctgcttaggaatacaagcataagccaactggcacatggcattcctagccagagggactggatgagccaatgagactcataagagatatgctggccttccctgctggaaggacttatctgtggaaagagaaccacagataagttctttactaggcaaagctagattttctattacttgtggcaaaaagcatcccaactgttaacttaaaaaatgaacaggttaaagattctgatcaacatcaacaaatgtgatcatgaacaaatttaaccatatctatgaaacctatgatccttggactaatattggcctttgtacatttggagagtttgttgactttaacagaatatggtactccaagagaagttagtgtgggtggggaagtgaaggttaagaaacagcaaagtcactggagacattcgtgtcacagccatatcacagatcaaatccagaagatgaaaaatctcttcctgctttactacctgccatgccaaaaaccacttagcaaatacgaaaacagacctggccgggcacagtggctcacgcctgtaatcccagcactttgggaggctgaggtgggtagatcacctgaggtcaggagttcgagaccagccgggccaacatggtgaaaccccatctctactaaaaatatgaaattagccgggtgtggtggtgggcgcctgtaattccagctactcaggaggctgaggcaggagaactgcttgaacccaggaagcggaggttgcaatgagccaagatcacaccacacggcactccagcctgggcaacagagcaagaccccatctcgggaaaagaaaaaagaaaaaagaaaaaaaaatagacctgactttattcaagcattcaagtctatattaggggaatgatgaacaccctaatccaggcagaactctgggaagggatgggggcaaaaatgaacatttttttttttacaaacacttgtaaactaaaaagcagtttgtaattgctaacaagaaatatcatagccaaagataaagttaaaacttccatggcacagaaacatcttactggccttatatggacctgtcctaatagctgttattacccaattctggcatttgcttcttacttcctcctgacattgtccgccttgcagattttcataagaaggttcaggcagttgcttccctgtgggatatacaacaattttccaattctatgactcagaaaatggcaagagaaggaagcgttcttctcttctaaccctaaataaaatcagaaactgtttatttagctctggaagagtaaggctcagttgagttaccgtacagactttggcaaactttttttctttcaagtcaaatatttaccaagaacttagtatatgcaagtcagtctattatttatccaaagccaatgcatgaattatttttatcagttccaaacttcctttctctgcatcccttataacaaagtcaaatatgttaaagaaaaaaaaaatcatgccttacaaaacttgcaattaaacgtttttttgccagaattggtggactgtagagcaagtttatttccagaatagtgttttgaaagagtccacacttttcttttaatttcaatagctttaggggtacaagtggcttttggttacatagatgaactgcatagtggtgaagtctgggcttttagtgtacccgtcacccgaatgctgtacaatgcacccaatacacctttcttaaaacaaaagttcgaatgatgtgcacttaaagagtttattagaatacaaataacctttgaaaataagtggaaatgaactgtactaataaagtaataaatactatctggaggcaacatctgaactaacaacgaagtttcgcacggagaaactcctgttaattcggaaacactaaaggcacagtctcattcagaacgtaaaccatgcatcgcaaatactgaaccagtttatactcattaactgctccgaaggaaaccagtgatcctttccgacgacatggtctttaaaaaaaatgatgtcggctacccacaaagaaaccttacttctgcggaaacacatttcgcactcgggaaacagcaggggccggtaaatcgacagcctcctacagaggacggaaataccgacaacgccaaggaccgccaaggaagcgatgggctggccctgagccaagggagcacaacccgggcgcacaagatgccgcctccccggggatcgcgcccggcgccccctcccagcacccagagcgcgccgcgccgcccgcctgccccacctgggaaagtttgcaccttcgcatcccagcccctcgtacctaccagcccctcaggccgcggcgccgtcgccatggcgactggcccctaccccacccccacccccacccggcctgtgctggccgcgccgcagccccgcggcggctggggagagctcccgcaggatccgggacaggggctgcccagccctggaaagaagggacgcagcgggcgggggaggatgaagaggtgcggaaagcggaagtcgtgcggctcctcagctggggccaagcctagtcccgcggggttctcacccttcactttgccgaaggtgccgacccccagcgtgtcacccagaatgtagtggccgatcttcacccgcccgtcgtgtttctgcttctcggctgtcgccatctttctccaggaactgagtctgcgcatggcgct

SEQ ID NO: 485 - DNA, 38817 bp, Homo sapiens; identical to SEQ ID NO: 484

SEQ ID NO: 486 - DNA, 3881 bp, Homo sapiens
tttcattgtacaatatctttattaaagaaatgcattccagcaacactgtcagcatctttattaccaaagaaatacataactttaacagataatctctgtatcttagtttttgcctttgcaaaacaaatggagatatatcaactctcatacaattctaaaagcattgtgctgtgctgcctcacaggggtacgttcccagaggtttctctctctagagcaatccctaataggacaattgttcactctgaggcttctggcttcttatctctcctctcttggggagctgctgcttctctgtaggttgcttccctgtgacgcagggaccatagtttctgctctaataacaccttttccactctgacgtagctgagccatacactacattgccttagtcctgttcaccctttggtgattctgttccatttgccacctggcctcttcctcctcagtcacttttttctttttttgagacagtctcgctgtcactgaggctggagtgcagtggtgcaatctcagctcactgcagtctcaacttcctgggctcaggtgatcctcctgcctcagccttcggagtagctgggattacaggtgtgtgccactgcacctggctaatttttgtatttttagtggagacggggtttcgccatgttggccaggctggtctcaaactcctgacctcaggtgatctacccgcctcagagcctcccaaggcgtgtgggattacagatgtgagcctccgcacccggccgctcctcagtcaattctaaacaactgtcctcacttgaggaagctggcctttctcctgtactgttttaccagttgtctttttaaaaaataactttcctccaaataacttactaattttattcatataacactcctcaggagttcaaataattttaatcatttttaaggcaaagaaaatactttttacatttgctagatgtttatttgcagagctacataaatataaccttattagaatgggatttttcctactttgggtaactatcaaaagtctcacacacacacacaacccaaagaaaacatatccaagaacgtggtcagttttcagtttttatcattatttattattttattttttatatcccagccctcccatgtaagactggtcattttttagaatcctcagccatatcaaggatacagaaggggtctaggatagagaccaatgaagaaatttctttggagaattgttaagtgctcaattcagccttcttggacaaaggagttactaccttctactttgaaacccagtgaaaggaacttcaaggaagcccttcagagagctttgaaatgtgtttcgtacaaccatttagctggggagcccagagagggctgctgccatgcgatctccctgaaattgtttttttcaggccagggatgtgagaatgtttcctgaggaccagatgtgtgacactcaggagagagccggcataaaatagcccccagaggtaaagaaaacctcaggactgaggctggatactaagggttaggaaagaattacagacttttcttgagacagggtctttgtcatccaggctggagtgcagtggcacaatcaaggttcactgcagccttgacctcccaggctcaagcaatccttccacctcagctccctgagtagctgggactacaggcacataccaccatgcctggctaattttttgtatttttaatggagaagaggtttcaccaggttgcccaggctggtctcaaactcttgggctcaagccaatggcacctctgagcctcccaaagtgctgggatgacaagcatgaacctccgaacctggcagagtattttaaattgagatgggtccatcagatacaaggataactacccagcagggaacctccaaagaggtcatacaaatgcctgagacagaaaaagtcgatttaattatctgcggggcccagggattatgaagccagccagccaaggaagaactaccctatctcctcactcctcaccttttgtacctccagtctacactttaatcccactgagttaacttgcagctcacagctccagaaaagtataaggagaaagctgaaatcagaggaatcgtgccctccactgccagcttgcagtttaaagcacacccaagctataattaagattaccttctgacgattacataggactgcacgttttacctattgaaataaaactgttttcgcaactaatcatgatgaaaatactttttgttatctgtgagtaatctaaaaatacatgggtcaggtcaagtcttcatcctggggcaccagggtatactcccaccgtataaagacacaaacataaaagcaatgttttgatctgaatccaatccacacacgatgcttattctacatactcgtgtacatgagaaccatttttccattgcaacttttcttgtcaaaacatccttctacttacaaggaagattttgcttaagtccttcctttatccttttttttttttgagatggagtctcgctctgccgcccgccgttctctcagctcactgcaacctctgccccccaggctcaagcgattctctcgcctcagcctcctgagtagctgggattacaggtgtgcaccaccaggcctggccagtccttccattcttagttcttgaggttatgcagtgtctttgccctgtgcttctcttgtattatgatccaaactcctttgtttaaaaaaaaataaaacacctaaatataatccaaatgtgctaataaatgtgaaacagcctctttctctgaaacaagttcttcagtaaaataattctgtaatgtattgctttgcttttcttacatgaagttatgctattacaaaattaagtttcaattacaggcaaggttaaactctgcaagcaacccaaaactcaaaaagggctgaatgataagtcattcaggtaaagacaaaagaatggctccttatcattcaacttaaccaaccttctaaaggttcctccatccccactgtctattacgctcgtggtatccttgtcttacacacttatcactatctgcaattgtctattatgtcaccttccacaaacatacatacagtatatacatgattgaaatctgtcagggcagggtctttgttttgttttccacttaaaagtttctgggcctagatagcttttgacacatagtagtcactaaatagatacttgcttcatgaatgaagggcaccatttagtcaataaaagggaaccacagaataggtaaacttccaaaagtatctagtgttgtcttttaaactaaactccccattcctcactgcccaatctcgtgacctcttggcaaactggtttttctttgctgctctaacatgagagaggtttatgaaaagtaaagactagcctaaattttgccaaatccagaattttaaaatatatcttcattctctttggcctcagccacatgtgactgagtgcccccctcaaacaatccccttccttggtttgtgtgactccatccaattctagttcctgggctaattctgcaaccactggagtcagagggcagaaaacacatctggttttgctcccactgtatctctaacatggcttggcacacagtaggtgcaccatacataaatatgtcaacaaatgaacttctccctctctccacttctgtctccaatggacatctccccaaatcttactttgagactctaaattatctttttgtttttggagtctgtaaattcacaaatggtttccaccaatactaagtcaaggatagttactgaagttcatcgatgaactcaagccctcttgcttactctgacttctacatgcctatcaaatctcagtgttctcattttcatgcttaaattatacagaaatgggaagcttggaagttag

SEQ ID NO: 487 - DNA, 3958 bp, Homo sapiens
gggaggaagcccaagagagatttaatcagcagggtttctttataagtgaatgttctgaagctgagacctgaagggtaaattaggagttaaaatacaagatgagagtagcaattagctagcacattataaagccattccaggttacaagtaaaagtgatacccttccaaggccaggttaagaacctcagatgttattctaaacacagtggagaattataatttaaatagcatgacttggctacatcactattttatgtagctgttccagcaattcatgttcccttcaactgcccctgccctctcactcagcagtccagttgactttgtcccttcattttaaaaaaacaaaaaaaacccccaaccctgtcaataaaccacgaaaactaggaaggcacgacagcaagtttcagtgctttaacacagaaacacccaattaccaagttgagggctaaaaaaattcgaccaagtagtcccacatcattgcctttagtctacaaatctcagggattatacttgattttcctttatttcctgctcaatctttacttgcacccaagccctactttttctcaaacctatttacatattcttaagttgactcacacctagcaggcttttttcacttagctagccaccttacacacagcccacaagtcaggtgtgccaagtgagcattacagatactaggataagatcatcttttgaaaaacagaagccacctaaactcctacccatacgtttccagtggtactcccaagctctatgtgactaataatcatccccctagtcatgacagcatagcagatgaacatgttgctaaaggtaatttaaacatcatactctttcaaatttactcaaacatctaaaatacccacctatgccacatgagctgtgctattttaatctgctatattgtcttccagtgccctctgcttcaaggactcctggaattctgcttgtttctcattgcctttaaccgtgttacaaacccagtccaaaagtaaacattccaaaacagtcacttaacaagtaaatctgatatgaagctagcccagtccctaaacctacagtatttcactgatactacaagcctaattgattaaaaataccttaccaaaaccagatatgtattttttaaaaccagaacatttattgcatgactaatcgttgacattcttaagatgaactggatgctgcaacagctgccctcttgggtttaggtgttgttccttcacggaatccatgcctgcaggatgtcaaaaacaagaacaagttacttcagcaacatcgatgcatacattttaatttttgttaaacagatttcaatgcgcttatctcagttaaatgctgaaatcaatactgcattcatatgttcagacatttatttttacaacatcactgataagctgaaattcttcactttgcttaaagatacccattttcggatatagttaactgcaactgcaataaaggctcaaaaacttatttggctatactagtcattgggccagtatgtttgttcatatttggcaagagatcacagattatttgtgaaaatggttccctatactgagaatagatcccaactactttcactaagcaaggaaaaaacaattagcatgtttaatggcagacattttctaaaccaagagctttgcattttaacttatttaacatctgtatctactctaagaagtatctactctaagaaaggtcaactatcctacttttaaaagcctggcttcagttcaagctcttaactcctatattgtactaacagaccactcaacattaagcccacaaaaacgttatgaccctaaatgcaaagaaagttgcttcagcacatgaacacacctatgggtgtctacaaagccctgaactgtcttgctatctttaaaactggacactccggagactgagtgggtagaggctagggattctgcaaaatattcaattttgcactggacaatcccaccacaaagaattatccagcccaaagtatcaatagctgagaattgctgaaatagaacatagtaacggaaggagcaccagctttatagttaagtctgcatcattctgaatcttagctgagatcttagatgggttaatctcttagaaactactctttaatatgcaggttctctcagctaagtctacggcggagctgagattctgcatttataactctaaggccaagacttgagtaacaagagcccaaggcaacagcagcaaccagggcaattttctacagcactcttgcccacagccactatactaaaggttgaaccaagcctgactccagaccttattcactactgtcttgacaaattttgacaccaattaaacctaataaatatcaacactttgggaccctagttcaaacaatgctcctgttatttaatttatactactgtttagtgaaaaaactactaataaaatccaaactaactgatgtcaaggttacagcggcagaagataaaagctttcaacatctggcctgagcccaggagttccgagattatcctgggtaacatgacaatatcccattctctacaataaatacaaaaattagctgggcatgtggcagcgcacacctgtagtcccgggtactcgggcggctgagatgagattacctgaggctggggagactgaggctgcactgagccgtgatcgtgccactacactcaagcctgggcaacatagtgaaaccctgcctcaaaaacaacaataaataaaaagcttccaacatctcatccccagtaaccatcagggtactgttatctttttacaagtaaacacgagggtttcattcaagcccactggaccaattatgatcgaacatacaaactgtacctgaatctgcggtatacaatttttaggtgcctcattcgaccagttccggtggtatttcgtcttttagccttggcactccagttatctaaaacataagttcagaaaagatttcaaacggtgttctcccacacaccttgtaggtgttgttaacacacgagttttatgccacctcatcggcatacagatgtacgagttttaagataggcaccaaataaagttcaaacctatgcccccacttaagtgcaatacaaacaaaagctaacacagttggcctgaaaaatgttacttacactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcacattaaaggaataaatagttctgaaacctggcaacttctagatttactcgagttctccgggaaaccaattactgataaaatttaaaggcaatcgtaaagatcgaaactgcgggagaagcctctttccacgaatgccaagtcagagaccactacccgcatttcacgttacctaaaaccctccgcaagagttgcaatgttctgaaatgcaccttatctttacagactccggccagagagcatcaccaatgaattatttcattgttacacagagccaaacattcccaaactccttccctcggctcccaaccaaggctagagccgtgaaaggtctccaaaggttggaccgaggcaaaggacacaatgcggctctagcaccacaattacggcgggataggtcccccaggcaccagttagcagtcattcttctggctcttgagggccaccgcatgcctctttccagcccaccagttccccttatccggaatcttgccagccccccaagcacagcaaacagagaggcacaaaggacgaggatggaacgcgattcacaaacaccacagtcacaactcaccatctcgcttctgcggccgagaccagaaagaccggaagagaaggcacttccgctatatcacgctcagaagcttccgcccagggaagcacttcctgcggggcgc

SEQ ID NO: 488 - DNA, 80 bp, Homo sapiens
cgcttatctcagttaaatgctgaaatcaatactgcattcatatgttcagacatttatttttacaacatcactgataagct

SEQ ID NO: 489 - DNA, 14047 bp, Homo sapiens
attctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctgttaattttggtacagaaaaagggagaggcgacctgtcagcattttctcaagtgtttatttagtacttttccacagtcagctgccatttgcggcttaaggcatggtaagttgactttgtatactttttggggtgagaggaagggggcagactttctgaaaaagaaaacaaaatgaaagaaaattgttgccttttatttttgttagtctttttctggagataattttcattgaaatatgaaatagggaaaaactggaatttaaaaagtttctgaaatttaacatcttattggtctactgaatcgataatttgtttttcagactgtactcaaaacttgaagttgttttagtgctaacaaactgctcattattctggcagtaacatgctaaaatctcacagttggaaggaaaatactttaataataacacaatccagggtttgtttttcaagtagatgaattcgtggatatttacagtgccaagaccacaagctgtatctttcacttagtatagccgttttgaaaatacaaggaaaataatttttaacacatagatggcaaatcagtagtttcatttttttggtgataagaatgccagcagcagctgttttctggagcaattccagtgctaattcttaaatggttcaaagataactagtagtccatgaaaaagcaattcttccagttatttagcaattctgtaaattactactaggactaggtctagctctttttctaggaatctaaaaaaaaattcaaaattattttaagggatgttagagaggtagaggctcagataaaaaggtgaatgttagtgatacctaatttaggacaagatttatatgcttagaaatttttcttttattatttctaaagcacactattccaaatagagccatttgcttactgattagaaattatttgtgatcagatttcattagcaatgaccccaagagacgtgagtctgttgtgagtcacagtaagtccacaagtaaacactgttcatatgattcaaatttttcgttttattcacttaccctgtaaggttgctaggaaggactcaaactttaagcaagacagtggtgtgatctgatttttttttttagtggaaaaaagaaagttctgaaagttgacatgttgacatgcaagttatataggaggtgttaggtattcctgtcctccagtgaaataagaggtggctgggcgctgtggctcacacctgtaatcccagcactttgggaggccggggcagatggatcacctgaggtcaggagtttgagaccagcctgaccaacatagtgaaacactgtctctactaaaaatacaaaaattagctgggcatcatggcgcatgcctgtaatcccagctacttgggagactgaggcaggggaatcacctgaacccgggaggttgaggttgcagtgagcccagatcgtgccattgcactccagcctcggcaacaagagtgaaactctgtctcaaaaaataaataaataaataaaaggagagggatgaagctttgaggcctcaggaactctagctgttatacagcttctttttcttaattgggaaaaacaattcttttctttgcagaagttttaaaacatgagaatacagtacctcctcaatctatgggggcaagcagtaattcagaagatgctttttctcctggaataaaacagcctgaagcccctgagatcacagtgttcttcagtgagaaggaacacttggatttggaaacctctgagtttttcagggacaagaaaactagttatagggaaacagctttgtctgccaggaagaatgagaaggaatatgacacaccagaagtcacattatcatattcagttgagaaagttggatgtgaagttccagcaactattacatatataaaagatggacagagatatgaggagctagatgattctttatacttaggaaaagaggaatatctaggatctgttgacacccctgaagatgcagaagccactgtggaagaggaggtttatgatgacccagagcacgttggatatgatggtgaagaggacttcgagaattcagaaaccacagagttctctggtgaagaaccaagttatgagggatcagaaaccagcctttcattggaggaggaacaggagaaaagtatagaaggtatggaaatatcttgtatagttagttaggcaacaacttaataagttaataagcttgccatgacataatggggatgggggatgaaaaagggacagatgtcagcagaaaatcaactactaagaaattcctcgtgcctctctgacctggaatctcctcgaggtaggtgttgacttaaaggagctcccaggacctaggaaatgatggacagcataagcaaaagtaaatattgattgtcagtttgtaaatttctgtagttcgtataaggagttgccaatcattaatttcccattatacgtacgaggagttgctaatcattaatttcaggctaacctatttctcaggttaaaccactttagttattttagtgcctttgtgaccagagagatatggggattatgggtttgactatttaagtgaaaacagtcagtaaatggctaagatcccaaaatattgttacttggcttgatccagtccacataatgccatcttgatgagaattatatttgtatcttgaatctgaatatttctttatttaaaaaaaatttgtttttaaacagggtctcactcaggctggagtgcagtggcacaatcatgactcaccgcagcctctacctcccaggctcgggtgatcctcctacctcagcctcctgagtagctagcattacaggtgcctgccaccacgcctggctaattttgtattttgtaaagatgggattttgccatgttgctcaggctggtctcgaactcctgggctcaagtgatctgcccaccttggccacccaaaatcctgggattacaggtgtgagccactgcacctagccaaatctgaatatttcttaatgaaaattcaaaatatgagaagtgtttcattggagtgatattgcctgggaaaacagacatcactaagttctgagtagaggatgaaaatgtagctaccatctcacattaatttcaaatcttggggactcataatccacttatgggtaggaagagagtcatttcttcctcatcacaccttgtatcagtttgtgagggatgctgtaacaaaataccacaaaatcagtggcttaaacaataaacacagatttcttgtctcactcttttggaggctagaaatctgaaatcaaagtatcaaagtactgacagggttgcttccttctttttttttttttttttttgaaacagagtctcactcgtcgcccaggctggagtgcaatggtgtgaccttgctcactgtaccctccgcctcccgggttcaagcgattcacctgcctcagctccccaggtagctgggattacaggtgcgtgccaccacgcctggctaatttttgttgttttagtagagacgaggttacaccatgttggccaggctggtctcgaactcctaacctcaagtaatccacccaccttggcctcccaaaatgctgggattaaggcatgagccactgtgcctggacaagggttggttccttctgaaggatgtgatctgaaggatcctagctttcctggtggtttgctggaaatcattgacactgcttggcttgtgcaagcatccctctgatatgccttcaccttcaaatgtccttgtccctgagtgtgcacccctttggccaaaataaaaaaggacaccagtcatattggattagggcccaccctaataacattattaaaactaattacatctgcaatggccctatttccaaataacatcacattctgaggtactgggggttaggatttcaacatatgaattttgtaagggacataattcaacccatgcctcttgccccacccccaaataacttcttaatacatgattattttggggccccattcttaatttttatttatttattttagttggtgcatagggttgaattaattaattcattgcatagtatcatcattattctgcaaaaatcccctgtttatctattctgtttttttctccatttcccatttaccttcttccgtaggtaacattctaatattgcagtgcatctcttacatattgtttggttttcatgaaattttttttctgtatcaggtactgactgggtttcaccacgttgcccaggctggtcttgaactcctggcctcaataatgctacataacaaatcatctgaaaattcagtcacttcaaacactgagagtttattattgttcacatgtctgtggttggctgggcagttctgctggtcttccctgggttcactcatgcatctgtgatgaggtggttgaaggctggtctctcatcttcaagcaggctactctgggcttgttttcagaatagatgcagtatattcttttttttttttttgagatggaggctcactctgttgcccaggctggagtgcagtggcatgatcttggctcactgcaacctctgcctcctgggttcaagcgattctcctgcctcagcctcctgagtagctgggattacaggtgcccactaccacgcctggctaatttttgtatttttagtagagatggggtttcaccatgttggccaggctggtctcgaactcttgacctcaggtgatccacccacctcggcctcccaaagtgctggaattatggacatgagccaccgcgcctggccaagtatattcttatgatgagggtaaaggagagagaaagggagagagagcaaggtggagggggggagacagagaagtagtgaaggccttttgagtcttagctttagaacgatcatcatgccatctatgccatctgtatctgtttcctagggctgctgtaacaaagtaccacaaatgagtggctttagaacaacaaaaatttcttgtctcacagttcaggaggccagaagcctgatatcaaggtatcaggagggtcatgctccctctggaggtgctaggaaaggatttgtctcaggcttctctcctagcccctggtagcttcgtgcattccttgacttacagatggccattttctccctgtgtctcttcacatcatctatcctctgtgcatgtctctgtgtctaaatttttcttttttattaagacaccaattatactgatttaggcccccctccatgaccttattttaacttaattacctctgtaaagataaagatgctatttacaaaataaagccacattctgcattactgggggacttcatatctttttgagggggacaaaattcaacccataacaccattacttctgccacattctgttgaccaaagcaagtctcaaagccaggtttagggttgggggaaaacaagttctacttcttgcaaaataagatagcaaagactatggataccagaaagccattaactggggacattattacaatcagtctaacatctttagtaaaacagatcaagagaagtcttaataataatgtagttatgatctgcaatgtaattctaatggctgcccatccactctagttgactggaggcacgtggctattctttgtttctttcccaagtaatatttgtctgtgcagctgagaaatgaaaaaaatagttctaaatcaaaggaaggtcttcatgctctttgtcatgtgaaattttatgtaaaaaatatcacagtgtcacagtctcagaaaggcttaaactattgccttgtgtgctctgcactatagaagttcaacttgtatagacagtatcaattgactctcttccccctccagcttgttgttgggttcaaccattgggtggaaccaatatgtttacctttccctgtggcctttcttttttcctgaagatccaggttttcattttatattattttcctttagcctgaaaaatttatttattttttctcttagtacaagtctgctggtggtaaattctcttagtttttgtttattgaaagatatttttattttgccttcattccagaaggttgcttttgctggatataggattctacaacttttgcctttaacatgttatggatgccattcctctgtcttttagcttccattgtttctgatgctaaatcttcagtcattttatcattgatcctctgtaagtgctgtgtcatttatctctggttgttttcaagattttttcttaattttttttgagcagttgactctgatgtgtctggggtgattttttttttctcttagtgtttgcagagtttcctgaatctatacaaaaacttttaatcaaatttggaaacttttcagctgttatttaccgagatttttttctttctcacttcttctcttctctctttctgagacttcgagtacatgaattttagagttttaaaaatattgttctacaggttccagagactttgctcagttttctttaatattttttctctctgttcttcaggttagatatttactttcttctgtcatctccaatttgttgttagcccatctagtgattttaaacaaattcatatattgtgatttttaattccagaatttcctgtttaaaaatactttatatttttttctgagaattcctatttaatcattcattgtggacttacttaattttaattgtttttttttttttttttgagacagagtcttactctgttgctcaggctagagtgcagtggcacaatcttggctcactgcagcctcagtctcctaggctgaggctcaagccatcctcccacctcggcctctcaagtagctagggctacaggcacagaccgccaggcctggttaattttgtattttttgtagagacagggttttcacgatgttgcccaggctggttttgaactcctgggctcaagtgatcctcctgcctcagcctcccactgttttggaattacaggcatgagccaccatgcctgactgtaaaattcttatatgctaaatctaacatctaggtcattttggattcagtgtccattgagtatgagttacatttcttgtttcttcctatgtctattagctttggattgtgttctatccattgtatataataggtcatagagactctagattgttatatttctcccaagagtctgaatattattttagtctgtttttgtctccagttaacctaactgtatttaaattcaaaatttagactccttttccatgggtggcagctgaaatctctgtttatttctttttgccttagctgagttatttttatgaatttttaatttataaaattgagattagtttcctgatattattgcttacttttttcacctagctctgtgcttaattagatacatctctgttttgtgtgtacatctactctgttgctttgatctgctccatagtgacactgttattaccttgtcgacacacctggcttggatcctgtgggtattgatgtctttctttttttttgagatgacaggctggagtgcagggccacaatcttggctcactgcaaccctgcaacctccacctcctgggttcaagtgattctcctgcctcagcctcctgagtagctgggactacaggcacctgccaccacacctggctaatttttgtatttttagtagagacggggtgtcattatgttggccaggctggtctcgaactcctgacctcaggtgatctgccgacctcatcctcccaaagtgctgggattataggtgcgagccactgcacccagccatgggtacgaatttctggctgaagaagtagagaattgctttcctaaggcaaagtatgagacaggaaaaagcagaacttaaaagctgtcctgcaacctattctctcactgcttcctctgtgaactctttcttcatgctagattcaacttccccctcacctttttgccccaacacatatatcagttcaagcaactttgagactactcaagggcttcttatagttacttttattaattcctaaaatctatgcttttctcttatttctgttgtttcttcaaagctatttttaagggtaattttacatttttacactagctggccgtctgtcaggagtagaaaatctaggctgatcttctctctctgttatgtactatctctgtatttataagatgtaggtaggccagccagggtggctcatgcctacaatcccaacactttgggaggctgaggcaggcagattaattgagcccaggagttgagaccagcctgggcaaaatggtgagaccctgtctctacaaaatgaagaaatgaaaagttaggtggggttgatggtgtgcacttgtggtcccagctactccaaaggctgaggcaggaggatcacctgaacccaggaagttgagactgcagtgagctgagattgcaccactgcactccagcctaggtaacagtacaagaccctgtctcaaaaaaaaaaagtaggtagaagatagtttggaaaatgggagatcaggaaaaattaggtatagcatgtaaactccgagaaaaactttgaaggaaataaaatcttcagttcctgtaaacttcagcaagagataaatttaagaaagaaccagtatcggccaggtgcggtggctaacgcctgtaatcccaggactttgggaggccgaggcaggcgcatcacgaggtcaggagatcgagaccatcctggctaacatagtgaaaccctgtctctactaaaaatacaaaaaattagccaggtgtggtggcacccgcatatggtcccagctacttgggaggctgaggcaggagaatcgcttgaacccaggaggtggaggtttcagtgagctgagatcgtgccactgcactccagcctgggtgacagagtgacactccatctcaaaaaaaaaaaaaaaaaaaagccaggcacagtggctcacacctgtaatcctagcactttgggaggctgaggagggtggattgcctgagctcaggagttcgagaccagcctgggcaacacagtgaaccatctctactaaaatacaaaaaaaaaaaaaaaattagctgggtgtgacggcgggcgcctgtagtcccagctactcgggagggtgagacaggagaatcacttgaacccgagaggcggaagttgcagtgagccgagatcgagccactgcactccagcctggtgacagagtgagactccgtctccaaaaaaaaaaaaaaaaaaaaaaaaaccagtatcaacctagagtatttctcatagatgtatataatttaacattaataaatttttttttcattgctgcatgtaaatgttagcacatttttttaaataaaaaacctaaatgatcatccataggcaattgttaaatagttacatccatccaaaccatggagtaccatgaaatagctaaaatgagttaggtagatcagtatatatgctgacttgaaataatttgcaaggaataccactaagtgaaaagaagctgaagaatcatttgtttagtataatatcatttatgtaaaaaaaaatagcatgggctgggcacggtggctcatgcctgtaatccctcattttgggaggctgaggcaggtggattacttgaggtcaggagttcgagaccagcctggccaacatggtgaaaccccatctctacaaatacaaaaattagcttggtgtggtggcacatgcctgtaatcccagctactcgggaggctgaggctgggagaattacttgaacccaggaggtggatgttgcagtgagctgagatcttgccactgcaccctagcctgggcaacagagccagactccatctaaaaaaaaaaaatagaatctactaagtaaaactatatatttctatatatgcatgcatacttaagtacttgcatagaaaaaggatgggaagcaaacatactgtaccatattgatatctcccctaaaaacgaagctgacttgccagaatggtgaaaggagacttccactttatttatattgtttcagctttttgcagtgaaaatgtagattagaccgggtgtaggggcttatgtctatcctagcactttgggaggctgaggcaggctgatcacttgagtctagttcaagaccagcctagccaacatggtgaaatcccatctctactaaaaatacaaaaattagccgggcatggtggcatacacctgtagtcccagctacttgggaggctgagacacaagaatagcttgaacccaggaggtggaggttgcagtgagctgagatggctccattgcactccagcctgggtgacagttttctttcaaactctgcctcaaagcaaaaaataatgcagatgacttaattttaaaagtcaggctgggcacagtgactcatgcctgtaatcccagcactttgggagtttcgcttgagatcagttcagagtcagcctgggcaacatagaaagaccccatctctattaaaaaaaaaaagtagccaggcatggtggtgggtgactgtagtctcagctacttgggaggctaagatggtaggattgcttgagcccagggtgatgatcatgcccctggattccagcctaggtgatggagtgagactgtctcaaaaaaagaagtcgatggggaaaattgaaactctgaacatggcattcactattatcttctctcctacagaaagaaaaaaggtgtttaaagatgtcctgttatgtttgaacatggatagaagcagaaaggttctgccagattttgttaaacaattctccttagatcgaggatgtaagtggacccctgagagtccaggagacttagcctggaatttcctgatgaaagttcaagcacgagatgtgaccgctagggattcaatcctcagtcacaaggttctggatgaagatagcaaggaggatttgctggctggagtggagaatttggaaattcgagacatacaaaccattaatccccttgacgtgctttgtgccaccatgctgtgttcagatagctctttgcaacgccaagtcatgtcaaacatgtatcagtgccagtttgctcttcccctgctactgccagatgcagaaaacaacaaaagcatcttaatgctgggggccatgaaagacattgtgaagaagcagtcaacacagttttcaggggggcctacagaggatacagaaaagtttctgactctcatgaagatgcctgtcatctcttttgtgcgtctaggatactgtagcttctctaagtccagaatcctcaacacacttctcagccctgcccagttgaaattacacaaaatctttcttcatcaagatttgcctcttttggtgcttccccggcaaatctctgatggcctggttgagataacatggtgttttcctgatagcgatgatagaaaggaaaacccctttttccaaaagcctgttgctctggctaatctccgtggaaatctagaaagcttttggactcagtttggttttttgatggaagtttcttcagctgtgttttttttcactgactgtttaggtgagaaggaatgggacttgctaatgtttttaggagaggctgccattgaaagatgctactttgttctcagttcccaagccagggagagtgaagaggctcaaatttttcagaggatactgaacttgaagccagcacagctactgttttgggagaggggagatgctggggatagaaggaagaacatggagggccttcaagctgccctccaggaagtgatgttctcttcttgcctcagatgtgtgtctgtggaggatatggccgccctggccagggagctggggattcaggtagatgaagactttgaaaacactcagagaattcaagtttcctctggagaaaacatggctgggacagctgaaggtgagggtcagcaaagacacagtcagctaaaaagctcatctaaaagccaggctctaatgccaattcaagagcctgggactcaatgtgagctcagccagaatcttcagaatctctatggtaccccagtattcaggcctgttctagagaactcctggctctttccaaccagaattggaggtaactttaaccatgtttccttgaaagcctcctgggttatgggccgcccctttgggtcagagcagaggcctaagtggttccatcctttgccttttcagaatgcaggggcccagggccgaggtaaaagttttggtattcaatccttccatccccagatattttattcaggtgaaagattcatgaaattttccagagttgctcggggatgtcactcgaatggaacatttgggagactgccaagacccatttgtcagcatgtacaggcctgccctgagagaccacaaatgatgggaactcttgaaaggtctagggcagtagcctccaagataggtcactcctattccctggattcacagccagcaagagcagtagggaagccatggcctcagcaagcttgcaccagggtaacagagttaactgaagcaactggaaaactgataagaacatcccatattggaaagcctcaccctcagtcctttcaaccagcagcagccacacaaaaactaagacctgcttctcagcaaggagtccagatgaagacacaaggtggggcttcaaatccagctctccaaatagggtcccatcccatgtgcaagagctctcagttcaaatccgatcagtccaacccatccacagtcaaacactcccagcctaaacccttccattctgtgccctctcaacctaaatcctctcagacaaaatcctgtcagtcccagccctcccaaactaaaccttctccatgcaaatctactcagcctaagccaagccagccctggcctccccagtctaagccttctcagcccagaccccctcaacctaagtcatcctcaaccaatccttcacaagctaaggcacaccactcaaaagcagggcagaagaggggagggaagcattaaagagctaactccagagatctataaagcatatcctttacccaggccattcctatcatatagtaagcagaagagttgccatgaaagtaaaagactactgtcattagcatgtaaaacaaagaaagatatacatgactgaattggatatctttgtttgtttgtttgagacagagtttcactcttgttgcccaggctggagtgcaatggcacgatctcggctcaccgcaacctctgcttcctggcttaaagtgattctcctgcctcagcctctcgagtagctgggattacaggcatgcaccaccacacccagctaattttgtatttttagtagaggcagggtttctccatgttggtcaggctggtcttgaactcccgacctcaggtgatccgcccacctaggcctctcaaagtgttgggattacgtgtgtaagccacagtgcccagcccgaattggatatctttaagatatctgtaagtgttatatccctaaccaagaagaaaaatatgaaaataattaagactagaatcaagcagtagataattgaatccaatcttgggtattattagataatgtataacttgcacccagggaatgggggtctatgagacaaccccacttggagaagaatggggttagggtctctaattgcaaagtgactgtacaataggacgaaagttgcctctgtgtctgagaaagtatcttagttgttggctgctccagaggtatctttgtcaaaagcttctggttcaatatcagccactgagcagataaccctgcttatttggtgtggttaaatcaactagcttctgctaatagccccaatttgcttgaatgggaaaactctctcatttgacccttataggtagaaataatgaattaacaaccaataaaattaatcatttggcattaa

SEQ ID NO: 490 - DNA, 258757 bp, Homo sapiens
ttaacaaaatggtagatagtaggatctattttaatttttcaatctgaaaaaaaaaaacccaaaacaaaaaaaaaacaaactatcctcatatatatatatacagtgtcaacattttcagagcacttacattaggaaacattgtttctcttcaactgtatgacaatactgtatatgccacaataaaatttacaaaaacaatcgcatcagcagtcataacaaacatcatgattttacatttcaatacacaagaaaaaaaatagacatcttcccggcacttggctcccgcctgacggcaacgtctcctccacactttgagagacctcagcttttaaaacccagcagcggctatttcagaagtcatgtcctttccagatccaaacttaaataatgagaaatttgccatttcaaaataactgagagtttattcatggatgtggtgaagtttactccaccaaaagatgtgtaaaaaaattgcatgaaagtaaaaataaataaagctgttgtaaagcagcctcgttgacacggtagcccagaacaaaacacttacgtgtaaaagtgtcattacaattttaaagtaattatttatattcaaattacaactttttgacaaatctaaagaaaacaaactgatttggtaaaaggttcaaagacttccacattcaagctcggtgttgtttcacacgcgtgcgccccggctgcggcggtgacatattgctgtattcggacataaggcactgtgatctgaacataccgtgcactcaccttatgccacatcacctgttccataccagtgaattctttgaaatgaaaaataatgaaaacttcaggacacagtgcactttaatgacatacagcatttaaaatccttcagacaaaggtctgaaaacagtcttttaatgcaagcctgaatcttcaagcacataaaatctttcttttttaagcttaatttcaacatcactggaagaaatacctattgttaaaccctgatatacattcttaaccacttgcagccagtgttcatgaggcaaaacgtgacccagagactttgttcaagttctcctcctagggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaggaggatgatccagaggcttcggaggagggcgatgtgggaaggagcaggtggcccaagctcccatctcccacccaatcgttcgggcagcttggatccacgtaacatcttgtcattctaaatatgtcagatttaacttggaaaacaaaaaaaaagaattccactcttaaaaaattttactaagaaatatgtaggtatgttttagtgaaggtgtgaagtatttcagttgtgcactcttacaaatatgtattaaaaaaaggtttaggccgggcgcggtggctcacatctgtaatcccagcactttgggaggccgaggcgggcggatcacctgagatcaggagttcaagaccagcctggccaacatggtgaaaccctgtctctactaaaaatacaaaaattagctgggcgtagtggcgggcgcctgtaatcccagctacttgggagactgaggcaggagaatcgcttgaatccgggaggtggaggttgcagtgagccgagagatcatgccattgcactccagcctggttgacaagagtgaaactccgtctcaaataaaaaaaaaaaaaacaaaaaaacaaaaaaaaaacctttataaatattctgaaggataattgcacctaacaagtatctggctaggacattccacagtggattggcagggagagctactatttttctcatcacaggagcttctctcctaatttttcaccagacgctagacccctgaaagagatcggcaatctattagagcgtgtggctgaaacaccgtagctcctggcatcagactgcccacacactggatgcacgcacacatgggttcatttggacagtctaagtttgacaatgaactgttgctaaaaacttttttgagaaagagaaagtgttattgtgttgaaccagtacccctctggggaacggtggccattgcccgatgaaaagaatcaccactagtaccttctaatcgagtaacagcagacacttcatcaaactgcctcttactgactattccatggacaaccacctaacagtgcaggtcccgggcactgcgcctcattgcacacacatggcttttgtgcacggctttcagctcttttcatagcaacataggagggagacgggcctgtatcagccggctccttctctactgaagaaattggggctgaaggaggtgaagcgacttgcttacattcagacagcgctcgggtgggacagctgggacttggcctcacggtgggggcctcctcacttgcgattgttgatcagatgcaggcgctccctgagttccactccaaaagttcacttgtaatccagttattagtaacacggaatgttttcctcaacaaatcgtgttgtatacactgtatcataaggaattccaacccagctacccccatcttcacggcacaatttctatggtaacatacattccaaattccagctggaaatagattcctctctgcaccagcagtgatgggaggggcattgcaatgacttagaatttttgaaataccaaatctggatggaaatttgaactcatccagcacaaccgttcattcttatggtttgagatatcaagaaacagagaggatgaatcgcttgacttgtttactctttttgtaatgcccaaagagacagacaagagctgacattcagcctgacccgctgggcagactgtgtcccgtggtccagggctggaaacggggcatctttttctgaaggtgccaagctatatacctgtggggataaatctgcccagagaagaggccttttctagttagcacaaatgtgctgtgcagttatgcctgcctggaaatttatatgaatttaatgatggtctggatgagcctggctccctctgttcaatgttgcctgtgagattcctccactgttgaatgcagctgtactgttcgttttcaatcctgtatcgtattccatcgaatgaatgtgacacaatttatccattcttcttttcaaagatatttggattattcccagttttatggcattaacattcgtttagttcttaatgtttcatgattatagagactattgtgagattcaggtcttttaaacacttgaagtttgcaagtgactgcaccaggccccatttctagagtttctgattcagtggatatgggacggggccccaacatgaacatttcattttctagtaaattccaggtggtggtgatgatgcctggcctgaggaccacctcggaaaaatcactgctgtactggaatttctcttggtgttctcatttagcgaataagacatgtttcttgcaggtggtgaagattcctttagggtaggtatttttgggttacagacttaattgtaaaaactagtcttaactgaaatttctgaactaaagagaaatcaatactgtagcacacacaccgtttaatattggattctgagagttcaaagggcatgctgtttgctcccacatcgggtccatgtggccctgacaaaggctgggttgttcatatttgactggggctggggaggtggagggatgggaagaggaggagggaagggagggctggcagttttaagaactctcaagcccacctcttactactgagtgtgtgaaatgagaggaaggccagctcctcttgtctaaagccctctcccgttctctctgctcctcactgtctgagactctgaaggcttgctcaaagtgaatctgtcaaaaaatgagtttaaccacactctatctgaaagtgaatgtgatttctgtacaatattaatgaataaaagtttgtgtttaggtattctgttttatctactcaaaatataagttttttttctctttaaggaaagatgaaggtatcaaatagaagccagtgacgttccctctatgtttctggtcactagttctctcacaaagcacaattgaagaggtcttttcagtggaaaaggttatgatgaacatggcaatggctcccaagtcatttagggggccactggaccttgataggatgctcttaacttcgaatacgttctatacactttcctcactcacgcagaacacttaaacttcccaactgaagagaaaacgaaaatggtttcaaagtaatatactcaaagccttgatctgtaggtgggtggagaaatgatggtttaaatgctgcacttcctgttctacctcccacccttcctagacgccgatggcaaaggtcagaaaccagcattttacctgctggtgtgaggatcagggcttgcagaatgtccgacagggaaataatacccacaatactatctgcttcatttaccaccaccagccgatggacctgcaaagagaaaagcaggacacgtgaaaattaacatttaaaaaaggtttaaaatggacatgagaaataatgtcctgtcatgtttttatatgatcaacacatccctccagcctggggaatagcagtgagacatcatctctacaaaaacattagacagtggctgggtgtgctggtgtgcacctgtggtcccagttacttggtgggaggattgcttgagcctgggaagtggaggttgcagtgggccaagatcgcaccagtgcactctagcttgggtgacagagtgagatcctgtctcagaaaaagaaaaaagcaacacacacacacacatcccataaatgaataaatgagggaaagtagccacagacagacccatacgatgaccttaggctctaatgttcaatgtgttactgtctgattacctggaagacctactccgtattaaaaagtcacagccctggtgaaaaacagggacacaggcatgagaaggaaagaggggaaagctatctatctcctgtctctaatgatactgatttgtctctaattcaagctgatttgcttgcttacttttaagaaaaatgagctagctatgccctgctgagttttcaattttcaaaatattaatatagaaaagatacaactcaaacacgaaacacaacgtagctatcatacattgttaaacataactgttttaatttctaaaagttgtatatcagtttctaataactatcaggtacttgtcttattaatacatgggagagaagtccagatgatgacagaaacgaagaaacaaggtcgcagctcttacaagggttttattttctgcagtgtcttttctctgtgaagttcatatattaagaatcgcatccaagaggataaatgagctataatgaagtgggatagactacgtccatctctagttttctactctgaaatctctgatgagtgacggcagagcgttttgaggtgtttctgtaacaggcctttcacccgcaggaagggagcggcgttgctattctcttaaaagcttcatgatggccgggcgcgatggctcacgcctgtaatcccagcactttgggaggccgaggcgggcggatcacctgaggtcaggagttcaagaccagcctgaccaatatggtgaaaccctgtctctactaaaaatacaaaaattagccagaagtgctggtgggcacctgtagtcccagctactcaggaggctgagacaggagaattgcttgaacctgggaggtggaggttgcagtgagctgagatcgtgccactgcactccagcctgggcgacagagcgagactgtgtcttaaaaaaaaaaaaaaaaaggctttggaacctggagccgggtgcggtggctcacgcctgtaatcccagcactttgggaggctgaggtgggcggatcacaagatcaagtgctcgagaccagcctgaccaacatggtgaaaccccgtctctaccaaaaccacaaaaattagctgggcgtggtggtgcattcctgtaatcccagctactcaggaggctgaagcaggagaatcgcttgaacctgggaggcggaggttgtagtgagctgagattgcgccactgcactccagcctgggcgacagagtgagactttgtctcaaaaaaaaaaaaaaaaaaaaaaaaaaaaaggcttcagaacctgggccacggcagctctgtgccggctgcgccctgggagaccctctctgtattgaacagtgatacccctgatagaaaacagggacataggaaggagataggaagagggggaaatccagtttttgtattttgtctcaaataatactgtttgggtgatgtttctgtcataggttgctttaggttaataataataataataataatggcttggtcatctttcccgtggcagtcaacataaatttcttttaaatgtttctctaaaaaagctttcaggttcatcagtaatcctgtgatataacacagcacaattatttgctaactataatcacacattaaaatgatagttcacatttgtcttctacactgaagacattttattggttacattcaatagtggatattagccgggtgcggtggctcatgcctgtaatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacagagcaagactccgtctcaaaaaaaaaaaaaaaaaatagtggatattaaacagatatcttttgaactctgaaggctaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtccttctgtgaggagtcatcttgtgaaggaattttctttttaggcggagtcttttatttagggtgttacacaaagtacatttgaaaatcttataagcagtaaagtctaaggaaattggactgctgaggtgcaggaaactgggagttactagattatttgctatttatctaattgaggaaagagagatactggtgggaagagagaaaaaagttttactgacttatcattcactttgttaaaatatatattacgcactttaaattttgaattcataaatattcaaatggaacttaaagcttctgggatttttgttttctcaaaacaaaatgtatccatagatacagatacatcgatctatttagagacagggtcttgctctgctgtcgagactggagtgcagtggcaccgccacagctcactgaaatatcaagctcttggattcaagggatcctccttcctcagcttccctattagctatgactacaggtccaagccaccatgcccagctaatttatttttatttttagtagagacaaggtcttattatgtcgtccacactgtcaaacatatatagtttaaactatgaatgtatcttaccagtttattggattcacctatgataccaggacttttccattcaattcaattcaacaaacttttagagatcgcctatatgccaagtagtgtgccaggttctgggacaggagggaatcccatcgactgaacctggaggctgcctcgctgggcccttcctgagattcaggcttccagaggcatcattcactactggggacttgttgcagtggacgtcgggggagcaggactgggaaagccgtctcacctcagctcttactattctgtccacgatggtctccagtatttccagcttattgcacttcacaacaccttcaaaatactgtgaacggtgctgaagggcctgggtcaccgtgatatctaggttattgtatgttttctcagcagcaagattctgtaatgaagcaagagaataaattatatcctttcatttcagttcacttcaatgaccaaaattagtgagcttaagagagcctgatttctaaaaactttaatgcttatctgaatttagtacctgcatacatcagacgttctttctggcttacgacatgccattgctactgttattttgtcaacatatcaatcacaattaaagataaccatgttacaaggtctaccttccttacgaagcaacattgttaaactttgacagtatatcctgccaaagactgccccccaatttttaccctctaatgctctctaccatgcatggatgaaatctctggcaaggtgggctgacatctgtaaagggtggtgagtgccacagggctagaaatgctgcagcaacggaccttctcaacaagctccctggggaacaaggtttctgctgggaaggctttgggggacccatggggatcaagcaaccagaggaagaacaggcttgaggagccccatggatccaaatggcttcatggggctctcattcattttagcgggtcccactcaaccaaaatgccgatcagcatatttctcggtgactgttatgtttaacataatagtgtgaagcaaagggtttgaggcagctgcagaagaatgtttaatgtggggtcagtattgtggcaaaaaatggcgtgcacatttggggctataaagtgtcagtccccttttcttctttagaacagtggctcccaatcactaagcaatgggatgcgcccgacaaaggagccatgagtccacgtgtgcactgcgcacgcgtctagaggcgaataaatcaggcctcctacgtggaaacaagaacatttaaaatatatacacatgctgtggcagtgcataaaatatgcatgtattgtaaagatgaaaaattataaaatgctactaatatataattggttgctaaaccaatgcagattaaaagtacaattactatagaaggtctataaaattctgataatatcctcacaccccaaaaggttagaaattattaaattaagaaacaagataaaaacataaaaacacattacatgaatgtttaaaatgcattctaggtgacagattgaacaaaattaaaatacttacaattacatcaaatttggaataaatatctacaacttttcctaaaaatgaaaaatatatgttagaaaaatgtcttaagggacaaaaagaaattcatttaaaatcagttttaatgacataattactaaaagttaaacactgataaataaccttgtctattttaaatgaaaacttagatatgaaatcatattttaatggacatatgaaaataaaccaattaaactttttttacgatcctgcgtgccccttggtgctgaatttattcaccatacccaagttttcattttccccacgtatctcctgtgccaggtcatcttacaataattgcaccctgagataaacaattatttctgcctgtcagcgccaaacacacaaacctgactcatccacaacaggcagagctgatattcgtctttccacaaatatgttcaaggctttgatgatgggagtgtctggatgtatgaaggcaatgttgtggtacgttcctattccaagctcatccaggttctgcttcatgaaggcaggctttggcatatcagacatctaaacggaagataaacgcaaacgttctagacccagaacacactcttgtcatgttcaaaggtccagatttgaatgaaaaagtatgtccaacaaattaaagttagttttttctaacagtctacctggatgcctgaattaacatgagaaaattacaaaggactgtatcttttgtttgaaccagtttgtaggtctatgcttctatttaactattcacaaactattgcagagcattgatactgtaatctttttccatctcctcttcactcactaagaacgcgtatagaaccagggaagaacaggtctatttgggatattaagacctgtaagccacgaagaattgaatcctttattcttaattgttcatgttaaattcctggtcctgctgtcaggattaagtaatatttattaagaacctatacatttccaaacccaaagcatttgacggcagctgtctgagccactgctaagctagtcctcacgccacccgcctctacatcctgaattctccttggagagctccaatttttgtctactaggaacaaagaagccagctgaacagaattaaaagaatctttaaaaattaacttttcatgggctgttttaaaggaggagggatatggcaggagagaaaagtctaggatcatgtttgagtataacaaaataaggtctacggtttcaaaaatccaccttttataaagggtatagttgattccatcctcctggtgtaccttataattatcaggaaaagatgaacaattagaagaaacaaaatgttcaagtcaaagagttcatcaatattcaaatcatgagactcctagaaatttagagaaaaaaaaaaagaaagccctattaggtcatctagtccatctcaacatagcgaattccctgttgcacactataggcttaggctaattttcaaacgtcttgaagggtaatgctccttttttctcagaaaatgatctcataattcagtaaaaatcaggctctgaaatgtctttaagttctatatttttaactgaaaacctttagttagctgaatattctggtagcatgattctaattaccatattggcccaaatatgaggcagtactgggcagaggcaacttcctctcctttttatagaagataaaaatctgaagcagctctgcaaaagaatgatctcacgcttttactccctcttgtgcaacagcacactagcagaaatagtttgggcttgggagtcagagagactcccgggtttgcaatctaccacttagtatccacatgactgggggcacgtttcccagccaggtgtcctgtgtatgcaaggtatgcaaacgcctccctcccaaggcccctgcgtggagaaaagcatggggagtgaggaacgcttgaaagggatcctggctctaccgcttcccagccacgcaaccttggcaaagctacttaacctttcttagctgcatccctataaaataggattaataaaaatacctacctgatagggtagcagcgaggatgagattatgtcaagtgcttagaacagtgccggacatacagtaatcagctctcatgattaatattatttaaaaatgatgactctaaggattaagtgagctgcaggcctggcacgtgggggccctgaatacatccttcccaccccatgctccctctgttcctattaaacttcaactactaaagcggctgcattcccagatgtccagtctgataaacaatgcggatgcatccctaatccctttttcctagattatcgcctttattaaacttcagacttgagtttttttgtaaattactcttccctaccttctttcttagcacagcatggttaaataaatgttatttatatatgtaaatgattaaaatacaagactgggttgattgacaaggtatttctctccatcactaagccctctgtgcttctgtcagcaaaaggggtccctcaagctgcctccagggcaggagcttcagctccttcacactgcaccggaacgctatgttaggtccttaggtgaagccatggggaggaaaatgggaaagctaatttgaagtacatttttaatatctgttacagtcttggaaaaacaactcttcaaagtacctcttcagaacgattaagaccttctactggttctatttgactgattacttacaacctcaaattccatgcatgtaattaaaagacaaacataaaaagcctcttataaactctctgttcttcctgagtctcttttaatgtttccaaccaaacaggctcaaagttctggatgactacggagccaggtcatttcaagtagctgagaaaacctacaggttaatacaggccttatttggaccaacatggtattctcttgccaaaattttatttgcttcgggtttttctatcactgctgcagtttataagataatcttgaggaaagcattttttggaacatgtttctaaaaccatgacaccagtaaaagcaacataaagcaatttttgctctagatattagttcagtttatcttgtacaacagtcctcaattagacttgcagattgccttatttcccctcatatgctggtgacaaatgttttaatttaaagagagaatgccgagttttgttgttaaaattgttttgatacttgcactaaaaggtgattcttttaaattggaatcaactttaagaatgtacaattcagagagtagtaagttgagaaactgaagtttagaaagggagacctcaaaactaacaatttcttctactgagggtaacaggagccaatttacttgaagtacattatttaataagtaaatgcaattatgtctttagaaacgctaaaaactacttacaaaaagctggaggaacttgaggattcttttgtgggtaagtatataaagtgcattcccactgatagggtcaataacgggcaatctgtggattttatttttgatcaaggagtatacagcatcgaagaggctgtgggagaagtcattaaagttgttaggaggctttcgagaaaaatcagaacactttggactacccctgccttaaagcacttccagtgtttttattattgcaataataacagtgttttggaagagttttaaattagagatctcagcaaatttttcatttttcacaatctatgttaacatatctcaaatacaagtgcaagctacaaatctctagaagaggagattttttttggtttgtttttttgagacagggtcttgctctgttgcctgccgtcatggctcactgcagccttgacctcccgggctcaggtgatcctcccacctcagcctatttgagtagctgggactacaggcatgcgccacctttcttttttgtagacatggggttttgccacgttgcccaggctgctctcgaactcctgagcttaagcgatccacccaccatggcctcccatagtgctgggattacgggcatgagcccttgcgcccagccaggaagaggagtttttttaaagagtgtatttagtgattttatttgaaagacgatgaaacctaaatccttagaaaagcaaacagatacatcgtattggcaagagagcaaaggctgtagcagcaagctctctgcattggtgagtgggcaaactggctctaccccgggccggcccggctaggagatattgcagggccaacatttctgttctacttggtccctctcctgggactgccagtaagaaggttgttatacctttttgttaggacttggaaataaaatgaaaataaatattttaatctttctctgtactggatttgagtttgaaagatgcttttacaccaatatggaaatgtatcacagccaaaccagaaggcttggataaaaaaggacgggccagacgactacacagaaggcagcccatgctctcaccacatctgaaccgacatctaacacacactgatgtttaaacgctagtgtggagcagaattgccaagggagttgtttaaatgtgtattcctgggccctatcctgatttagcaggtcaggggtaaaagcccaggaatctgcaatttcaacacgccccccagattggccgagatcttcgtgatggtttagtatgaccctattactagaccattatccatccttagcaccagcaacggctgtgatttttgtagtgttcctagatttactgaatgcgtacagtgtagctggaattaaggaggcaggccctgtttggaatgaagaacatgtttatttgtgtctttctttctatcatggtgataaaacacatacatctgaatgaatgttttcaaagaaaaaaaaaacaagtttaccttgcatctggagatatattcactaaaggcttaaatgtttcttgtaaataaagctctgtatttatagaaagaaaatatgcagttagtaacacatttgctgtttgcagttataacacaaattcaaatacccttcagtttacggttaatagttagaaggattaaaaactcaaataaaaagaaatttaatttgcctaaaactcctgtgttaatcatagttatggctattttaaacaacttccaaactgttttcaggatgttgcatttgaagaaaaattaaatattaaaaaacaatgtgacagtaagtgtttataaaatcaggaaaaacaaagaaatctgataaaagagcaataccagcagaggtcactagaatgctaccaggttcaccttactctcaagaaatgaagcaattatgaaatttaaaaaatcaatttccataagttataagataaaatcagttatgacaaactttgttctttaaatatttttaagtattattttaccaaattgatgctcaaaacctactgcattgtgggcatctttccagcacataaaaactgtttttttctgaagatatcaactgcaattaatttgcttttccaaggtttctttttttttctgagacagtctcactctgtcactcaggctggagtgcagtggcatgatctgggttcactgcaatctctgcctcccaggtacaagcaattctcccacctcagcctcccaaatagctgggactaaaggtgcacgtcaccacaccctgctaattttttttgtatttttagtagagatggggtttcatgatgttggccaggctggtctcgcactcctgacctcaagtgatccacctacttcagcctcccaaagtgctgggattacaggcatgaggtcctgtgcccagcctaattttttttttttttttgagaaggagttttgctctgttgcccaggctggagtacagcagcatcatcttggctcactgcaacctctgcctcccaggcccaggcgagtctcctgcctcagcctcccgagtagctgggagtacaggtgcgcaccaccacgcctggctacttttttgtatttttagtagagacagggtttcaccatgttggctaggctggtctcgaactcctgacctcaggtgatccacccgcctcggcttcccaaagtgctgggattataggcgtgagctactgcgcctggctctaattttgtatttttagtagagagagggtttcaccatgttggtcaggctggtcttgaactcctgatctcaagtgatccacctgctttggcctcccaaagtgctgggattacaggtgtgagccaccgcacctggccttgctttaccaaagtttctatacagaaggcgtttaagaatattttggcattattattactacaaaatatcatgtaatgtcaaaacgtaaacatacttaaaccttggtctatcagtacttgtacagtagaactggacaagaagctggtgttacacaatcactgcacaacagactgtacagatcccatgccaaatttgtttagcttggtttgacaaagccgtaataaaccaaacccatcactcagtgaaacttctaaatcgtatggatttgaaagggcccctgggggtgtaagagaactccaagatgtattctgatttcacagccagctacaaaggttgcttctcctatcaagcatattatgggaaacacagaaccaaactcttcaattttgaattcaaaattttccttcagttggtccctccatttctaccagtgtttccttgagcaccctccaaaggctccgctgttgcagacagactgggtctgccgtgattcccacccccggtcctctccaccaacccaccatgacaagtgtcagtgagaccaccaccttacaatcatgaaatgcgaatttaagaaatggttctatggcagaaaagagtatcatgattttacagggtgaatgtcaatgtgacaatgaagagaatatggtcttcaaattacttccatgctatttgctccaaaccatctagtttgaggttcatttgtcctaagtttctccacaatttgtaaagaaacaattactaggtttaaataagaacagatgcttgctttggttcaagttaggcatgcctctgatgcatttcttaataccaaggcaaatctctgagggcttagacttagtagtgagcggtggccccattgtgggcagcgaggtggggcttggttagctcattcatcttcacattcctggccctaggataaggccttgcctgctgaaggtgtcctatacatgtctataaacagaagggacaatacttatattgttcagctttagtacagtagcatactatcaaaattaacagaaataaagagaatgttttatataacattttatggagcagagagaaaaggatctgcaaaatgaaaacatacttttcatactaaacatagctttcccgatactaaaagattttaaacatccaatagtgcttacccctccatgtttcaattttatgttcctctaattcataaatctgtacctgcaaataaaaaaattcttatttataaatatacatatacaacatagaaaaaatatttggaaaatgaaacaaaacatagcttggataatagcattttctattcgcaattagaaaatgaggcggccaggtgcggttgctcatgcctgtaatctcagcactttgggagatcaaggtgggcagatcacctgaggtcaggagtttgagaccagcctggccaacatggtgagacctcatctgtactaaaaatacaaaaattagccaggcatattggtgggtgcctgtagtcccagctactcaggaggctgaggcaggagaattgcttgaacccaggaagcagaggttgcagtgagccgagatggtaccactgcattccagcctgggcaacagagtgagactctgtctcaaaaaaaagaaagtgaggtgagatatagagaaaaaaatgtatctcaagtttttttttttttttgagacaaggtctcattctgtcatccgggctggagtgcacaagtgcgatcatgactcactgcagcctcaacctcccaggcttaagtaatcctctcaactcagcctctgagtaacttggactacagatgtacaccaccatgcctggctaatttttgtgggttttttttttttttttttttttttttttgtagagatggggtttcaccatgttgccccactggtctcaaactcctgggctcaagtgatccacccttctcagcttcccaaagtgctgggactacaggcgtgagccactgtgcctggcctgtatctacagatattaagaaaaactttgggctgcatatttagacataactgcttttttgcaattttgatttcatattctactgctaagatttcttatatgggatttgctgcatttcacagaaatctatctattcaaaaatcacactcatgctgattttgctagttcaaaagcagagatatgaccactataaggaaagcccgtgttcacttgcattggtaatattgaagaaataatacacttcatgggaaataaatacaggatatttacaaaatctttggtaaaacttcctaagagtatggttgtgtttgtttttcggagacagagtctccctctgtcgcccaggctggagtgcaatggcgcgatctcggctcactgcaacctccgcctcctgggttcaagcgattcttgtgcctcagcctcctgagtagctgggattacagatgcccgctgccacacccagctaatttttgtatttttagtagagacagggtttcactatgttggccaggctggtctccaactcctgacctcaagtgatccacttacttcggcttcccaaagtgctgggattacaggcgtgagccactgtgcccggcaagagcatgttttatgaagaaactcatttttgtatttgatgtaagaattattggataatactgagcattacgcataaagcagtattaattgaattaacctacaccttttaagtaccccaaataggactagttaaataagagtatgcaatcctgtccttccccccaccctcatgaacaaacaaacagaaactaaaaacacaaaaccaagcaggttgaatctcagatatcacaaagttagatgaaggacaaaagtggtttttaagctacgctctttccagaaccattgtactagggaccagagagttctgctactaaaatcagccaggagctgtctcttcctaattagcaggaacatgtcaaaacggaatttatttcactttaatgactcatttttttctgctttaaaatcacaaagtacatataattcttgttctgcaattgctggggtaactgaattaagctctaccacctcaacaggcccgcagagataagcaaaacttacagaacgtctagctaataaatatgtagaattctgctaagccaaggaattccgaaagctgaataaagaatctatttccttttatttttcctgagaattccttctttgagtttcatacatataacttacagtaaagagagttttgtactgaagttccctgcatgttatatagatttggaaaatcaccatcagcacaccataccaaaaaagaaaaaactgaaaacattaaaaatcttaaaatacacacatatacctacacacatacatagatacgtacagctccaactactgacataggaactggtgccacttaccataggtgatttatagtatctatgtagtatatttatgaaatctgtaattgttagcattcctggaacaaagaattacatgttacaaataaaaccatgaaaacatttttaaaaatttcaaatgacaagtgagcctagaatatatgctagaagagcttataaaatatacttcgaagatatcaagcagagtttaatatattatttaaaactattgatgtgttaattgtgtataccaaactggatatacaaatttagctgaaattaaacctgacagtaagtactacggaactaaccagagaatttggcaaatcaatgagagaaaactcattaattgatacaaatttgaaaaaagaattgcagttacaggtaaataattttaagtactttaagataaagtattccgtaagctttagaaacgtgacaattctgggcacttggattgtttcccaagaagcattctaaacacaatggttttaacagttgccatttattgagtgcttttgacgtgctagacaccaggatgatacggatgaaaaagacatgaacttcttccctgatgaaattaaaacctagaagcagacataacgatcatttcaaaataacgtgaagaatactaagagagacaatggcattgtctgctgtgattcataagataagtaacgatggcatttagatagctgtaagttacacaacagttttaacagtataacaatggtctggcagagacatcagtcatgtttacagcatctaatttgccctgtcaaaaaggtgtgcactagcgagatgagtgcggggcccagggatgccatatgccatgtgtggcccaaagtggggcagctggctcacatctgactgtggtgtcctacgtggggtttgttcattgggctggtaaagacacataagctcttcagagagccaaaaagttgctaaattaaaagaaattcaacaacaacaacaacaaaagctccataaaagttacaacagtgtgtagagttctcaatgaggcggcaaaaaaaaaaaaaaaaagaaaaaaaggacaacagtgtttggaccttactagcacgtccaccttcttacccagtatgtaaaagcaaggaattttttttttttttttgacagggtctcgctctgtcacccaggctggagtacagtgcagcgatcatggccttgacctcctgggctcaagtgatcctcccacctcagcctcctgagtagctaatttttgcatgtttttgtagagatgaggtcttgctatgttgcccaggctggcctcgaactgctgggctcaagcgatctccctgccttggcctcccaaagtgctgagattacgggcatgggccactgcaccctgccagcaagaatgttctttaacttggaaacatgtttactaggttgaattccaaaccggcatctattaaaatactttaggctttctgctttcaaggtttccattttcgattttcctcaggcccacactgcttacctacaaaactttgttttttactctcccacagtggcgctgctcggacaccgttggctaccaaagcaaagaaggcctttttaacctgaagaaaaagaggagaaacaaaacatactttcaaagtccaggaagaaaaataccttttttttttgagacaaggtttcactctgttgcccaggctggagtgcagtggcaccatcttggctcacagcaacctctgcttcctgggctcaattgattctctcacctcagcctcccgagtagctgggatgacaggcatgtgccaccatgcccggctaatttttgtatttttggtagaaacagggtttcaccatgttggctaagctcgtctcgaactcctgacctcaagtgatccatccacctcggcctcccaaagtgttgggattacaggcgtgagccaccgcacctggccagaaaaatacccttaacatatttgaccaagtcttatcagttatcttccataataagtttcgtaagtttgataagctaaaaataatggaatttattaacattagcaaaaatctttttgaattacacctaaaggcatacagggattagaaattattttttgaaattgaaataatgcaattaacttcttttttttttcttattgtatctgaagactcttgtctacatacatactttatgtaattaaaaccatacaaaagaattaaacttcagggtctaatatctcctacatgtggttattaattcatctgaaaacactgaagttgtatcaaattacctgaaataaaaatttatttttagtattttcaatgagaaaacaagcatactttctcagttcccaaggttgaggaaaaaaaaaggtatgaaagatacaatatatttttgcattttataccttccagacacaaatgggtcaggcactaacatatcatatctcacttaacactcataacaaatatcttttgggataccataaggtatcatacttgaagatttattaataaccaaaagttcagtgctgaaaatgatcctctaaattcagacagcaaataagtacagggaaaatgtccaaccttattaataacccaagaaatgcaaattaaaacaaagtgtcatttgtagatgctaaataagccgatattttaaagttgcagctcctaatacaagggctattataaaaccactggtggcaccaaacactgagaaaatattttttctaacacagctagtgtcaagaatcacaaagtattcatattgcttgtgcaacagctttttctctttgaattattttaggagtgggattcctgaatcaacaatgttccatgtgacattacttctaatcttgaaaactgaaaaaaaaatccacctctcaaacaaaacttatcaaatactagcataccaatgagaaaaaaaatcaaataataattaacataattatgatgttttcataactatatcaagaaaggtctatgacaataaaaatgtaactgtaaaattatacattatgatacttagaaaaatatgtgtttaaatggaaacaatgagaaacaagcaaaaaaagattaaactgatacattaagaagctgggatagtaaaatgtttctttaaaaaaagtgttacattatggtatggttatgtttttttttttttaactaaaagtaaattattctcttctcactcactactcaaaaaaaaaccttgttggctgggcacagtggcccacgcctgtaatcctagcactctgggaggccccccgagatgggcagatcacctgaggccaggaattcgagaccagcctggctaacatggtaaaacctcgtctccactaaaaatacaaaaattagctgggcatggtggcgcacacctgtaatcccagctactcaggaggctgaggcacaagaatcgcttgaacctgggaagtggaggctgtagtgagccgagaacacgccactgtactccagcctgagtgaagagtgagactctgtctcaaacaagcaaacaaacaaatgaacaaacaaaacaaacaaaatccttgttaacttactaatgaaaacaactgcaggaacctagagcagatgactttaggactaataacttagtacctatttcttcctttattgtgatatattttgccttatgtggaactgctcatgcatgtacctagttcacctacacaagaatatagggactactggtgcgttgagggagctcatcaattatttcacgcatttattttaacccgtccagcgctgagtcctgaatatagcagggattctagacattagtcaaatgactacaagagaatgacgatgaggaaatgagtagagccaacccagtgatgtgggagagcaacagtaactgagcagcatccagaaactcatgaactgtttctgaaacacacctttatcaaaaaggcaccaaaatacactgcttttgtaactaaatggcatccaggaaaggtgtgcccatttgaatggtttgctatttgtaccctgggcatctctgattgtggtcctagaatatattatagaagaatatagtggaaaagtcgcatgtaaatagattttaaaacacactgaatatctggtaagtttgcttttctaaactggttggaatagaatgggaatgggggcaccttttatgttttatttgtatttatttattttttttggagacagggtctcactttttcacccaggctgaagtatagtggtaccttggctcattgtttcctcactgcacccctccccgctgcccctgccgggctcaagtgattctcccacctcagccttccaagtagctgggaccacaggcacatgccaccatgtccagataattttttttcttgtagaggcaggatcttgctatgttgcccagactggtctcaaactcctgggcttaagtgatcctcctgtcttggcctcccaaagtgttaggattacaggcatgagccactgcacctggccaggggcatcttttaaaagcacaaattgcttactgttttcttcaaaatgacagatttagcagagaaaataaatgttaaaaacattcatgaggatcattcatgaaaccctaagtagccatagctattgaaaacctatgccagaaagttctgagtttggcataatgaaacagttgaaaacaactatccaagttgtacaaaagacaggaaacactatttgagggccctggagtgcatcaacacggggtggattctgggagctacaattcttgaaagaaaagaaggctatgcattgagcatcacattcattctggaatttttctgagggcatttcccacatcatctgcacataggtcaatttcaacaagaagctgaaatttatcaagaagaatcaaacaaatcccaggtaagataaacacaaagaaaaccacacctaagcacgtcatagacaagatgctaaaaaccaaaggtaaagggaaaatcagctagagggggaaaagacacattggctttcaaaagggtaacaagcaggctgacggctgactttccagcagaaactatgaaagtcagaagacaagagaaagaaaactttaagatgctaaaataaaaaacctgccaatctaggttagagcatatatccagtgaagatatccttcaaaaaggattggcaaagtaaggttttttggattaaaaaagcagagaaaattgtcaccaaccaaccagcattaagaaatacttaagggaggccaggtgcactggctcatgcctgtaatcccagcactttgggaggccaaggtggggggatcacttgaggtcaggagttcaagaccagcctggccaacgtgatgaaaaaaccccatctctaccaaaaatacaaaaattagtcgggtgtggtggtgcgcacctgtgatcccagctacttgggaggctgaggcaggagaatcacttgaacccaggaggtggaggttgcaatgagctgagaccatgccactgtactccagcctgggtgacagagtgagactccatctcaaaaaaaataaaaaatacttaaggagtcctctgcactgaaggaaagattctagacctgcacagaaccgtaggagggaacaaagagcacaggagagggcagagatgtaggtgaacataaatcaatactgcataaagccagagtaatgatatcctgtgggattcataacttatatagaagcaaaatatataacaatagcacatagggtaggagacggtttaacttttgtatacattttttgcattgtttgggacttggtaaaattattattaaaagatggaaagtagtaagtcaaagatgctatgtaatctgtaagacagcctctgaaagatcaacaaaagaatgtataactaagttcacatgttctcatccatttgtgggagctaaaaatgaaaacaactgaactcatggaaatagagagtagaatgatggttaccagaggctgggaagggagggtagtgggggtgggtgcggggaggaagtaggggcagttcatggataaaaaaatgtagttagatagaatgaatacggtctagtatttgatggcacagcagggtgactacagtcaacaataatttattgtacatttaaaaataaccaataattgggatgtatgtaatgtaaagaaatcataaatgcttgaggttatggacaccccatttatcctgatgtgattatacaatgtatgcctgtatcaaaatatttcatgcaccctataagtatatacacatactatgtacccataaaaatgaaaaaagaatgtataactaaaaagctagcagaggagaaaaatgggttaaacatagtttgttaaatcgagtgaagaaggaataaaagaacaaatcaatagaaaaagtgaaaaacgcatagcaaaatggtagacaaacctaactatagcagtaactgcatgaaatgaaaatggactaaacggtaattaaatgctattctaggcatttattgcatggtttaattgcaattgtcaatacagaaagtaaacgaaccttgtctatgacctaagtcctaggatcctatcaaggactgcctttctctaataagggccaatgagtccaatggatctaaaccatagatgagaccacgtgagagccaaacaagagggcttccttcagtggacacatttctagaagcttctggcagagactattgtatccagcttcaagacataaatgactgagcacagtggacatctacacacaaaaatctctggtcaaatagtgtaataatttaaaaaaacccaagaataaatattgctattagcttagtttgtgaatattttgatattttgatatttaatgtttacaccttgtacaaatgatcacatatagatccaacagatttaatggacatttttacactacagtgagcctcatcacacctcaggcttaaaagaatgataccaacaaaagcaggggtttaagtttaacactcaaatatgatgattattacttcagactcagaaaaaaacatcctgcttccccataataaattctcagactaatctgctacaaaagcgttcagcccccaaaatgctgcagatactgtttacggtgaggccactgtgaacaacacaaacaggaaataactgcctaacaccaattcttaaggtggcaaatacatgtatgggaaagtatacggggtaataatacagacgttagaaactgatcacgcgtgctgaatcaagttaattctgagatgaaagacactgatgctgcgtggtcaatggcagggagggatggagggaggaattaattaatttcagacagtatcggtccaacagagggatcgatgtatgtatgtacgtatgaatgacagggtctcgctctgttgcccaggctggagtgcagtggcaggaacatggctcactgcagtctcaacctcctgggttcaagtgattctcccacctcagcctcctgagtagctgggaccacaggtgcacaccaccacagctagctttttattttgttattttttgtagagacagggtccggttatgttgcccatgctggtttgaactcctgaactcaagtgatcctcctgcctctgcctcccaaagtgctgggattccaggggtaagccacctcccccagcccaatggcaaggtttatagagagaaaagccccagtgaagcagcagttcaatggcaaagagaacgttaagaatttaacgtgcaaagtggtatctcttctgcaacagaagataaaacaaccaaggctcacggaagcacgtggagtgaattaagaggccatcccacttcttgtcaacgagctaaggtgctacacctactggacttcaacttctcgttttccacataaaatgtgtatctctacagaacagggacactgcttcatttctcaaactgaaatcataagcacagcagctcacttcgtttttctgatggcctcaagcaccaaggctttctcgcgggctccttggcccgtgccagctgtgtggtggctgctcagtcacttaaccctctgtgagcctcaacatgctgttataaaatggggctaatggatatttcctcacaggtgtagggtgtggattgaataggctagtatttgaagatgttcagtatggtgctcagcactaacagccaagaagaacaaatgcttaaaatttccagtctatactgaccaaaccagaagccaacagaaatttcttctttttttcactttggagacagggtcttactctgttgcccaggctcaagtatagtggtatgatcacggctcactgcagcctcaacctcgtaggctcaagtgatccttatgcctcagcctcctgagtagctgggatcacaggcatatgccaccatgctcagctaatttttaaatctttttgtagagatggggttttgccatgttgcccgggctggtctcaaactctaggcctcaagtgatcctcctgcttcagcctcccaaagtgctgggatgaaagatttattcttttaatttcatccacatacactgttgacctgtccgcaggtcactgaggaagtctcaattccatccttcagagatctcatataatattccaaacggacatgatactcgtacaatgcattaaagagcagtgtcctgggtgagctcgggaggggcctgacgcttctgtggttttgccgaccttctttgcaataacgaggccttctaaaacttggctttcttaagaacacgtgcatggagctgtttataaagcaatttaaaatcatacttggaaaattctccataattatagacggcacagggtgttccaattaaccaataaacaggatacaaagaggactaacacaatctagttctaatttgcaggaagaaaccgctcagggatcttgagtacctttgaaaatttctttccttttaactgatacgcaatttgctcaaactatgattaattttaaagtttacattttaataggattttcaacacatttcaaagcaaatgtgataattagataagaaaagatgggaaataaaatgttcataggtaagtttttagaatagtgagcaggcccgagctgctctaagagactctggcagtctataccaaggagaacatctgtgttccccagaatgggaagctggttcctctgatgcctcactgctttctacacagcttcactctgattttcagtaattaagttgactgtgaagcttttaaaattaacgctgatatctactgcgtcaagaagggtccagcttctgaaatacggtcgtcgagactcttctccgtccaggcccaggcctcccttgccagctgcatgactccctcctccctgaactcatcttccatgcccctccaagccccagtactccttcgacttcagaagaacagttgcccaccattgccatggaaggactgttttctggaggaaatgcactgctccagaaataaaacagacataggaacatggggcctccaatgaaaaagatggctggcttactgctcttcagtgaagcccaccaagcaagaagcccacctgtgaacttggtatgtccatgccaactgttagcagtcactcttaattatgaatgaatgggcagccatctgacagggccttgaacgctgaagtcacacaagtcccagttttacacagatctcactagaagggttaggaaaaaaaaaatcttccaaaaagtggaatgaaaagaaaaattgaaaaaacaatgggaaaagaatattaaagatcaactcgggggtctcagagctgctcactgaagttccggagaaaagcaagcactgggaagaaaatgattgaggaaagaatgcaaggaaggctaggcacagtggcttcgggaggccgcagcgctgaggatcgcttgagcctcggggttcaagacccagctgggcaacatagcaaaaccctgcctctacaaaaaataaaataattaactgaatgtggtggtgcacgcctgtagtctcagctacttggaaggctgtggcaggaggatcgcttgagcccaggaactgggggctgcagtgggctgtgactgcactaccatactccagcctgggtaacacagtgaaaccctatctctaaaataaataaataaataaaaattctaaaaaagaaacaacgcaaggaccagagaactggatactaggagtgtcaggttctagcgggacgtcacctgcccggcaccatgaactgaccacaagacacatgatgatggaattttagggtaccaggtagaaagcgagagccacaaaagcttcagaggggaaaaataaaatcatatataaaggctggggattttaaaaaagcatcaaatttctctcgatcagcactggtagctagaagaaatggaatgatattagtaccttcacaattcttaataaaaatgatttctgttatagaattctagacatagcagtctacaggttgaacgtaagtgatatataaaatttcaagtaatacattcccacgcatcttttcttgggaggttttatggactcagtgtgtttggttcaacggctcaacaggttgtttctgtggaatatgacaagagtaaggcacaggagcaagagactatgtctttattgtcagtttttttggtaccacttgacagaaattgttaatatgtgctttgaaaaactctcagccactagtctgctctgctccagcacattcccgagcacgagcccatgtgtggcagggcttgccattctccctccctgttctcagcccgttttcatctttttagaatattcacatgctctcatctcttctgtccttgatgccatatcaagtgatcctatgtataaattttgcctactgaggaatctttctgcgtttcgattattatcagctatcccacctggtttcaagtcatctgtaaattagatgatgccatcaatgaaatcaatattcaagtcattgttccaaagctgaagagcgtggggcacaagaatgctctggcgtacccccagtttctcagctggggctccccagaaggcagagtgtatttgggaatgtgatgccagggagcagaagtacaggaagggaggaaggagacgggtgggcgggtgagtcagcgcaggacgcgttcctgagctgccgccgcagagcccactgatgctgatgccagtgggatcttcctaggactgcatgtagctgctagcttctatcctcccctggcggaggaagctggggtacatgggatggtcctgggctgagggccgtcccactgcccctgcacagagtgaggagtgctggactatgagttgatgtgaatggatttggaaatggcccacgagaggcatccaacacaattagaaaccttgctccaggtgttgactgagatttaaatattaattgatctgcttggctgccaagctgcagctctgcatctcatcctctgggacctcgtgccaggctctgccagcctactctagctggaatccagacgtgcctgtcatggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgattcatctggatcagaaatgagatgtggttcatgctgacaggtgctctccgcaactattgtgggctttagtttcctcgaatcactattactttacctcttccactttgaagatcattttccttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttactttacttttgatcatgtgctctgcattctgtattctctactcattcttcaaggtgggtggatcacttgaggtcaggagttcgagaccagactggccaacacggtgaaaccaagcctttactaaaaatacaaaagttagctaggcgtgttgttgcccgcctgtaatcctagcttctcgggaggctgaggtgggagaatcgcttcaagtgagccgagattgcgccactgaactccagcctgggcgacagagcgagactctgcctcaaaagaaaaaatagtgcttggcaaacagccacttatttggatacttgcttgtttttttgttggcattattcaaaatcacattgcctggaataatgtaaagaacaaaatgaagttgttctggattataacccaaaaataaatatccataaatccatactgaaatagatgactgaataaacaaacagatggagaagggacaaatctcccttgcagaaaaatcccaactaactcacgtagctgctcagccctcacggaggtgaagcgtcactccccatggctaagtgtgggctgtacgtggtgacttccttcttgggactatggcatggaaaggaggaagaagaatcatctcatggtggaaaaacctggcacacctcagccaggtaatggagagtggtaagtcacacaggcagtaagcaccctggagacggtatgatgaaaagggcactttacctctctctggtctttctcctccaaagccacatgcccagtctaatcatgataaatcatcatgcaaatctcagtagagggcattctggaaaatacctgaccaacactcctcaaaaccgtcaaggtgtcaaacacagggagtacctgtctgagaagctgtcccacctaaggaggcatgatgacgagacgtgatggggtaacctagatgggatcctccaacagaaaacggcattatgcaaaaactaaggaaatctgaagaaagcatggactttagcaaataaccatgtatcaatattggttcattaactgggacaaatatagaccacactaacgcaagatgtcaaaattcaactgggtgtggggtatatgtaaattctctgcactagctttgccatgtttctgtacatctaaaactcttataaaacacttgttaaaaaaaaaagctatcatttgtagagtattgctaaaagaagttacattgccactgtgaggaaaagcctggatcattcctaatgcttccccccaccaatcctagggtgtgaggattccattatgaagttttatttatttttgggcctctcataattctcgaggtgtcatcttttggaatcactaactgatgtggtttggctgtgtccccacccaaatctcatcttgaattgaagctcccataattcccacgtgtcatgggagggacccagtgggaggtaactgaatcatgggggggagtctttcccatgctgttctcatgatagtgaataagtctcacaagatctgattttttttttttttaagacagattcttgctctgtcgcccaggctggtgtgcaagtggtgcaatcttggctcactgtaacctctgccttctgtgttcaagcgattctcctgcttcagcctcccaaatagctgggaccacaggtacccaacaccaagcccagctaattttcgtaattttaggaggacggtttcgccatgttggccaggctggtctcaaaatccaggcctcaagtgatccacctgcctcggcctcccaaagtgctgggattacaggcgtgagacaccgcacccagcgatctgatggttttataaagaggagttcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtctttattggcagcatgaaaacaggctaatacactaactgatacctatctttctctgaattcctgggcttatctggaagggaaggggatgtcccccctctctactgtgccagtcatgaagttactgtctctctgctccatgcccatccctctaacttggcttggtgatgctgggactttgcagaccctgtttcggtgttgccaactggctctatttcaggttctgacaatacaggagtctagggagggactcaaagccagagcaggaagaagggcttgctcctcccgtcagcggctagcagggctcctgtctgcctgcagctcccgtgagctccacccaggcactgccttacctgggcaccgaggcacctcctgtagcagcggctgaatacagtttgttgttttcccattttgtgcaaaatgagcttcctcaagccccaactcccacccagagacataagcaccagctagaaggcacgcgccaggaccccctctcctccacgacactgtggagtacaccagactcacacagcatcatggtgaaacatgggtcactgagcctcatccccccgttttggattcgggtctcagattgggtctgatgagctgcgtttttaaaagttccagctgatgctgaagctgctagtctgggaatcagactttgagaacactgccttagaggtctttatttgtcctttcagttaccagttaatttagatccagttaacatttgcttatgttctttttctgttcaaataactggtgtggcttctgtctcctgactgaaccttgactgatcaagaaactggcaccacggccgggcacggtggctcacacctgtagtcccagcactttgggaggctgaggcgggcaggtcaagaggccaggagtttcaggccagcctggccaacaaagtgaaaccccatctctactaaaaatacaaaaaattagccaggtgtggtagtgggtgcctgtaatcccagctactcaggtgggtgaggcacaagaattgcttgaacctgggaggcagaggttgcagtgagccaagatcgtaccactgcacttcagcctgggtgacagaatgagaccctgtctttaaaaaaaagaagaagaagaagaaaaaagaaactgccaagactggttcccaggaacagaggacttggaattggtttcccatccatgggtttaacacagtgttgagctctttgtcagtgggaaatcagattcctgtaatccagggcaggccatggcattgtgactaaaaaagccatcatctgtgcctgtgatgacatttgtgtgccagggcccacatggccactgcactggccactgaggcagaagccaggaccaaaggactcagtatgacagcattctgtgagtgcgctggggcctctgagaaaacctcaagcccaggtctgggacctgcacccacagacagagaacccaacaagcctctatggcagtccccagagagtctatttcttgtagctacagggctgtttccaaaatcaaacacaaagcataactctgcggggtgtggatgcacaggcggaattggtggcatcaccaggtttgatgggaaagctgggcatggatctggaaggagtgggaccctggcaccggacagagggacatctgactggactcagatgaagctgagattccagattcgggagttcctccgagcctcccatggcagtgggaacagctggctccccagtgtctgagaatcacctttctttactcgaaagcccagtgacaggctttcctagggcagacgcctagcgtgggcctctcaccctcccacccttgccaccccttgacctgtaactggggacaggtttccgcatgctgcaggggaggaaaccacttatatgcaaaacaaactgtgagatcttgccatttcacagctgcagaaaccgaagaagtatgtatgggaataggtgctagtaacgttaggacaaagacgagaaatttaacactagtttggtgggactgattgctatgagtggtcttatgagaaattgttcattaacattttgtgcacgcagccggcagtggctctaaccgctcacttggttgactgcctgaagtgcagggcactgctgagtccgtgtttaatgaggctgagatgccaggcttctgtggcacagtgaactatacaggaggaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggctgcggcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacaccccagaacggcctgaaacactggagacacccctccaatgggagcttcaagttgtcactccacactccacctgccactgcaaccaccaggcaggtgttttggaggcaacatgcaccacatgtgtacgtgctactctgacaccggtactgagtgacactaaaagctgttttcagagaggcccagggcacgatcaggcatgtggcaagtccaggctgctcttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccaaacaagctagccacgagatgcggagaccatgcaacctgagctccccatcacgaacagggaactactaggccccccaagccgaatgctgagcatgcacagcgaccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggctggcccctgctggcactgcacagtgtggctcttgaggacagtggggattacatcccccagcaggcagacctcccagttggacatttgatttccactttatcaggactgagatggccaggacatatctacatggatccccagggtgattccagtattaaaccgaggggaatctcatggaacccaactgcagggagtccagtcggcctctcaagagaccgaagatggaagcagaaaagccaagcccgagactgctcttccccctcattctggtggcacaccctcgcattctgctctcctctcattggctctgttctactcctgtctgcgcacactctttcagcttccctgcaagtggctcgccttggtccctagagcagttacggctctgatgacgtcgtatcctcagagtaacgtggtcattttgagtactgttctgcagcttactttttcttttcctaatcaatgaatcaatgaatatactcttgacaaacattttctccattatgcagtattctattatatgcctatgcgaggatttatttaactggtctcttaggttgttttgggtacgcggctattttgtttgctttcttagctcttgagggtgtgtcaatggctattactgcagcctgtgtctagaaaatactcaaatcaccccttttcaaatacatctttttaccttgacttaaccaatgccaaacaactctctccccctatttccatggtaatgcatctcagctcctctcaacttagaggctcacaggataaacggcttcccggagatgatgctcacagctcctcttaattacggaagtgatatttactggatcagtcaccttggacatccataaggcattgcatttttcatgtattactcacttgactttctctagggtttagccaaaatgagtaatacatggaaagctgggtaaaagtcaaatcagctgttacttgttattattattttttgagagtcttgctttgttggagtcttgctctgtcatccaggctggagtgcagtggcacaatctcggctcactgcagcctccgcctcctgggttgaagcgaccctcccgcctcagcctcccgagtagctgggactacaggtgacttctaccacactcggctaattttaatttttgtattcttaacagagacggggtttcaccatgttggccagggtggtcttgaactcctaacctcaagtgatctgcccgccttggcctcccaaagcgctggaattacaggtttgagccactgtgcccggcctactgtcgcttatttttaagttggtagaaatgccggtggtcagaaaatctggtattttaaaaagtaaaccttctgggggatgggcgtgaggctgaaataggttgagccagtagttcctttattttgggaattcagaacttctcattattttgttattgaaacatgtagtcacagttctcgagaccgcatctcttaaaacaactgcctactgttttccctactataagattgtatttggatgcttccttctttgtgtcaaataatcaagaatcttagggttttaaaagtgactctgaaggttacctggtccaaagtgaactcagcaaagaacataaagccaatttgcaaaaatcaattgtatttccatacgttaacaagaaacaattggaaaatgaaattaaacaaaagcaaagtcatttttggtcatcctgtaagtcctgggtggcaggcacagaatacaggtaaggggctccaagagcccggggagccctctgaggacgcacggcaggtgtggggcatgggaacagaagcaggccacacctgggggtccctggggaggtctaaagggcctggtggagcaggaagagcctggaaggatcatctaaggcagggctatgggagggggtggatacactccagggcacctttcagctggtgctcccgaaggctcaggctgaggcagcccttccagggcccttgctgggtgtcttcccctgccctgctcttcctctgatcccttcatgcttcctcctgggagtgcatccttcataaacccatgaattcttggtttagcatttacttctgaggaactcgactgaggacaatcctacttggaaaatatttatgtagaaacaatacactaaatgtatacgcacagatatgtgtgtagacacccatttgattacactgaatgtagtttgatcacggtattgagtatattatttaggactttttgtatgtgattataagttacattgatataaagtaagttgcaatacgcataattttaataccaaaatgttaagattcaaattttctgggaaaagagatcggtaaggttcttctttcaaaagattgcccatttttgtgattttcttcttttttaccaatattatttcaaatttatcatatgttctactaaataactaagaaagaccatgaggatatactgagcgaggccatacagtttaataatgaacagcttaggttctaacacacattagacaggcctgtgttcaaaaccccatcttgtactagctctgtggattaggtccttaaattccacaacaacttgtggactaagctttctttttcttttttttttgagatggagtctcactctgttgccaagctggagtgcagtggcacaagctcggctcactgcaacctctgcctcctgggttcaagcgactctcctgtctcagggtcctgagtagctgggactacaggcatgcaccaccacacccggttaattttgtatttttagtacagatggtgtttcatcacgttggccaggctggtctccaactcccaacctcaggtaatctgccagcctcggcctcccaaagtgctgggattacagacgtgagccactgcacctggccaaagctttctgacttaagttcttaaactctataatttgagcttccctgtctttaggaagaagacagtaatagcacatttcttataaggttgccaagatgttgagaattcagataaaacctcagcacagtgcccgatagtgcaaaggactcaataaacgtttgctggcattgctggttttaaattactgtataaagtagtagccatccaaaaaataccaaaaaattcatgaaaatggagtacacttacttgtaatgtagtatcaaagacaacaagctttgaactggttggaacgatgtcataacacttgtgtgacctcatgaatcgcatgtaaacaccactttctgagtcttctactgctaaaagaaaaaaaggcaaaacatcagtaataataaagaattccctcaatcggatgaagagcatatacgtaaacctatcactaacagacttaatggtaaaatacgaaatgttttcccagtatgatcaagggccaggcaaggatgctcactctcactaattctatgaacactatattggaggtcccagatggtgaaataaggcaagagaaaaaaatgaaaggcatacatgttgaaaaggaaaaagcaaaactgtctttatgtgcacactgtatgattttctacataggaaataccaaagaatctagaaaaagttcctagatctaaaaagaatgagtttagcagggtcatagaattaaatcagggttaataaaacaaagacaaagctaatcgaatggggaaaagttggaagctttcccttcaagatctggaacaaggccaggtgcattggctcacacctgtaatcccagaactctgggaggctgaggtggaagggtcacttgagcccaggagttcgagaccagcctgggtggcatagcaagacccagtttctacaaaactaataaaataaaataaaaataaaaataaaggggaaaaaaaagaccaggaacaagacaagaatgcctgctgttgctactctgttcaaggtagtactggaagtccttgtcagagcagtcaggcaagacaaagaaataaaaggcatccaaatatggaaacaaggaagttaaattgtccctgtttgcagatgacataatcttatatatggaaaaccctaatgactccatcaagaaactgtcaaaactaataaattcagtaaagttacaagatataaactcaacataaaaaatcagtagcatttctatacactaatagacaactatccgaaatagaaataataaaagaatcccatttacaatagctacaaaaaaacaaaatactcaggaattaatttaactcaggaggtgaaagacctctagagtgaaaactataaaacactgatgaaagaattgaagcagaccaggtgtggtagcacgcgcctgtaatcctagcactttgggaggctgaggcaggcagatcacctgaggtcaggagtttgagaccagcctggccaatatggagaaaccccgtctctactaaaaatacaaaaattagctgggcatggtggcacaggcctgtaatcccagcttctcaggaggctgaggcacgagaattgcttgaacctgggaggcggaggttgtagtgggctgagattgcggcactgcactccagctttggttacaaagtgagactgtcaaaaaaataaataaaaataaaaaaaaagaggaagaattgaagaagatacaaataaaagggaagatatcttgtgttcatggattggaagaatattgttaaaatgaccacactatccactgtgatctacagattcaatgcaatgcctatcaaaataccaattcttcgcaggacaagaaaaaaaaaatcctaacatttgtatagaaccacaaaggaccccaaatagccaaaagaattttgagcaaaaagaacaaagctgaagatatcacactacctgacttcaaaatgtactacaaagctataataaccaaaacagcatgaagctggcataaaaacagacacacagacaaagagaattagaaagcccagaaataaatccacacattacagccaaatgatttttgacaaaggttccaagaatacacaccgggcaaagggtggtctcttccataaatggtgctggaaaacctagatatccacatgcagaaaaatgaagctggactcctatctctcatcagatacaaaaatcaatggaaaatagattagagactgaaaatctacgacccaaactacgaaactactagaagaaaacataggggaaatgcttcatgactttggtctgggcaaatattttatggataaagcctcaaaagcacatggaacaaaagcaaaaatggacaaatgggattatatcaaactaaaaagcttctatcctgcaaaggaaataatcaacagagtgaagagacaacctacagaatgagagaaaatatttgcaaactatacatctgataaagggttaatatccaaaacagattaggaactcaaacaactcaacagcaggaaaaaaaccccaaataatctgattaaaaaatgggcaaaagaactgaatacacatttctcaaagaagacatacaaatggccaacaggtatatgaaaaaatgtccaccatcgctagtcactggagaaatgcaaatcaaaaccacaatgagatatcacctcactccagttagaatggctattataaacaaaacaaaacaaaacaaaagatgagtgttgctgaggatgtggacaaaagggagcccccccccccgctcttttattgaactattggtgggaatgaaatataaattagtagagccattatagaaaacagtacagaggttcctcaaaaaattaaaaatagaattaccctatgatccagcaatcccactaccgggtatatacccaaaggaaatgaaatcagagtgttcatgacacatgtgcactgccatgttgagtgcagcactattcacaacagccaagacatggaatccacctaagtgtcgccaaaagatgaatggataaagaaacgtggtacctataaacaatggagtactattcaaccataaaaaagaatgaaatcctgacatctgtgagcacaggatgaacctagaggacactgtgttacatgaaataagccaggcgtggaaagacaaataccatcccattcatctgtggaatctaaacaagctgatctcacaggagtagaaagtagagagtggttaccagaggctggggagggaatggggtgggggtatgaggagaggttggtcagttacagtcagacaggaggaatgcattctggtgttctattgcacagtggggtgactatagttaacaataacgtattgtatagttcaaaatagctagaagggaggattttgaatgttcctgccataaagaaatgatacgtgttttaggtgacagatatactaattatcctgattttatcagtacacaatatatacatgtactaaaacatcaaactgtatcccataaatatgtacaattatgtgtcaaccaaaaataaaacttaaaaaaaggaaaaaagtacaataaagcaaatgcaaatagaaaaaaaaggctactatatttgtatctactaactcattgttagcagacagaaatttaaaaaaattttaaaggtactatttacataaatgctgtatggaaatacggacttacacagggaacagagagcactgaaaatggtaacaatgtggacaaatatacaaatgctttcaaaaattatttaaatctctctaaaagctaattgacaatttatttttttatgtattttttttttttgagacagagtttagctcttgttgcccaggctggagtgcagtggctagatcttggctcactgcaacctctgcctccaaggttcaagagattctcctgcctcagcctcccgagtagctgggattacaggtgcacaccatcacacctggctaatatttgtatttttagtagagacggggtttcaccatgttggccaggctggtcttgaactcctgacctcaggtgatcttgcatggctcggcctcccaaagtgctgggattacaggtgtgagccactgtgcccagccctaactgacaatttaaacaaaaataatgacaatgtattgtggggttgatagcacactgataaggaaaaggcaacaccgtccaaccaatcatggaaatctaggagtcacccttgccaatgtcctcttgtcaccctaaccaatttatcacaatgccttgattttgcaccccagaaccctcaaatccactcatttctctgcctccatggccaccccctacatatcctaacttcctcaccaatccttctgccccctgcatcttccacagctgtccacactgcatccaggaagattttgccagatgcaaatataatctaatccagatgctttagaataaaggcaaaacccttgaagtcacctagaacagcagtccctaggactggttttgtggaagacaatttttccactgggggtggtagtgggtggtttcaggatgaaactgttccacctcagatcatcaggcaccagattctcatcaggagcacacaacctagatccctcgtgggcacagttcaccatcgggtttggactcctatgagacactaaagctgtccctaatctgagaggatgcacagctcaggccataatgctggctcacccgccccttgcctcctgctgtgcagcccatttcctaacaggccagggaactgtactggttcatggccccaggattggggacccctgacctataagacctgggaggcctggcccccgcctacctccctgcctcttgtattaaacactcctgctccgtattttctccaaccccctatttttttccagtcctccatcagtgctctgctgtctcttccatggggcctgacactactgcttcctctgcctgaaatactttctccgtctgtttgtggcccagtgaactccttcattagaccttggctcaaggatatgactggtgagtcatggaacctgaatttgaacttgaagcctctggattccaaagctgtgttctcagccaagctgatccccctccttccctcggcccgccacaactgctttccccgttctgccgaaatccttccctattttcatgggtcagtccaaattatgccatctgcaagagacatccttgacagctccattcagcccacaccgatctgtgcattttaggaagatctggactacttgggaaatatctgagaagaaaaacatgtagtgtataagctaattagcaaaacaagtgttaaacaagtgatactaaccaagctctttggctgtggaaaggagccccacaattttgtatatttcctactgtggacatccatgcagctggtttgccaatttcatgacaaatgatgtggaccactctcaagtctattttcattctgacctctctttgggatattacaatttataatgcagagttttgtcactgcaactgcctcctggatatttctctctcaaatgtctccctcctgatgtggaataaattccagacgtctcctgtctcattcatgcatctccacatctggcttctccgcagccttatttcccagctcctggtttcatgtctaagcaaacggtctccctgtcagtctcctgtagcctttgacctctcccttcttgcccttgttcactcacttgccttaaacgtcctcctccttgacttttccttgttcaatttcaatccaacctcaacggacatcttttcccacaaaagaagtgaacgtctgagtgctcattacggaccaggtactgcaataaatcacctcacttaactgatgtgacaacctcgaggaatacagcttcattttttcattttacctctgaggaaaccgaggctaggagaagctgcgtcacttgccccaaatcagacggtgaagtagtgacccaagcgggatttgaagctctgtcccaggctccagtagctccttattaaactcacttccctcactcaacggtgcgctcatctgagcgcacctggggaggacccctgtgtcctgggccctgtcctggggttacccacagggggacacaatgaccggttatccaccctcaaagcttatgcatcagcccagggtgagcactggatcacctgagaacacacaggtgggtcaccaaccctgacctggaaagggtaaggaaatctaaaatgacttcttcccctgaacgccaacagcattttacttctgtctcatcagttattaccttctatctcgttaacagtgactgtgtatttctaatatttttttccttcctgggtgataatttatttgaatgatcagtatcttactcaagtaatccatacattaattcagtctataaatatttattgcatattgtctagtgtgcattcctcccaaagctgatcctgagaccatggaaagttaggggaggaaaaattcaaaagaaagggtgcccagtaagcaggttataccttcgtgaccctggagtgaagctatgagggaggatgctctgaggctgtacagacctcagaactgtctcgtgggaggaccactcctgccctgcctgggttccaggtaattcctgggacatcacccccgtcatttctacccacaagcccagttgccaaagaatgtcctggggcagagatgttgaaatatgagaacttggatgagacaggattctggtgaggcacccgcagcatccactgtgcgagaggcggggatgccgcagggaagacaacaaacacaacccttgtccttacagacactgcaaaccaatggaggggacagtgactgtcatcacactgccaccagcactaccaaggacaagctcggggttcgtgaatgaatagcagcggctgtcagggagggaacggatggacagatgaagtttcagttggtgtgctcccatgtttctcaaaacactgatagactagacagtgagggccctgcttaagaaaggcctgaaacagcaagctctcatgagagcggcacagagagatctggtccgtgtccgccatcgctgctaaggatgacgctcctcgcgcagccgcatgcgcagtctcctcatgcctactgagtgtggaattggcgcaaaacaaaagccaaagatcagggcagtcaagcatacattcagccagtatttaagttacaaattgcctgccaaatctaacatcctaaaattcaaaagcaagaaatcaagagggaggctaagtatagtaaaatgtaacaaaccatctcccagaaaggaaatctcagaagataattttgttcattcattaaatcaagaattttcataaaagaggtacacatattatagacatattatacatgttagtattactatatgaatatgtgaaataattgaaaataatatagggcaggaatgttcaaacttacagaatttttgaaaatctgtaagtttggtgttagattatatttttaatataccattttaatgtgttgatttctaaattatttcaatgaacattgtattttgaataaatatatgttccagatttacaaaaaagttgcaaagctggaacagttcctatatactccatatcaggttcccccaagtttatcatcttacgttattgatatggtttggcttcgtgtccccacccaaatctcatcttgaattgtagttcccataatccccacgtgccaagggcaggacctgctgggaggtgattggatcatgggggcagtttcctccatgctgttcttgtgatagtgcctgagttttcaggagatctgagagttttataaggcagttttctctgccctcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggagggacacgctccatcctcaccgcacacggagggacacgctccgtcctcaccgcacacggaggcacccgctccgtcctcaccgcacacggagggacacgctccgtcctcaccgcacacggaggcacccgctccgtcctcaccgcacacggagggacacgctccgtcctcaccgcacacggagggacacgctccgtcctcaccgcacacggagggacccgctccgtcctcatcatcatactgagggtacacatgccttctcatcccatcctatccagggtgcctaaaatcaacgtgactcatcaccttaatcacctgagtgaagtcatatttgtcaggtttctccaagtagaggtactctttccctcctcctttatgtactgtaatctttttaagaaggtcactaggacccctcacttaatggcaaggagttatgccctacctccttgtttaaaataattatgtacaggagagttatttatttatctgatcatttattcatatcagtgtagactcatggatatttacttcaacctaggtataatccaatcctaggttaggagcggtcagaggctgtgccccagccagtcaggcacccacctgtggctgatggactggtgggtggcttgtggagccctctcctagttaagacagtttccaagcctgccatggcttagactttctggcaggtcctccagcactgccttcacacacaggcagccccctagttggctggggagctgtgggagtgtggcttggtgctccctgcgtgggcttcctccgtcatccagggaggtgtgcagagctgggctctcctgcctctgtcctgcatgcacacagcctccagggcagctggaaatgtgtttccccatcatcaacatcttgcattagcatggtgcagcggttatagttaagcagccaagaaaatcataatgaatgtgtctaggtacagtggctcccacctgtaattccagcactttgggaggccgaggcaggaggagccctggaggctaggagtttgagaccagcctgggcaacatagtgagatcccgtttctacaaaacataaaaaaaattagccaggtgtggtggtgcacacctatggccccagcctactcaggaggctgaggtgggagggtctcttgagccaggaggttgaggctgcagtgagctgtgattgtgctactgccctccagcctgggtgacagagcaagactctgtcacacacacatacacacacacatacacacacaccccaacaatgtattaacaaaagtctccacattattcagatttccttattttttccttaatgccctgtgtctgtctcacgatcccgtccaggattccacatgatggtcgggagcatctcctcgggctcctcctggctgcgacagtttctcagaccctccttgttgtgatggccttggaagctttgaagttctgatgaggcactttggaggatgcccattggctggaagaggtctcatgcttttctcaagattagaacctctgtaactgggttccaggtttgggggaggatctacgacattttttaaaaatataaagcactcgaccaaacaaagtaacatgttaaatatttacttatttatttattttggagacagggtctcgctctgtcacccaggctggagtgcagtggcacaatctcaactcatcgcaacctccacctccagggttcaagcaattcttgttcctcagcctcctgagtagcttggattataggtgtgggaaaacaagcctggctaatccttgtatttttagtagagacggggtttcaccatgttggccaggctggtctcaaactcctgacctcaagtgatctgcctgcctgagcctcccaaagtgctgggattacaggtgtgagccatcacacccagccgtaaaaggttaaatatttaaaataaattataataaaccctctttgaatgtgtaaaaccagttaaaaataattttaaaaacaaaaataaaatttataataaaatttctttaaaaaatttttttaaattaaattttatggctgggtgcagtggctcacgcctgtaatcccagcactttgggaggccaaggcgggtggattgcttgagaggccaggagtttgagactatcctgggcaacatggcgaaaccccgtctctactaaaaatacaaaaattagctgtgcatagtggtgcatgcctgtaatcccagctacttggcaggctgaggcacaagaattgcttcaggccaggtgcagtggctcacacctgtaatcccagcactttgggaggccgaggtgggtggatcacaaggtcatgagatcgagaccatcctagccaacatggtgaaaccctgtctctactaaaaatagaaaaattagcctggcatgatagcacgcacctgtaatcccagccacacaggaggctgaggcagaagaatcgcttgaaccctggaggcggaggttgcagtgaactgagattgtgccactgcactccagcctggcgacagagcgagactccgtctcaaaaaaaaaaaaaaaaaaaagaattgcttcaacccaggacatggaggttgcagtgagctgagattgtgctactacactccagcctggggaacagaatggtactctgcctcaaaaaaagaaaaataataattaattttaaatagagatgaggtcttactatgttgcccaagctggtctcaaactcccaggctcaagtgatccacctgccttggcttcccaaacttctgggattacaggcgtgagccacctacaaattataataaaatttctgttgagtgggaataaggacagattattactgatgtaataaaacaacatcaatcacaacaaaagtataagctttttaagctaggaaaatacagtaaaatataaaacgttcctttttaatgtcgcttttctacttttagtataaactttacgattataggtggcaccatctgtgttagttacattatggtgaagtctcacattgtacttggaggaagaaataaattgaaacagagtgaaaatgagtgtaatttggagttatacaacaacaacaacaaaacccacccaaattgttcaacaacaggctgtttaaaatatattatcaaaattccttggccgcgtgcggtggctcacgcctgtaatcccagcattttgggaggctgagctgggtggatcacctgaggtcaggaattcgagaccagcctgggcaacatggtgaatccccatctctatgaaaaatacaaaaatcagccgggcgtggtgacatgtgcctgtaatcccagctacctgggaggctgaggtagaggaacggctggaacccgggaggtggaggctgcagtgagccgagatcctaccactgcactccagtctgtgcaacagagcaagactccgtctcaaaaaaataaataaaataaaataaattatcaaaattcctgagagggcaagaagttccaactccatattcaaaagctaactgaggttaagatattaacacaatgctcccttcttgcttttgatattttcagtgttataggatagaagcataattacagagtatcacactgggacttgagttactgctctacaaaaggaagaaacctgtttgcagactgatgttaaatctcactactctttaaacagatgccaacccaacattattatgcaagggagttgctaaagaagaatatgagtaagtagcaagtttatattaaagtgtttaattcataaaggttaataacaaacttttacaaatgcaacatctaagtttaaatgcaagcaattataaacactaaattgaaatattggaagtatttctcctattaaaaacaaatctgattacataatatgcttgtttggtacctttgtttgtttttttgagacagggtctcactctgccacccaggatggactgcagtggtgcgatcatggctcactgcagccttgaactctcaggctcaagcaatcctagcagctgagactacagatgcctgccattacatctggctaacttttttattctgtatttttttttttgtagtgatggggtctcactatgttgaccaggctggtcttgcacttttggcctcaagcctcagccttccaaagcactgtggttataagcatgagtcactgtgcctggctgctcgtgtcctccctacctacacaatataccctgtatcattcaaggttctagaactcgaactctaacctacctttccagcctcatctcctatcacatcccctaggaatctcatctctaggatcatttcaacatatccttttcaaaggaagggtttgaactttgggaaatccagttttgagaatgcgttcctcatgcttctgttctgtgcctctgcacacactattctttcttcctcaacagtgccttccctgttctcctatggtcacctgacatcctgcttgcctttctgcagtgggctgaacagtggcctccgcaaaaagacaggtccactggaaacatcagaatgagaccttatttgcaataagggtctctgcagatgtaactaaggtgaggatctggagatgaggttatcccggattagggtgggccctaaatccaatgacaagtgtccttataagagagagagagaagatgcagcgcggcacggaggggagggccacgtgaagacaggtggaggctggggcgacgcagcgacaagccaaggatgccaaggactgccggcaacagcaggagctgagggcagcgtggggcggattctccctcagcctccagaaggaaccacccctgctgaggacttaggaaccaaccctgctgatgacttactccagacttctggcctccagaactacaaggaaataaacttctgttgtctaagccaccaagttgtggcatcctgggaaactaataggccttcaaagttcagttcaaaggctacttcctcccataaaaccttccctttgagcccctcaggtcggaattaactgctccagttttgacatgcctgttaatgcttcgtgagtcacacacaccttgtactgaagttacaggtctgttcttcccttagacatgcgcaccggggggcagcagtggacgtcccttgctcttctctataatccaggcccctggaaggttcattgtagatatcaggcatgagttaatgcctggtatcttgcaagtcactgaagaagcacagatcaaatttgagaggggcaagtacggatctgagatgactatattgtgttcctgacctcagagaggaaatgtcagcaaatgaagcacgcaggtttaaaagaacactggtgaatctagatttaataaccagtataaaaaaacaaaacaaaacaaaaacctttatatacctttataagattaaaggattacctttatattcctttataagattaaaggattagacatggatttttttttttgtaagagaaataatgcacctatgaaagtgcctcatgtgatttttttctctttctttctttcttttttgttcaagatggggtcgcacactatgttgcccagcctggcctcaaactccttggttcaagggattctcccacctcagcctcccacatagctgggactataggcatacaccactgcaatttttgtttttttaagtgaaacagcattgatctaaataaagctttaacatgtttacaagtatattttatattgaagctattttctaattctattagacaaaaaaatgcagttgaattgaataagattgcagaagaccttcaaatgttcattctaccatacacattttaaaaacacctgcaaatacagcaaacaactggacaagtatgtttcagagataagcactacagtcatcaattactttttctgaaacccatttacacagaattttaatttagaaagaatttatataaaaaaaatgtgttgtaagacggtgtaattctttggtcttcttggccttaattctatgaaaatgaacaagacagactatcactaatcatttattagtcaggcaaaaatactaaaggataatttaacagacacataccagtatgaaattcattttacttatacaccttaatcaaactaagagcaggatagtgactcaaaatggatttcaacgtgtcctatttataaaaataacaactgctaaaataatccactactaaccagacagttaccatcaatctgcccgtcccaggttctctccccactgatactggcaacacccacacagtgagggaatagacgccccgagaagcagagcgtgaggactcacttcccaccctcaagttccacacttcttttggtccagtcctggaactcttgtttagtctagaaggaggattgtcccatcactcctgggaatggttactccaatttcagaaggggttggcctcaactagaaaaggaagcttctaacgtgagaagaaaagaagaccttctgagaaaacagtccaggcttagcggttccgtgcccaccatttggggctccctcaccacacgatctgggtgactgactgcagacacacctctcctgccatgagcagcacgaacttgctgacctagtcctatcacctgtgtagctggctctaccccggaggctgccaacaccacctttatctcatgctccacattttaatatgtcaacatacacagggactgctgcttactttccagactataagaaccttagtgtggctcacatctgtaatcccagcactttcggaggccgaggtgggcggaacacgaggtcaggagatcgagaccatcctggctaacacggtgaaaccccgtctctactaaaaatacaaaaccaaaattatccgggcatggtggcgggtgcctgtagtcccagctacttgggagactgagacgggagaatggcgtcaacctgggaggcggagcttgcagcaagccgagattgcgccactgcactccagcctgggcgacagagcgagtcttcatttcaaaacaaacaaacaaacattttagtgtgggctgggcgcggtggcttacggctgtaatcccagcactttgggagaccgaggcaggcggatcacgaggtcaaaagattgagaccatcctgaccaacatggtgaaaccctgtgtcaactgaaaatacaaaaattagctgggcgtggtggtgcgcacctgtagtctcagctactctggaggctgaggcaggagaattgcttgaacccaggaggcagaagttgcagtgaactgatatcgcgccactgcactccagcctgggggacagagcgagactccatctcaaaaacaaaaaacaaaaaacaaagccttagtgtgttagcatattataaatattttttcttttctttttttttttttttttttgagatggagtcttgctctgtcacccaggctgcagtgcagtggtgcaattttgccttctcctgggagtggtgcaacctccatctcctgggtttaagtgattctcctgccttagcttcctgagtagctgggatttcaggcgcccacccccatgcctaactaatttttgtactttttttggtagagatggggtttcaccatgttggccaggctggttttgaacctctgaccgcaggtgatccgtccaccttggcctcccaaagtgctgggattacaggcgtgagccaccacacccagccaatattttcaattcaaagttgagaaaatggccacagggagctctaaataagtcattttttatattctctgcttttaagtcaaaagaaggaacagagaagagatgcgtgcagggtgggagcagagcacactggggtcagaatgccaaggaggacttccccatctggaacccacacacagagagcagcggagtgctgatcgatggttacacccctcggcatcttcctctctgtattctatacccattatgcgaagattttgtccacagaaccaccttcgtttactaagcaatgcttgctgcggtttcaaaggtgctcagatccagggcggtgcagcgcttgccagaggccgccctgttccaggatccgttcctcagcttcatgcttaattttgtaaccatcagtcttctagggacttggtgattcaagtgaaataaatcagtaagtgatgaggaaactgaaatatcaattaagtggtaaagagatggaggccaggttagtgagcacagactgagaaaggaatgatctgatccatgagtgaggcgtggatccagcagagccgagcccaccccatcccaccaggacaagtggcaggaaccgcagggaaagctggaaacacaacagctttcttagaaaagacgttggcgcacttacgtggggtggtccagatctcacactcatcatctcagacaacattaagatggtaaaaaagcagtctcgggccgggcacggtggcccatacctgtaatcccagcactttgggaggacgaggcgggcagattacttgaggtcaggagttcgagaccagtcaggccaacatgaaacctcagctaagatacaaaaattagctggacgtggtggtgcacacctgtggtcccagctactcgagagactgaggcttgagaatgtcttgaacctgggaggcggaggatgcagtgagctgagattgtgtcaccgcactccagcctggacgacacagtgagactccgtcagcaccaatgtgttactcccttcagcactttctgtgctcccttttgtgggaggacagcgacaccagcatcactaaaggagctgaattaaatgcagtgcttttgactttggacttacatgcagagagaaagaggagagttgagtaacatgctcagcctgtctctccccaggatgcccatcctctgctgaacctgcccgcaggtttgggagccgctgagtgcactgcagagtgagcgtcagctaccacagtcccttcttgcagggtgttcctagtttaatccttatctgtacttgtgaaatggaaggtttatgccttgctagagagcttttaggtataaggcttgtcaactctaaaatcacactgcagagacctgcagtgtgcctctcccctactgacccacacaggtaggggacagagttggaggccccaagcacagagccctgcctaggcaagacactgccactgctgctcactgtgaagcaacctggggaaccccctgcttccacctgttctgtcccatcagcaggcgtaggggctgctgccatggtctggttctgccccccatcactccaactctgtgcactgcctggcggttgtcaccagtccaggggtctgaccagcgtacccacctctgcctgctcaccttcatagtgcacagccccatttctaagatgatgctcagcgagtgaccgtctatgggaccattcccaaaggcacaggtgcatggggaaccccaagaaatagtgcaataacctgaagctgttaccagccctagacctggggtgaggaacagttacaaaacctggaaggagagagtttcaggtagagccagtccccttgggtggggcagcgaccttcattcgagcagtccagccaggtagcggcagcctcccaggatgagggagctacaggagtaaccacctgcctcctctgggggctcctcactggctaagctcaacaggaccccagaatacgggagcccagccgatgtgtcccacactcagcctccctggtgagaaagacaggtgaggcagggtgaaaatgggacctgggggcaaacaggagctacctgcggcactctaagactgggcagatggaagaaagacagttggggttgacgcagtatcttctacaataacgcctgaaataacttaaactttgttttcagaaattattatttgtaatagcaataaaaggcatgaacatgttttccaaaaataacaacagtgatatacacaggttgagcatcccaaatctgaaaacctgaaatctgaaatgctccaaaatccaaatttttttgagcatccatactacactcaagggaaaagctcatcagagcatttcagattttggatttttgaattaggaatgctcaactggtatgtatgatgcaaatactcaaaaatctgaaaaaatactaaatctgaaacattcccagtcccgagcattttggtttttattttatatatgtttgagatggagtctcgttctgtcacccaggctggagtgcagtggtaggatctaggctcactgcaacctctggcttctgggttcaagtgattctcctgactcagcctcccaagcagctgggattacaggcacccaccaccacgcctggctaatttttgtatttttagtagtgatggggtttcgccacgttggtcaggctggtcttgaactcctgacctcaggtgatctgcccagcttggcctcccaaagtgcttacaggtgtgagccactgtgcccggcagcagtcccaagcattttttttttttttttgagatggagtctcgctctgttgcccaggctggagtgcagtggacgatctcggctcactgcaacctctatctcccgggttcaagcgattctcctgcctcagcctcccaagtagctgggattacaggcgcacaccaccacccctggctaagtttcatatttttggtagagacaggctttcgctatgttggtcaggctggtctcgaacttctgacctcaggtgatccaccttacctccaactcagacacccccgctccagtgaccaactctctggtctcactggagccgaccaggaggtgccccgttcccacggctatgctgagcgccccagccagcactccaacacggcctgtcaggggaggtgacgctgtctccagctgtgtcttgaaggcaggaaaagggattccaggcagaggcctgagcccctcagatctgagggtatcctcaggagctcgcaggggacatggggcaggggctggcaccccatggcgatgggggagcagcagcagggtggcagggaggccatggggtcggttacgttgggcgcttggcatgtgctctgtactactttatcctggaggtgaccagaagccacacaggggctcacacaggaggctgaaaaaatcagggctgcgtggacgctcagtcagaggagaaaagaggcagagcagtcagtggacgtctctgagaccctgctccctccatcgtgactctccgtcccatccctgcgtgctctccttcacctccgcccctcaccagcttgcttcccgctctctctccccatctccacttgaccttgtggtggttcactccactccactgcctttctttcagagcaaacagctcgcagtgatgatctgtggccctaagcccactttgccaggaccgctccagttcagcaccatggaatgggactccacctgggccttctgagtccccatcaccagcaaccacctggcactaatcacaatggcttttctgcaaactccttgccgaccactgatcacttggcactgggctctcagccccagtctcctcacctttacactggaacaaaagagcctcaaaggggccatgtggatccagagggaacctcgagagaggagccgtgtggatctagagggaacctcgagagaggagccgtatggatccagagggaacctcgagagaggagccgtgtggatccagagggaaccccgagacagaagccgtgtggatccagagggaacctcgagacagaagccgtgtggatccagagggaacccccagagaggagctgtgcagatccagagagaaccccgagaaaggagctgttttttgttcctgcattagtttgctaaagacaatggcttccagctccacccatgttcctggaaagggcatgatctcattcttttttatgcctatatagtattccatggtgtatatgtaccacattttctttatccaatccaccactgatgggcatttagtttgattccatgtctttgctattgtgaatagtgctgcaatggacatacacatgcatgtgcctttatggtagaacaatttatattcctttgggtatccacccggtaatgggattgctaggtcaaatggcaggattaaagacttaaatgtaaaattgaaaattataataacctggaagatgacctaggaaataccattctggacatacaaatgggcacagatttcgtgatgaagatgccaaaagcaattgcaacaaaggcaaaaattgacaagtgggatctaagtaaacttaagagcttctgcacggcaaaataaactatcaacagagtgaagagacaacctacagaatgggagaaaatatttacaaaggatgcatccaacaaaggtccaatatccaggatcaataaggaacttaaacaaattgacaagaaaaaatcaaacaacccaattaaaaagtgggcaaaggacatgaatggacatttttcaaaagaagacatacacatggctaacaagaatatgaaaaaaagctcaacactactgctcattagagaaatgcaaatcaaaacccttgattctctaatgatgttgctgcaccttcaacaccactgggaactctgcctgctgcaagccaaatgccctggtctaccatttgcacaccggcagtataaacacaaagcatgattagagcctctgtgtacagaagagagtaactgctcacccacaccagctcctgtagttgtggggccctgacttagtcaattactgacgtcctccttggcaagcaaattttgccactggtcagagggttcattttaacagtgctgtgggtggtgggggcgtgaagcaaaggcggaatgcatgtgtgccttggagggtgcagtggcttctcctcagggtgggcttttggagctgctgtccagctaccaccagagagaggctctgcttggccaggcaggcaacgagggcgggaggaagcaggtgcacatgcatgcacacatgcacatatgcacacaggcacacacacacatgcacacacactcatacacctgataccaagttaaacccctctctcttttatcacgaccactgactattatattttaaaacacatattcaagggaaaatagtggataggaagcaggactggaatgcagctcccactcagacggacagagcagcgtgtggcaacttgcatcatgaacctgtcttccagaactactgcaggaataggccaggaaagctgagagaatccacagacccttgaagaaggcagattgcttctgcaggacccaggagacacaccaaacactgccccgtggcaggctggtccccgccctgcaggagtgtttggactgtgcagtgtgataagcactgtgggtgaagtactgcaaagtgctaaaggaacatacacaggaggagccagaggagccttcacggccaaggggatgtgagctggatcctgaaagaagaagtgtttgagagagaagagaagaagaaacattctaggaagacgtaatagcatatacaaagacagaggtcccaaagaacatggcatgtttgaaaaatgatgtagccgtatcttagcctgaaacagctggagtctagcactcatgggatatggctggagatgcgacaggaaagttactcaggaccagatcgccaagggcctttagaaacgcacactactaggccgggcgcgggggctcacgcctcaaatcccagcactttgggaggccgaggttggcagatcgcctgaggtcaagagtacaagaccagcctgaccaacgtggagaaaccctgtctctactaaaagaatacaaaattagccgggcttggtggtgggtgcctgtaatccaagctatttggggaggctgaggtaggagaatcacttgaacctggaggcggaggttgcagtgagccaagatcacgctgttgcactccagtctggcaacaagagcaagggaaggagcgagggaaggagggagggagggaaagagggagggggggagggagggagggagagagggagggcacattgcttcgtgtagcaccaaggcgtcactagacccgggattcacctgcaaataatccgagtgtggggaagtgggtgagggtgttgatgaaacaaggctgtctcaggaattgatgcattgaaggtggatggtggctatttggaatgcattgaaccattctctctaccatttcatatgtttggaaattttcataatacaattttgaaacaaaaaatatcatcatcttatgcaaggacattctttgttgttacataatattagaatacttttattattgttgttaatagcattgttgagtttttttaaaataatcatgttaacagaaaaaaacccccatattcattaatcacaggtcatagtaacatattcaaaacttgtcttaaagactaagtgtataagaatgaaatgcattttaaaacaaaatttacactgtcccaaacttcacttaaaaactccccaaaccgaaaaaaaccctgactccttattcacaattttaacttaatatgctgaatttcattataattccacaaaaaattatcagtgttaaaatgtatcttttatactttattctgcatttagaaatacaagtttactatatttatatagtgttttctctttttagaaaactgttaaaaaatatctgagtaagaaataagcaaagaagaggaatgtgacagtcaaaagtatatggaagagaaaaaattaaactcataagttggctgggtgcggtggctcatggctgtaatcctagtactttgagaggcaaagatgggagaatcgcttgagctcaggagttcaagaccagcctaggcaacacagtaaaacctcatctctatttaaaaaaataaggtcgggcgtggtggctcatgcctgtaattccaacactttgggaggccgaggcaggcagatcacttgaggtcaggagttcgagatcagcctggccaacatggcgaaaccccatctctactaaaagtacaaaaattagccgggcatggtggtgggtgcctgtaatcccagctactcaggagcctgaggcaggagaatcgcttgaaccgaggaggcggaggctgcagtcagccgagatcatgccactgcactctagcctgggcaataagagcaagactccgtctcaaaataaaataaaataaaataaaataggccgggtgtggtggtggctcatgcctgtaatcccagcactttgggaggccgaagcaggtgggtcatttgaggtcgggagtttgaaaccagcctggtcaacatggtgaaaccccgtctctactaaaaatacaaaaatcagccaggcatggtggtgggcacctgtaatcccagctacttgggaggctgaggcaggagaattgcttgaacctaggaggcggggtttgcagtgagctgagatcgcaccattgcactctagcctggacgacagagagagattccgtctcaaaaaataaaataaaataaaaacccctaagtttttctaaagtgcctagaaacatgaacagaaacaaaggcaaatcttaaacataattttacaggatttacaattataaggtggcagaataaatgaagtctgttactttttttcccctttccatgctttttgcatttggttttgtgtgtgggggcaaatgtgtacacgggcgagaaaatgcacacactcttctaaataagggggcagtaaaagagttattaggaaagaagaaaaagcacaggcaggatcaaggcagagtttgcccaattagttcaaagtgagttgcaatcgatgcctaaggaaagtcacggacaaagcaatgaccttgaaattgtatgtggctcctgtcagaattttaaaatggttttgcatagaattctaggaactattaatacataattaaagcatctaccacagccaatgattcctttctcagggaagaaaacccagtgatgaagctggagaacggtgatggccaaggagagctcacagggatgaagcagcaagcaccagccaggccagaagagtgagacccaccttggcaggtacagtggagcatccataatccaaaaacgtaaaatcccaaatgctccaaaatgcaaaactttccgagtgccaacacaatgccataagttaccctgaacacatcggtttttcactgtatttatcagtagcatagaaatacagagtcaggaacgatggtgatgccagactgtccacaagggtggctgagacagtggcacctttgctttctgatggttcaatctgtacaaactttgtttcatgcacaaagttattaaaaaattgtataaaataacttcagactatgtatataaggtatatatgaaacatgaatttcgtgtttaaaattgagtcctcatccccaagatatctcattatgtatatgcaaatattccaaaatctgaaaaaaatcagaaaaccggctagacgcggtggctcatgcctgtgaaatcctagcactttggaggggccgaggtgggaggatcacctgaggtcaggagttcaagaccagcctggccaacatggcgaaaccccatctctactaaaaatacaaaaattagctgggcatggtggcgcatgcctgtaatcccagctactcgggaggctgaggcaggagaatcacttgaatccaggaggcagaggttgcagtgagccgagatcgcgccactgtactctagcctgggtgacagagcgagactccgtctcaaaaataaaaaataaaaataaaaataaaaataaataaataaatcagaaaacctaaacatttccagttccacgcatttgggagactcaacctgcaccaggaattatacagctgctgcccccgctggctgtcatgaggtatacttttagctacttaaagaagtttcctcatatccctggtttattaacgatttttaaaaaggaacatatgttgaattttattaattgctatttcagtatctactgagatgactaccagtttctctcctttatcaacaacattaattccttaggcaatttcttctttttctttctctctctcattctttctttctttctttagagataggatcacattatgttgcccagactggcctcaaactcctgggctcaagagatcctcctaccatggcctcccaagaagctgggactagatttctcaatagatggctttgtttttttgttttgttttttttttgagataaggtctcactctgttgcccaggctagagtgcagtggcatgatcactgctcactgcaacctcaaatggccaggctcaagcaatcctcctgtctcagcctcctgagtggctgggactacaggcatccgctaccatacctggctaattttttttattgtttgtagagatgggagtctcgctatgttgtccaggctggtcttgaactcctggcttcaagtgatccttccaccttggcctcccaaagtgttgggattacaggtgttagccaccacatccagctccttaatagattaaaaaaatttttttttaattaaaaaaattaaagatggggttttgtcatgttgcccaggttggtctcgaactcctgggctcaagtgattcacccaccttggcttcccaaaggcctgggattacccgatccacccatcttgacttcccaaagggctgggattacctgagccgcccaccttggcctcccaaaggcctgggattaccggcaagagctaccttgcccagcctagatttcttaatcaacagaagaatacttgcatttctaagataaaccttacttgaccacaatatattcggcttttaatcctgcatagctagtgtttgtttaggagctttggccacattttaaatgtaagactgatcgcttgttttcttctttgtgtgctatcttcctctggctttgatttcaagatcaagctagccttacggaaggagctgggaagtgctccatattttcctatgttctaaaataatttaaataaggcattaactgttcctgaaaagttttacagaattcatccataaacaggctgaatagaatggtatgctcttctgtagcagaagaggaataagacctttcattatcttatttaaaaaatagctttgttggggctgggtgcaatagctcacgcctgtaatctcagcacttcgggaggctgatgtggaaggatggcttgagcctaggagttgcagaccaacctgggtgacagagtgagaccctgtcacaaaacaaaacaaaacaaaacaaaaaaccaacaaaaatagtttgagatataattcacattcacaggttcgccaatttaaagtgtaccatctctgttgcccaggctggagtgcagtggtgtgatcctggctctctgccacctccacctcccaggctcaagcaatcctcctatctcagcctcccaagtagttgggaccacaggcgtgcaccaccacacccggatagtttttgtattttttttgttgagatggggtttcgccatggtgcccaggctggtcttgaactgctgggctcaagggatcctcccacttcagtctcccgaagtgctgggattacaggcgtgaaccaccatgcccggccggtgtgctttgatcaacgttacttttaaagatctctgcatttatagttaagaagcttctcttctttctaaagctttgcattttctcccattttttcctgaacagacttgacaaaggtttatccactttactgacttatccaagaactaagtttttgtttttattaagcatgactacctttgtagttgatttcactgatctatgtcatttcagtagactttaggagggaagagaggtaagtgaatatattcagcaaaccgctgagtcacaagagtggcagagcaatttggtgaattcattctgatgaattcaagatgggcacttcatccaagtccccgcaagtgtcctgaagtttgagactctgacaaaaggctatcctaactcacaatgaaacactggagtttcgcagagattacacatacgtccataaatgtgtgcacctctttggggttttgcaatataatggatctttctgttgtgcgtcctctgacagtttctactatggcgtgccattgtttttacactgtgtgacagcactgacaagaattactactgcaaatcaaaacacaaaaaaaccattggcagagccattacaataagtcaccaatagaagatgtcaggtagcaagccagtgttcaccaatggggactactcaaggtactcccagttcaaatgggaggcaatggagaagacagaagcatctagaccaaccctaggtcagaattgttactgcctttcttgtgagcttgaacaaattgatacccttgagcctgaatttcttcatttgtaaaatggtgacacaccatctttcctgagagcatttctcaggaacagggataagcacaaacatccaatcgcaaaagctgccaactatatgtggcatacatacctgtgtccacatggggcaaagtctgacagtgcagaagaacagaatcgctggaatcactttaaatttttgctcggtttcttcttgtcttcctagtcatcatcgcagttactgctgatggagactgtactacatcccaggccctctaatgcagcggtccccatactacatcccaggccctctaatgcagtggtccccaacctttttgggagggaccagtttcatggaagacaatttttccatggatgggggagcagggggatggtttcagcatgaaattgttccacctcagatcatttggcatgagttagagtctcataaggaaggctgggcacggtggctcacgcctgtaatcccagcactttgggaggctgaggcaggcagatcacgaggtcaggagtttgagaccagcctggccaacatggtaaaaccccgtctctacaaaaatacaaaaattggttgggcatggtggcaagtgtctgtaatcccagttacttgagaggctgaggcaggagaatcgctggaacctgggaggtggagcttgcagtgagccgagattgcgccactgcactccagcctgggcaacagagcaagactctgtctcaaaaaaaaaaaaaaaaaaaaaaaaaaaagctcataaagagtgtgcaacctagatcccttgcttgtgcagttcacaatagggttcgcgctcctatgagaatctaatgctgctgttgatctgataggaggcggagctcgggaggtaatgctcgctcgcctgctgctcacctgccgtgtgggccgattcctaacagtagtggtctgtggctagggggttggggacccctgctctagtggatatcatgcccatgttatttaatccacatataatcctcctggctaggtactattattatttccaagttacatatgaagaaaccaaagctttaagaaacttactaaagttctcacagttattaagtagaagaaatgagactctaaggtgaatctgactcatgctcttaattgctatggctctaattacacatgcattaaaaaaaggggggttacatcgtatgtatgtataagcttcaaagctagagaagtcaacgtgaagactgagagccaaggaaagagggtaaataagcgtcttacaatgcgcatgtgtgtactggggaggaggtcttgacggaacaatgaaacattccacttccaagaaaatgtggaaaatgattcataaaataacaacttattgctagcaacttcctgtcagttacaaatgaccaaagtacaacctaaaataaaatgaatcagttagcatgatgttcagaaacctcattgatgttatataaattcagatacatgggaaacagctccaagtgggacagaaggcagcgtgtgtgtgtgtgtgtgtgtgtgtgtgtgtacatatatatatattttttttttcagataaggtcttgctctgttgccccagctagaatgcagtgatgccctcatggttcagcacagcctcaacctcctggactcaggaggcatgggactcacctcccatgtctggctaattttctgtattatttatttatttttatagagagagggtttcgccatgttgcccaggccgatctcgaactcctggactcaaatgatccatccaccttggcctcccaaagtgctgggattacggggtgagccacagcacccggccgtggcagcatattaaacagattaaaaagtgactaaaatttagccaaaaggttcccagactagttcccttcccccaaaatcgctcttcccttttcatatcagagatgaacctggctctgttccccctaaccttagcacaagtgtaatcacggccatgaaaggaaggtgtcaaggcgatttcctcggatgccagattccgcaggcgagccatcccactctacccacttgctactgccttcagttattcaactgcaaacgtcacaagccctgatgtcacccaccgtcgggtggagaagcctttcacacctccagggttcactcagtcatttcacttcctccgttgctccgccctcactgctctttgattagcgcaccatcaacatggcaaatgcaattcctctcatttctccaatgcctcaaatagaaatgccttatgtctttgtaagaaataacattgaccacctgaagtatggcaagcctaggtgccacagtaaaagcataagctccaaaatacatacgttcatttgtgtgacaaatgtttactgaaaaccaagtttcactcatcccagtggcctcaagacctggcaaatattaagatttcagtctccatcctcacagagcttacaatgtaatggcaaataaatgggaggggctactgggaaacacaaagaagtgcgtccccctaacagcacctatcaattgtgagggatcatgagatagcatgggaagtcttcatcggggcttctgggaaggcttccctgaggaagcgacatctaacctgagacttggagaaaacgagcaggtggccaaaggagaggaaggaatgattcaaggagcaggagctgtctgtgtaaagtctggcaggcctggaggagcaaggcagtttgaggaagctgatgaaggccagagtagctggagggaaatgcagggaggaaagaggcaccaggtgaggctggggagggaggagaagggggcaaggagggcgtgccgggaagtgcggactcctacaggcaaaggaaaagtaccggaggctttagaaatgaaagcgatgggattagaaatatgtttgaaggaaatatctccaacagcagcatggcaaattaattggagggggcagagcaggtgctgggagagcttggctgctggaacggtccataggaagatgacactggccgggagtgagggagagaggtgaacaagccggaagcagcagcaaggagctgttctcttggacctggagtcaagcagctttcctgttaaaacagctgggaggatgcgggcatttatggaatcaggctggttaaaaagaaagaaaacaaaccgaagaaggaaggggaaggaaggagatgggcacagagagatcagtgtcaggggaatctgagccgtggaggagggcacgacctccaggctgaaggcacaggatgagatgtaggcctcagacagggcagcgagaagcccatatccagtgctccaggagggaggggaatcgtatgggatgtgagttatatcacaggggtccgaagcatgggtaaggactcagcacagctggctgtggggttggagctgaacagctgtagggccaagaggccattcttcaacacatccaccaggaagcagagaaagttctgagatgggaggtcacatggccctagagcaatggccagaggtgctcaatgccctgggccctgatgactttccagctggttccagttacttgcgaagactggtgacgagtcccacttaccaatacccccgaatcctcccagcattgtcctctgcttaaactagtcagggatcttccggtgacaaaacctctatctactccaagacaacaaccctacctcaccaagtcggagacaccaccaaatgtgaagtcacgtcctgacttcagagatactgaaatgtgtacctagaccctacagaatagggcaatatgttacatatggcgccagctccagaggaacaactttaattacagggatttcatacaattgtaactactcataatccagaaacaataagtctcttatctacgaggagtgtgtgaactcagcagggaagggtagagtttggaaagcagataatcacccgagccttctcgtgccctaagtaatgatcgacaagtaccagactgtgcccacacacctgccactttgatatctccaccagcagaggtcagtgccccgcagtagagtcaagaaacctgcaagttgacgcttggctgtgagagtcaagggacaagggaataattcaatagatgaccacaaatacacagggaggcaattctcccttaagcaagttccagcagcttctaagccttgttttcattatactcccctccctgagtcttttttatacattctcccccaactgtcctacccccacgacattttaatagcacagatatactgtgtatttgttcatgtgccgtggccctttgggtggccaaaatccactgtaacagctgcaatttttttgtctcccaacaagaaccgatcttcacttactcagggtgttactcactccagttgagaatgaatgagttttgagtgaacacacatttttgttttgtttatttgtaaagagtgattattggttgctttggggtctgatttttaagcgagagagaaaaagcaaaagatcaccaagtgccggccccctggttttatagagaaaactcttaacgacagcaataacaacaaaacaaagcccggagaggcctcacgggttgtccaaggaaatacaggcccttcatcacagatctgggcctgaatcccgagatgcctcactgaaagacaatgctttctttccctcctacgaaaagtggcccctacttttacctattttgatcactgtaggtgaggctgaccagttttgctagaaacaagcaagattggctgggtgcagtggctcacacctataatcccagcactttgggaggccgaggcaggcagatcgcttgaggccaggagttcgagaccagcctgggcaccatggtgaaaccccatctctactaaaaatacaaaaattagccaggcatgctggtgcatgcctgtaatcctagctactcaggaggctgaggcatgagaattacttgagcctgggaggcagaggttgccgtgaaccgagattgtaccactgcactccagcctgggcaacagagcgagacaaaaataaaaagagagaaaaataaagcaagattgaggcacgttctggaaagaagattctatttcgttgttgtcattttgtttttgttttttggagacatgaaattactccaggctgaagtacagtggtgcaaccacatgcgctcgggtgatcctcccacctcagcctcccaagtagccggaaccacaggcgtgcaccaccatgcctagctaatttttaaaattttttataaagacggggtctcaccatgtttcccaggctggtcttgaactcctggccttaagcaatcttcctgcctctgcctcccaaagtgctgggattacaatggtgagccgccacgcccggcctggattctactttggaaaatctttgcaagtgaagaagaataggacagaatggctgaactgggatgaaataagcggcaaatgaggaggaagaggagagacagtcagtctggcaagacactctctgctaagaagcgggtaaaatcaccacagcaagttatcaaaaacttgaaagagcccagctcctccggcagctgggagagaatgcggaccgctctaaagaggctgcagacttcatgaagtggtaccagagtagagcaggtttattaatcacggataaaactgctgaataattacctacttcaaaaagcattcatgagttgtgtttaggtgcttacaaagtactttgtgcttggtcctggccagtaagttagttcaaggcagttaatatagataaacacaaacacagcaaagacgtggtcggtgtaacaattacaaatgtaaaaagcaaacacagaaagggattgctggctgggcaccgtggttcatgcctgtaggtcccagtagttagggagactgcagccggcagatcacttgagcccaggagtttgagaccagcttggccatcatagtgaaaccccatctctactaaagtacaaaaattagccaggcatggtggcatgcgcctgtagtcccagctacttgggaggcggaagcaccacttgagcccaggaggttgaggctgcagtgagctgagatcgcatcactgtacttcaccccaggtaagagtgagaccctgagggagggagggagggaaaaattgctatgggcaaggcttctcatacacaaaatcatttcctcccccaatatgcccacaaagtaactacaaacacttaatgaaatcattgagatccaaagcactgctgagaacttgctatgtgccagctgtggtagcaggcacgggggagagaaaggtgaatgccagagaagtacagagggtattcagagaaggcctcggagaccagatgagacttgagctgagccttgaagtcttactaagatcggtgtggcatggaaagcatgcagccctcatcacgtgccaccccctaaggcacaggcacagtgagggagacacagagcagggggctggcacactatgcctgagggccaaatctgggttttggtaaagaagttttactggagccgagccccgccccttggattgtgttagctgctttctgctttcttgctacaagggcaaattgagtggttgtgacagaaactgagaccataacacccgcaaaggctaaaatatttactatctgaccctttacagaaaaagttggccggcccatgtcctgttattccaagaggggtctgtgaaccggcagcaggagcggcccctgtgctaggcaagtcccaccccagacctagagaactggaatctgcctttcaaaaagatctgtggctattcttatgcacagagagggaggggcactgagcctgcggagtaagagaagtctgcacctgtcggatatacggacagaggaacgtggtcaagaccttcccatagaggagtgaggccatcaaacccacccgtaccatgtccctcttgtcgtggtaagaagggttgacagcagaaaagggatggcagctcctgtcataacccaggccaaagacgacccaactaggcagggtagaactcaatctttcttcctaacctcaccagtgcttccaagatgtttctaacaaatatagtatcagttataacttattaggaaatagaaaaatcttggtaatgaaaatatgagtaatcatgtgtttccacgtacagcgaatatatctcggttgaagcaatgcctctagacatcaatgcatacatgaagacgttaacagggtatgctggatgctgaaagatgaaatgaggatctcgtcaagggctccctattatgtaggatatttagaggtgtaatgtcttactgctgggacttttgtccctgctaaataagtgtgagattctgcttgatattcaattttcctgtattttggatgaataagcaatttaaagttcaaaagaaacaaagctgcatttggactaccacgccaacactgttctttcttccagctcagctcagcctcaaagtcactgtttaacattctgcctccttaagaatctagaaaagtttgacagggttattcgtgggattcggtgtgctttaaaggaatgacagcaatatagataaaaatagatgggtgaagaggggaaattcctctcttagacacttaggtttaatactttacattcattacattggcagacacaatgaaaagaaaaaaaagagtgtatatctgcttagagaaatgcataattaaattaataaatctcaagtaagaagaagaaaagggacaggacaccaaatctgtgttgagaagaatctctgtgttgggtttcattaataaaaatcttaaaaagctcatgaattcagtacaatgcttaatggcacttaagcgataatagtaactaacatttatgaagtactcactatgggtttacactgtttttaaatgccatgatacggattggctcatttaatcctcaaaacacctgatattagctctattttagaaatgagaaaaccaaggcacagagaggttaagtaacttgtccaaggtcacacagctaaataagtagtagcgattcctctcgaacagaagctgctctctagttcttcttgcctccctgctaatttgcaaaaattgtaactgtaaaagactctcattcttactaatataagagacaaaaccctggtgatttagacattcaaagtcttatggaacgggcacaccattccaccctgtggacagcggccaagatttggcctgcaatataataaaactgaggaatagtgagatgggttcgaatgaagaccctggattatttttctgtaggatgaaatgcaaattaagtccggtaaaattctgaaatgcaccatttgttaccaataaatacagacaaacacttttaatgacaatgactatgaacgcgttctcttccagctaacatgtttgtgaaatgctgcagtgaatctcaaagataacaggcacccggctaattctattgggttaacacgtccatgctggctgtgcaggcttatttaagtaattgcctgactgtgaatgaacagaggtattaaagtaaagttggcacaagggacagcatccacatggcacgttctttgtttcgagagctttattctatcaatactcctggaaaaaagagaagttgctaaataaataatggaagcacacaagacagtgtgaacgccttttcaagtcctcgaattgtcaagcatcttatataaagttctttcccgactctgagctcatcacatttcattttacatattaattttgcgtaagagcaagctcatcccgttcaaatgttaacagcttcaaaataagatcctggtgaaagctcgtcacattccattttaaatattaattttgccaaagaacgagctcatgcctttcaaatgttaacagcctccaaataagatccaagttatttacctgtaagatacaagaagaagacaggagagggaaaaaaaacaaccaagtgagaggagaggcgacagaaatgacggagtgagagggtcgcctgaactcaacaccgattcaataacctcttcaggttttcctatttaactttccccattaaaaaagaagacacaccctaccggtcatatcttcacaggcgcagataagggcaccagtctatgattaaagggtctggactgtgggtatgattcggggttgcctccgagtgcatggtgacaagcacaaacaattagcgctccctgacaccttgctgtaattcgagttcggcgagtaaggacaaaagggccgcccgtccgtgtggatgccgggctcagggctgcgctctgggagcctggctcgcgtcccctccgcggacgcccggtaccccgcagcccgagctcgccggcgcccgcatccccgccccggttcccgccccggcccctgggcttccgcaggacgcagctcgccgtggggcagcgccggagatggggcgcggggtccccgcgggtcccggtcctcgggcggccgggccgtgggagcgccgggccggcagcgggcggggcgcactcaccttcgtcctcgaactccagcttctccagcatgccggcttccgcgggtcccagggccgccgccagcgccgcctgagggggaggaggaggacagcgatcagcatgagctgcgacgctcgtccccggccggcgggctcgcggccggccgagcgctggggcctggctctgccgcgccgccgggaggaggggcctggcaggggacgcgggcagcgggggccgggggcggagcgggagcgctgcccccacccgcccgaggccgccgccgccgccgcaggtggcgcggccgcggcccgcgtgcccctccgcgagtgggacgcgccgctcccccccgcgccttggtacggcccgcccgggaggaagcgtgggaagggacccgggagctcgagggcggcagcgcctgggcccggggcgcccccctccggccgtggcccgcgtcctccccgccgtgccgccattgggagaggcccgcggcccgcccccactccgccccccggcgccgctcaccttcccagcaccggcggccgcgctcggcaggctccacctgcgcaggtgtgggctccgcggcgcggggagggggagaggggctggaggctgcagaacgccccggggcgccagctaggggatcctttctcgctttcctcttccctttccaaattttagatgtaactgcccatcctcggcccccttaacaaaaatcgttccgtgggctacacgtattgtagatgcactttgtcgctatccatttttttttttccagcatggaactcttaattcgcgtcctctcttcgcagccgagtgtcttctcggttggggagccgctgccaaaaacgtacacaccctgaatctggccctggccgctcaggagctgggtatctgagactctactatggccaactcaggttggcaggctgcgcggccagcagccgctagcctcctggaagggcaggacaggccgagaggggactgaggtccctggccccacggcccatccctgcagagtgcacgggcgccgcgaatgcgattagctccagtaccgattagggctgaaaggagcttggccctagcgctcttgcaagccgggcctgaaagaggaagtcctgaaaatgcctctcgtttagctttgtcatcttacttgcgccaatccctaagtcttaaacctcttaaaaaaagaaaaggggtggggagagaaaaagaaaacaaaactaagatgtttcatggtaaaaagctacagcagataccatacttcatagtgaaagactgttttccctatgaagttcagaaaccaggccagggtgtctgctctcactaatcctattcaacatggttctagaagtactaggccctgcaataaggcaagaaaaggaaagaaaacgcatacagattggaaaggaagaaaaacacctgtgtagataacatgttatctacatacaaaatatcaaagaatctacaaaagaaagaaaaaactcacctggaattagtgagtttggtaaggtcatagcatacaagatcaacacacaaaaatcaatcacatttctataaactaacaatgaacacatggaaaaatatataaaacaatatcacttaatacaatcacttcaaagaaaattaatacttaggcataaactcaagaaaccatgtatagtagctgtatgctgaaaatcacaaactgtagatgaaagacgagctaataaatggagagacagtcctgagctggaagccccaacatagtaaaaatgacaattctcccccagattaatcttttggtttaatgcaattgctaccaaattagggttttttttaaagacataaataagcttattctaaaatttatatggaaaggtgcaagctctagaattctatttatttatttattatttttttgagacggagtctcgctctgtcacccaggctggagtgcagtggcgcaacctcggctcactgcaagctctgcttcctgggttcacgccattctcctgcctcagcctcccaagtagctgggactacagtagaattctttaatcttgaagtcgcttaatattaaagcaaactatatagatacagcaatcaagacaatggtattggcagaagaatggatataataatcaatagaaataaatagaaaacccagaaatagacccatgcaaacatggcaaaccaatttttgatggaggtgtaaaagcaatagaactggagtaattggatatcaaaaggtaaaaagacaaaaacaaaccccaacctaagccttgcgttttacacaaaaattagctcacattggatcgtgaacttaaaactatgaaactttttggagaaaatatttgggaactggggcaaggcaaaagttagacttgacaccaaaaacacagtccataaaaggaaaaacataaatggacctcattaaaattaagaatttttgctctgcgaaagaccctgttaagaggatgaaaagaaaagctacacagtaggagaaaatacttgcaaatcacatagccaacaaattactagcacactgcctatagggttagccctgctctccaaggaatagcaaaaataaaataaaataaaaatgtctggaatacataaacactaccaatattaaacagaaaatggagaaaataatccaattagaacataggcaaatgacacagagctgtttcaccaagaaagatatacagatggcaaattagtgcatgaaaagatgttcaaagtcattagccattatataaatgcgaattaaaaccacaatgagatactactacacaactgttaaaatggctaaaatcacaatagtaacaacatcaaatgctggtaaggatgtagagagacagacaggattacttctacactgctggtgggaatgcaaaatggaaccactgtttttttttttttttttcttttttttttgagacagggtctccctctgtggcccaggctggagcgcagtggacctatctcaactcactgcaacctctacctcccaggttcaggcaattttcctgtctcagcctcctgagtagctaggattacaggcacatgctaccacaggtcagctaatttttgtatttttagtagagatgaggtttcaccatattggtcaggctggtcttgaactcccgacctcaggtgatctgcctgccttggcctcccaaagtgctgggattacaggcgtgagccactgtgcctggtcaggaaccaccactcttaaaaacaatttggcagttttttataaaactaaacatgcaactaccatgtaacacatcagttacactcttgggcatttatcccagggaaatgaaaacttacatttacacaaaaacttgtacatgaatattcatagcagcttttttgcaacagtgcaaacgaaataacagatgtcgttcaatggatgaatggtgaagcgggctgtggtaggtccatctataccgtaaaatactactcagcaagaaaaaggaaggaactactgacacatacaacaacttggatagatctccagggaattatgctgagggggaaaaagccagtcctaaaacgtcatatactgtatgattccatttatattatagtcttgaaataaaatggtcgaaatggagaacagattagtggatgccggggatcaggggctggggtagggggccagaggtgcctatggctataagaggataatgtaagagatccttgtggtgaccgaactgttctacatcttgactgtatcaatgtcaatatcctgcttgtgatatcaccctgtatttttccctatgagtcaggccaagctgatttaattctgtggaggaaatgacaataaatttttttttttttttttttgagacggagtctcgctttgtcccccaggctggagtgcagtggtgccatctcagctcactgccagctccacctcccgggttcacgccattctcctgccttagcctccggagtagctaggactacaggctaattttttgtattttttttagtagagactgggtttcaccgtgttagccaagatggtctcgatctcctgacctcgtgatccacccgcctcagactcccaaagtgctgggattacaggcatgagccaccgcgcccagccaaaaaaatctttactgaaatataattcacataccataaaataactcacccatttaaagtgtgcagcccagtgatttttggaatattcagaattgtgcaactatctaagtttacattttcatcatcccaaagagacagcttgtacccattagcagtcacgtcccattacctgctcaaccctcacacccatccctaggcaactatttcctgtctctatggatttgccgatgctgggtatttctcatcaatgggatcatacaataggtggtcttttgtgactagcttccgcttaatgtcagggcccattcacattgtaacacggatcagcacttcatttctgttgactgctgaacgatactctgttgtgtggacacacacaccttgtttatcctttcgtcagctgatgggcactcaggtggtttccactttttggctgtggtgaaaatgctcctatggacattcctgtgcaagtgtttgtgtggacatgtgtttcatttcatatatacaggagtggaattgctgggccacagggtaaccctatgtttaatatatatatattttaaatttagttttgaaatggagtctcactctgtcacccaggctggagtgcagtagcgcgatttcagctcactgcaacctctgcctcctgggttcaagtgattctcctgcctcagcctcccgagtagctgggactacaggtgcgcacaaccatgctcggctaattttcatatttttagtagagatggggtttcaccatgttggccaggttggtctcgaactcctgacctcaggtgatccacccgcctcagcctcccaaagtgctgggattacaggcatgagccaccacacctggcctctctacatttaatattttgaggacctgctgaactgttttcaaggtggctgcaccattttacatttttaccagcaatgtatgaggattcaagtttctcctgtactgtttagttttgcaagatgttaccactgcggggaactaggtaaagggtgcacaggatctctctgcattatttcttacaactatatgtgaatatacaattatctcaaaataaaaagtttaatttttaaaaaaagttttttaaaaaaacttggagtgagccaaggtacacaggaagtatctctcgttctaagtctatgcttttgtctcttgcaataatttaaaaaaattcttaccggtgtttatgataagcaccatcaatttcacctgtaatcgtgaggggttgttttttgggaggcagaaatgggcaacaaatggcagtatgtacgtcaggaggaccgcaaaagtggttcacagactgaaaagacctataaaccatcactacagaagttggtagagagtagaaattctaacaattaatgttttatgcaactccacttgataatgaatgggtgtacaggagtagcctaaaataaaaatgtttttatgtaatatgctagtgggattgaatttatttctacaggttttttacttagtaagaaatcttatgttttcttccttagaaaggaggctactcatggaacaacagaaaaagtcatgaggttttttttttttttttataacacactaagtcaatttcaggaatttgagggcttttacagtttaggtatgtacattaatgtgcacagggtcaaaagacagacgaatttgtcagcacacagaacttgaagctggtggtcgtcgttgcccttttatggcaatgttttcttaaagtctcaacagacttatgccagacttaattttagctgtttcaggcaggcagggaaagccgggagaagaggcgaagggaggggaagggcgtgggcaatgtcatgcaagcaaagggaaggggcgtgcacttgtgacaccgactcctctctcagtccatcagcatcagggatgtttgatgtagcaaaaacagaccaaatccaccacccaaaccctcctgataatccagaccgatctccccagggagaacaaaatgggccaaccatggcagggaggaactgggttctgctaacagcctggcacagttccaccacagggaacatttccatttatatcacatcagccagtctgaggttactggactctagtgtggtgggagggaacagagggacccaagttggactttatggagagaatgcctgagaaacatggagccatcacaagtgtgacttcttggttggtaaaaaatgctaaattattatcccggcatggtggctcatgcctgtaatcccagcactttgggaggccgaggcgggcggatcacaaggtcaggagatcgagaccatcctggccaacatggtgaaaaccccgtctctactaaaaatacaaaaattagccgggcatggttgcgcacacctgtagtcccagctactcgggaggctgaggcaggagaatcgcttgaacccaggaggcggaacttggagtgagccaagattgcaccactgcactccagcttggcgacagagtgagactctgtctcaaaaaaaaaagctaaattattaagttgtgtcttacataattgtgcccaggtgcagcaaaacactgtattttgaatgactatcagaagggaaaacttcagcctgaaaacttaatcataaaacaattgccaaaaaagcactcctttacgcacagaggtcggatatgagtttgctctgcctcttaaaagaagtcttaaatagctcctgcaagaaataaatcaacctcaaatactgggtaaggagctcctgaataatttagcatacagaactcttagtttctgtgcatcctgctgtcttccttgagctccactctgctctgcaagggcgtcctccaaagagtaaagaacgacgtgaaaccccctggatgctggacaggagctgcacatgcactctgctcccgttcccactgggcattctccaggcagctccaacccaccactgtgcctgacatgtccaggtctcagtcccagcccagccctctcctgagctccacactgccatcatctccactggagttttctacaccaacgcagatgcacttcatctaaaactgtgccccagtcctctgggtcttgccgtcttggtttcttttgagacaacccacttgtctccatccctgctacacctcccctgtttcaggcttccattttctcagggttggccagccgggcagcttgagctcctccagtcttgcccgctttccagtctatttccttccgtgtagccagagtgcctatgatggttaaatttgaatccagtcatcttgactggattaaggaacacctagacaaccggtaaagcattatttctgggtgtgtccgtgcaggagtttccagagactggcatgtgggtcagtggactgagtggggaagatctgcctccagtgtgggcgggcgccatctaattagctgggggcctggagagaacaataaaggtgacagaggatttccttgctctttctcctggagctgggacactttcctcttcctgctcttgggcatcagaactccaggctctcctgccttgacactgggacttaacagcagcagccctctggttttcaggcctttggccttggactgagaattacgccactggcttctctagttctgaggctttcagacttggactgagccacgctaccattacctgcatcccagggactccagcttggagatggcctgttgtgggacttctcagcctccataatcccatgaggcaattcccccaataaatcccctctcatccatctatcagtcagtcaatcaatcaatcaatcaatcatctattatctatctacctacctccatccgtttctatcatctatctatcacctattggctctgtctctctgaagaaccctgactgataagagtgacattttaaaaatgtagtcttggccaggcacagtggctcacatgtgtaatcccagcactttgggaggacgaggcaggtggatcacctgaggtcaggagttcaagaccagcctgggcaacatggtgaaacaatgtctctatgaaaaaaacaaaaattagccgggtatggggcatgcacctgtaattccagctacttgggaggctgagacacaagaattgtttgaacctgggaggcggaggttgcagtaaactgagatcctgccactgcactcttgcctgagtgacagagtgagactctgtctcaacaaaaacaaaaacaaaacagacttattattcactaacttagaaccattcagtggctctcggcaatctttaggattttcttggcaaactcctgagctggggggaagggcctgatcatttattcaccttctcttgccatgtccctctgtgtaccccacacctaaaccttaaggcattgtcctggaatagaccatacactccctgctgtaagggtttctgagcattctggcctccttgtttcttcctcctttccttggccagttcttactatttttaaagattcagatcaatctttctctgaaagcctttcccgattcttttctttcagtctgcttttcctccttcccccaccgccttccttccttccttccttccccgattcacgaccttttctcacaacttgcctggttaattacttctctgaacccacatgcttccatatggcatttaacacactggcttgggatttacttttctgtttcctctgagtcccacattgctctctgaagggaacgaatgactcatcatccttgtattgcctgtgtgtgacacatagtaggcattcaaaaaatatttgagtgaaatgaattgttcattcagacatccattaaaacttggtagggaaacagttgattttagtagcataaatgggtttagaagttatttcactcaatttactcatgcttcccttggacctcattgctgtttggaaatcattatagtcactttccctttagtgttggaattaacattttgaaggaaaaaaagtgactgtgccaagaaatgatggcagggtagtttttattgtaatagattctatctgaggaccaaagttcgctggcagtatgagatcctggcatggatactggctgagagctttgccagctcttgccaccaccctacaatttcagcttttttgttcccttcttttttccttttttttttttttttttttttgagatggagtctcgctctgttgccaggctggagtgcagtggcacgatctcggctcactgcaatctccacctccctggttcaagtgattcccctgcctcagcctcccaagtagctgggactacaggcgcacaccaccacacccagcaaattttttgtattttagtagagacaaggtttcaccatgttggccaggctggtctgaaactcttgacctcaagtgatccacccacctcagcctcccaaagtgctgggatgacaggcaggagccaccagaaccggccctttctttcttttttaagagactgggtcttgctctgtcacctaggctggtgcagtggcacaatcatagctcactgtaaccttgaactcctgggctcaagtgattttcccatctcagcctcccaagtacctgggagtgccagcacgtgccaccatacctggctaatgttgcccaggctggtctgaaactccagtgctcaagtgatcctcttgcctcagcctcccaaagcactgggattataggcatgagtgacatcacctggccaattttagtttctgttaagggaagacaattgatttttaaaagtagtgtagaaatttgaaaaaaatctcaaatatatattcaacactatgagtattaattcttggccacatgcagtagctcggtctgtaatcctagcatgttgggaggttgaggtgggaggatcacttgagcccaggagtttgagaccagcctgggcaacatagggagaccccatctttaaaaaaaaaaaaaaaaaaaaaaaggggccaggcgtggtggctcacacctataatcccagcactttgggaggccgaggcgggtggatcacgaggtcaggagatcgagaccatcctggctaacacggtgaaacactgtctctgctaaaaatacagaaaaaaaaaaaattagccaggcatggtggcaggcacctgtagtcccagctactcaggaggctgaggcaggagaatggtgtgaacatgggaagcagagcttgcagtgagccaagatcgcgccactgcactccagcctgggcgacagagcgagactccatctcaaacaaacaaacaacaaacaaacaaaacaaaaggtagctgggcatagtggctcatgcctgtagtcccagctagctacacaggaggctgaggtgggaggactgcttgactccacgagttcaaggctgcagtgagctgtgatcacaccactgccctccaacccgggcaacaaactgagaccaccccactccccaaaaagaagtgtattaattctgctgattgcttttaatcaatatatttggagagaaggttttgttcattttgacagctttctgaataacaatttcagatgctataaatattagttcctccctaacattcatgatttctttaaagataatttattccacagtatcttttcagagagagtagcaaccaatttgtccagctcaagtcagctgaaaacctgtttcaaaggaagtattgttaaacaaaaggtgaagaaaattgattaacccaaaaagtcctttggattctctatgttaaattatcttcgaatttccaaaataggagacaatggtaagcttttgaagacagtcattcattcagcaaatacttacttaatatgggctatgtgcccagaaccagggtagttggttaataaaatatctgttgaacgaacatgtgctagcatgactagaaattggcatagaagatatgaagaaggagctcaaggaacatggagaatcagcatgattgccttgctacccttcaaattcattcgttacagtctgaaatgcatacatctcttgcctttcacaaataaatccatttttttgccaatcaaaatattttattattagctttgtgtttaacatgagttattgggagcggaatatttatattctcttataggttgataactcttagtattgtcttataatacattgcaaataaaaaaataagtaatgctcaccaagttcatctaacctttcaattcttaatgcagccaagtcacaaactttgaaatatgttgtatttatattagaatgcaatgtacagaatgatatagtgtcacaaggcagtctctgttttctattctctgctccctcccctgcaactgacctattcattaaccctttctagaacagatcactgttaactgtttttcagcccctttaaatcccatattgggtggaagctctattcctaaattggtgaaaaattacaaacatgattgagacagactacttccacttcagttctgctctacataacgtgatcaaaaggaagtacaatattccagctgaaattaaagggacccactaatgcctccaccacatcttctacattctggagacttcagtggtcttcatttactatccacagtgttacatagccacttatggtggattagagtgaactgcagacacagagccaaggaaatggagaagcaggaccttcatacctcataatgcaaatcctttaaagaatgatttgtagtgtccctttttgttgtgtgtaatttaccaacaataaacgatttctattccaagtgtacaatttgatgagctaggatgaaatcatcagtacaattatacgatggaatactattcagtcataaaaagcaataaattaacagcatttgcaatgacctggataagactagagactattattccaagtgaagtaattcaggaatggaaaacgaaacattgtgtgttctcactgatatgtgggagctaagctatgaggacgcaaaggcataagaatgatacaatagactgtggggacttggagggaagagcggaagcggggcaagggataaaagactacaaacatggtgcagagtatactgctcgggtgatggatgcaccaggatcttacaaatctccactaaataacttactcatgtaagttcatgtaaccaaataccacctgtatgccaataacttatggaaaaataaaatttaaaaagtaaataaatgttaaagagaaaattaaaaaaataaaatatagagaaaatttttttatcactccaaaagtttgctcatgctcctttgtggttcaccccttcttcaaggcaaccactgatctactttttatcactatgtcactataaatatttcctagaattttgtgtatatggaatcatacagtatatgtgcttttgctcctggattatttcacttagcataattattttgccattcattcatgtcgctcagtataccagtagtttgttcatttctattgctaagtagcatcccattctatggatagaccccattttgtctattcattcaccagttgatggacatgtgggatattttcactttttgaccattgggaataaagctgtgaacatgtgtggtcaagtctttgtaggaacatgctttcatttctcttgggcaaataccaaggagtagaatggctgagtcatttggtaggtgtgtgtttaatatgagaaaccacccatttcacagactggctgtaccattttacatttctgcccaaagtggttgagagttccagttgcttcatgtcctcatcaatgcttggtatggtctcttaacattttttatcattttagtcattctagtgggtgtataggtttcttgctgtgagtttaatttgcatttccttgaggacaatatctttttgtgtttattggtaattaatgtgttttcttttgtgaagtgactgtacacatcttttgtctatttatttattagagtttttgttcttattgagttgtatgaatatggcaagcagactctgagatggcccccaatgcatgatccccacctcctggcattcatgtacttgtgtatccctcttcttgagtgtgagcaggacctagtgacttacttctagccaacagtattcagcacaggtgatgggacaccacttccattattaagcttctgtctatatacataagactgtggcttgtctttctagcagatcactatcttgctggctttggtgaagcaagctgccatgcgggagaggcccatgtcaatgaactaaggctctcagtctaaccgcttgcaaggaactaaacactgccactaaccacatgagcttggaaagggatccttccccagctgagccttcggatgagaccctggtcctggccaacatcttgattgcaagcttcacaaaagagcctgaggcagaggactcaactaagctgtacctgaacttctgacctacagaagctatgagataatcaatgcatgatttcagccactaagtttgtggtaatctcttacacaactagataatacaatgggttttaaaaaaatgcatttaggatgtaagtcctttgtcagacacatgtactgtgaatagtgaatattttctctccttctgtggcttgccttttcatattcctagtcatgtctttcaaagagcaagtttttaattttgataagatcctatttattatattatgactcatgctttttctgtcctagctaagaaatctttgcctcctcttcttccaaggttgtgaggattgtcttaaatgtttccttctagaagttttacattttccttttactaggcctaggatccattttgatttaatttttaaattatgatatgtggcaagggttgaggttcatattttccatactgaaatccaattgttccacattgcttgttgaaaagattttgctgcctcactggattcccttggtacctttatttaaaatcaattgaccatatatggggatctatttctggattctctattttgttcattgatttatatctatactttcatcatgaccacactgttttgattactgtagctctataataggccttaaaatcaggtagtggacattctccaactttgttcttcatttaaaaaatggctgtgagtcctttaagttccttatgtttctatatacattccagaattaaaaataaaacctactggaatcttggctgggacggcatttgatctacagatcaatttgggaagaaatgacaacagtattaagtgttccaatccatgatcatggcatatctttccatttgtttagccctttgatttctctcagcaatcttttgtagttttcaccatggaggtcttacatatcttttgttaaatttattcctaagtatttattttttgatgctctcataaatgaaattgcttataaaatttcatttcccaattgtttgctgttagcatataaaaatacagtggattttcatacattaaccttgtatcctgtgaccttgctaaattcacttgtaagttctagtggtaattttgtagatttcttaggatttttctgcataagtaatcacatcatctactgcctcttaaattattttgcaattccccgatactgtataattttagctatgtgttcagtgtattatacataactctgattcttatcaaaatgtatcattttagttattccttggctcatacatataaaatatgtactatatgttacacatatatgtaatattacagattacctatgtcatattacacatggatagatggatatctgctgctttcagctcacgtgcacaacctcagtagtggtatccaccatttgacgtgtgcacactggagccagctggagcgggtactcatggctgcctacttggcatccattcctcttcctctaccttccttcctagaataacccaaatgctgttgcagtatatatgctttcatgatagtgacaagctctctcgagctaccctgggctaccagggaggactcagggttggagagagccagaccgcacatgcatgtgtgcacagccccgtccatcccctgttcttgccacaagcaagcatgcagccctgactgctattgagaaacagccttcagatgaagccattgcagagagagagaagaacgtgggtcctaggtgacagcattgagcagggctgtatctcaccttgcctggggcctggcctgcttctgtacctgtatggatgatacaatagatgtccttatccttcaagccagtttgagttggaattctctgctgctttgcagccagaaacagcctaggtaacatttgggtattcaatgagatacaggcccggccctcagaaggttatattctaattaggtgacagttataattggggaaatcagatttctgcatatgtcacactgtaaaaaattacaaagtaatttaaataataaaaagctatagcgactgcattgtgggcacaaatgctaaggaaacctttgagaggaaggcttcctacagagatgtgcagaggcagattttgaagggagcaaggaaaggtggacattcgggtggcggctgtggcagaggaagagcctgaaggtcaggatgtgctgatggtctttatctgagagtagaacattcttgtagagaagtgaaagaaagattggagaccactgggagtgaaaggaatggaattggatttcttaggattgcatgtaagaagtgaatgtagataatctcaaatcgtttttggcaatataaaaaaatcctaatatctgcatacagtagagagggttggctgcaggagagcctggagtcagcggggacattgaagacgtctttacaatgaatgtaaaaattaagcgagcaggtcagaggtactgcagagataagaacagtttcgactttgtggattaggaagtaaataggaaagagattgggaatgtcagggaacagggattgaatgggcctgtgtgaggtaataaagggggaatgctgcaatcaatctgttaaacttcagctattacaaggctgtccaaaaaagtacctttggtgtgtaactagagtagcttccagtgtcatttggcggagaggaggggtgggtggtgtggatcatgctgaggaagaatgacagagatttttgattcatcagctatgcctcccaaactttggacaggtgtcattctatcatatccccatacaacctacacagttatttaaattgacttaaacccccaagtcttcccttaggcaacaattccatgaaatcataggttttgctgtttcagatatatttttccatgatatacaaaaatgtcgctatgaaaacgttcatccttgtaccgcctgaaagcatcttgcatcccaccgtggtcctcatgccccctgctttgggaaaactggtgtgtgagaacaagcggagtcagcatgaagggctggggcacccgggaaaagcacggagacattgctaggaggggccggtgtcttctcaaagggtgaaagggaagagacatcgatttaacaagcagccctagtagctgcaacacaaaggcatttgctataattggaagctgagaaaccaggctttagggaatgaaaatctaaaccagtgtttttaaaactgtaaactgtgacccactcatgggtcatgaaatcaattatgagtcaagtactgtaaaataatagtttactttaaaatgaaatgtaatagagggctgggtgcagtggtccatgtctgtagtcccagctacgtgggagggtgaggcaggaggatggctggaacccaggagttttaacccaaggcaacatagtgagacccccgtctctttaaaaaacagaaagaaaggggaaaaatcaggtatgtgagagaggaccaggattttttttttttcctttttatgatcagagactacataataaagaaatagagtgtacatcttcggatgcctcttgaccgaaagacgtagtcattcatatgggatatgagttaaaggaatgttcttgtcactaaatgtgctcaaatttcccttcacccgaagagcaagtagccagtgtctgtactaagttagacctgagggaaggaatgattattttattttattttattttattttatttgagacggagtctcattctgttgccgaggttggagtgcagtggtgtgatcttggctcactgcaacctccacctcccaggttcaaacgattctcctgcctcagcctcctgagtagctgggattgcaggcacctaccaccacacctggctaagttgtgtatgtttagcagagatggagtttcaccatgttgtccaggctggtcttgaactcctgatctcaagtgatcctctcaccttggcctcccaaagtgctgggattacaggtgtgaaccaccgtgcctggccaagactgcatttttaagttgcaagtaatatggtgaaaaattagtgtgtaccaacttttgtcatgttggttgtgcttgatatggtttggatctgtgtccccacccaaatctcatgcccaattgtaatctccagtgttggatgtggggctggtaggaggtgattggatcatgggggcggtttctcatgaatggtttagcacaatcccctcagtgctgtcctcgtgatagtcagtgaattttcatgagagctggttgttcaaaagcatgcagtgcctcccctccttcttgctcctgctcccgccacgtgaggtatgtgcggccccttcaccttctgccatgattataattttactgaagcctccagagaagccgagcggataccagcatcatgcttcctgtacagcctgcagaactgtgagccaattaaacctctttcctttataaattacccagtctcaggtatttatagcaatgagagaatggactcatacagtgctttttaaagggatatgcaggtatctaattctacatatctggaggaaatgtccccctcacctccccgacacacacccctgtatgtgttgcaaagcgtaatgactacttggtatttctattttctttttaaacagcaaaaattaaaaagaaaattagccggacacggtggcacgcgcctatagtcccagctactcaggagcctgaggcgggaggattgcctgggaggtggaggctgcagtgagctgtgatcacatcactgcactccagcctgagtgacagagtgagagagcctgtctcaacaaaaaagtttaagagaaaaatggtaatggttgactattttcctgctgagaagtgggcctgggtgatagcgaaacccagtctcaaaaaaaaaaaaaatttagaagaaaaatggtaatggttaatgatttttctgctgagaagtgggcaattacgcaaactttacctctagggaatggtttgcatgttaagattggaaccagagcaggggaaggggttatggtcctaaatcctaccaaactcagcagttcctgtcgctgtgttcctaaagatctgtggatgacagtaatgcttgacaacagtgacatatgctgacacgctatactagcagtttgaaaactggccagaggactcctgagggtccatgaaaccttttcagggagtctacaggtggaaactttttgtgccaacactaaggcgtcatttgctttttacccaccattgcttttccccatcaatgtcagcaccgtggcaaattctggtgccttaattcacatcaacaaggcagtggcaaactgtgacaacctcctactccaggggagaaggccagtgtcacttaagaaggtctttgataatgccatacatttattcattttgtcaaatctcagctcttgagtatgtgtctttttaatattctgtgtgatgaaatgagaggtgcacatataacttttccgttgcaaattatgatgatgttcttgaggaaaacatgtgcaattgagctgcttttaaaaccctgaaaaattgtagttatttggacctgggtatttggtagacagttttttttcaaaatgaataaactgagcctgtcactgcaaggaaaacaactgacatatttgttgtcaatgataaagtttgagttttcaagcaaaaattagaattttggaaaccttgtgtctgccacgatgagcttgacaatttccccatacttagagatttctctggggagattagtggtgttattaagaaatgctttttagttattgtgtaacaaaatgtgttcctatttggaagatctgcattagtcagtgagccaatattttccagatgactaatgcatggtattataaaatcatgcatgggtgaaagatccattcgaaatacaagatagggctgggcacggtggctcatgcctgtaatcccagcactttgggaggccaaggtgggcagatcacttgaggtcagcagttcgagaccatcctggccaacatagtgaaaccccgtctctactaaaaatacaaaaattagctgggcttggtggcgagtgcctgtaatcccagctgttcgagaggctgaggtaggagaatctcttgaacccgggaggtggaggttgcagtgagctgagattgcgccactgcactccagcctaggcaacagggcgagactccacctaaaaacaaacaaaaaaccaaaaatgcaagatagatggacagattctaacataatagactctaggtaagtaggctccgaaaagttcaatgatatggtgtcagattacacactgcggctaaccttcaagaaactaccacttgtcctctgggttcatccatgttgtcacagatgacatcaggctaagtgaaataagccaagcacggaaagacaagtactgcatgagctcacttgtagattataaacagtgaaactcataaaggcagcgagtagaatggaggttccagagactggggctggggttggatggggaaaggcaggaggctggccaaagtgtacaaagtttcagtttcatgggagaaataagttctgatgtatcgcacagcactgtgactacagttaataataaagactgctaagtgtagattttaagtgttctcacaaagaaatgataggtatgtgaggtgacagatacgttaattagctcggtttaatcattctgtattgtatacacatatcacagcatcacagtgtaccccataattatatacgatttttatttagcagttaaatatttaaaaaaccccaccacttgtcaagaaggctatccacaattatctgaagaggtaaaccaatacactcctctctttttttccaaccgcctatctgtctgaggctcgattttcttcatgtgcttcaaccaaaacaacatatggcaacagaccgggtgctgaagcagatctgagaattccaccgaattcttctaacccagacatgaaaaagctttgcagcaatgtaaaaggagttctttttcacaaagatggatttatgctaatatgtaatgagtttattactgatcttttcagataaattaatatttaaaaagttttaatttataatatggtaaattctttttcttttttcttttcttgttttgctaatcttctctgtatcatcccagttttagtatatgtgctgtcaaagcaggcacacaatatggtaaatattagtagatggaacccaatatccaaaaaagcccattgggtctcttttttctttttgagatggggtcacccaggctagagtacaatggcatgatcgggctcactgcaacctcttcacccccaggctcaagtggtccttctcatgagtggctgggactacagatgtgagccaccacacctggctaatttttctgtagtgatggggtttcaccacgttgtccaggctgggcttgaactcctgggctcaagcgatctgcccgcctcagcctcccagagtgtcaggattacagatggaagccaccacacccggcttgtttgggtctcaataattatgagtacacaggggtcctgagaccaactgatttgataactactgaactgccgtacagcaagacctcaagctcagaaataactcaggcgctaatgaaagttaaaggaaatatccctttcctccttttctctgaacttaatgccctagaattgtgtgaggtatcaacagaaaaaactttaatcatcatagcagagcctagtacagctataatccaaatttctactaccttctataaaccaagaggtcctgttccctttatctcaaccacatcattagtagtgttttcagtgtgaaaaaattatcattaaatttgcttgttaaaaaaaaatacgttagctttttgcctaaataccacatacatattttaaagtgcaaggggttttagactattctagtgctgattaatatagcttcagtcccctttagatcgaaaacaggaaaaaatttgtccttatgagtactggataattaacaaaatgtacataatttagttattctcacccaccgatacgacaacctggataacctcaggctactagaatccaaatcatgggttggaaatgcaacagagaagcaaacaggaatgggttgaaaattcttttttaacatgttacagacttggggctgggtgcagtggctcatgcctctaattccagcactttgtgagtctgaggcgggccgatcacctgaggttaggggtttgagatcagcctggccagcatggtgaaaccaagtctctactagaaatacaaaaattagccaagcatggtgacggatgcctgtaatcccagctacttgggaggctgaggcaggagaatcacttgaaccctggagctggaggttgcagtgagctgagattgtgtcactgcactctagcctgagtgacagagcgagactccatctcaaaacgaacaaaaatcttacagacttggtacacgtctcgctgcagataagcccaatcctttcatatactcataatgacagaaatctgtcaaatttctattcctcaaaagagactgaaccctacttaagttgataaatacccttatatgcaatataattttacttgtttaaaaattatcataattattttagatgttttaaatcatggtgttttcaaaatgaggataatttctttgtgttttatagatgctggggttttctttatctgtttttggacagacaaacccatccttttgaaatagtcatacagtgttcattggctgatcatagatatgccaaccaggaaagcctttcttccatttaactttgtcttcaaagaaacgtgtctacaggatgtcccatggtgaaggatgaggacgaggcttgcagcaagccatcccctggcccgccttctgtgctgcagtcttcttgcaccccagacacaatcacagcattgctagcttcccctccttaactcatatggctcactgatgttagtcatttctattttttctctatgcctatcaagactacctctcacaaatgcaccttgcccccaaacccttcctcccactgtccatatagttatgaattcttttgctatgtcaatattcaaggtttcaacttattacgactatgcaaatactactgatacctgagccaaaccatatagtgtactatagttcaccttcctttttgtcatttttctcctgtgcttttactatgctcagtctgatattggagaaagtgccagagacagtaaagggagacaaagtagaggaggaggagaaatgtcaaagtagctcaggatatgctgggtttttcttttttgagacagagtctcgctctatggcccaggctggggtgcagtggtgtgatcttggcttgctgcaacctccatctcctggattcgagctgttctcatgccccagcttcccaagtagctggggctacaggcatgtgccaccacgcctggctaatttttgtatttttagtagcaacggggttttgccatgttggccaggctggtctcgaaatcctggcctcaagtaatccacccaccttggcctctcaaagtgctgggattacagacatgagccaccatgcccggctgggatacgttgttgttgaattcactcttgaaaatgaaatattcccaaatttaacctgaggagagggactcaaatgacaagtattactcgggaaatatgtgaacaagtcattatatttttatttttttacttgttatttcttgggtattctttcagaaagaaacagcaatagttttgtattcttgaaggacaccacatcagagaaatgaaagggtacgccatctctggacagccctacactgccattcaaaggtatttggcccaaaagtactctgtgcggcattgctttttccattttcctcttcaaaatagcctattagatatgagctgatcgctcctaagaatcgtgagccctccttaatctctctgctgctggaccctaacacagcccatgcagaatcacctgtgtgtgaagtagcaccctgggcaagaagcccacagctgcttggtggcttggcagcctctctaggactaaaactcagtttccaagggtagtttagcaatggtaaggagtatggattctggacatactacctgggcttaaccctggcttgagcaatttattaaattgctccaggactggctacataatttgccagatccagagcaaaaagaaaatgagaggtcccttgttcaaaaattgggaatttccagactatgacaatagagcatcaaatcaaggatgggactcatctaaacacagggccctgtgtgctgtgaaacatccatgaagctgctcgtgcctcagtttcctcatctgtaaaatgggatcgtagcagcacctacctcatagagcggtaaggaatatgtgagttaattacacagacagcacttataagagtgccagcacttagtaagagctcagtaaattattatcacaccccacatagcctacactttgagtcaggccatctcaaacatactacccaaatctggtgaaaattcatttagttatttctctgtgacatggtaaaagtcaaacaggcaaacttaatttgtaaatttcattaacagcaatacagctgtttgaaaccctggaatttttatcagtaaacaaaaactcagtctaatttttttaaacctgaaacctgagtagcactatattgtgctttattgtagttaagttttaaaaattataagtacatattcatttatcatagccattgataactataaatttgttatctaatgaatgagtcacgaaaaactggaaataaccaacaattttaaaaggatgacaatacaaactacgtttcacgacaataagaaaacccagaatttggccgggcatggtggcttatgcctgtgatcccagcaatttgggaggttgaggttgggcgaatcacctgaggtcaggagttcaagatgagcctggccaacatggtgaaaccccatctctactaataatacaaacattagctgcacatggtggtgtgcacctgtaatcccagctactcgggaggctgaggcagaagaatcgcttgaatccaggaggtggaggttacagtgagccaagactgcgccattgccctcaagcctgggcaacagagcaagactgcatctcaaaacaataacaacaacaaaccccaggatttattccatatgcaaatatcttaatccaacaatatatttagctaaacataaacctttgaaggattgaatccatttattaggatgcaggtagagggatgccaatgtcttaggtagcatgtgtaaataaataaaaaatgtgttttctcttttgatgttgttgtttcctgatttaagaatgaaaggtaacttgattgtattggatcagtagtttgattcaagtaacatcgtggaattcaaaagtgcaaaggtaaaacctcaaaagcatatttaggccaggctcggtggctcacgcctgtaattccagcactttgggaggccgaagcaggtggatcacttgaggtcaggagttcgagaccagcctggccaacatggtgaaaccccatctctactaaaaatacaaaaattagctgggcatggtggcaggcgcctggaatcccagttactggggaggctgagacaggaggatggcttgaacctgggaggcggaggttgcaatgagctgagattgtgccactgcactccagcctgggcgacacagtgagactccatctcaaaaaaaaaaagggggggtggttattcatcagctgttaactgattttaattaagattttgaagaatattctcaaagtcaaattgtgtgaccatagtgtatataaaatgaagacagcaaacatcgcctatggaagaagacataggttgggctcaaagcttgcacctttcctctctcggtagttctggctctgagtcccagctatgccactgactcactgctggactgttctgtgtgtcagtctctaagcctcgtgccaatgtccactgtgtgcctggtataggtcttggctcaggctaggtggcaataaatgctgttgttggtttgggagtggggagtgccatttggtaaaatgaaaagaacatggattccaaaggtaggtctcaatttgaatcctatctcaatcatttactagtcatacaatctccagtagattttatttttctaaaccttggttcttaacttgcaaaatagagataataatatcttctttgcaggactgttgtgagaatgaactgaacttgtgtgtggctggcccataacaggcatcaacaagtgggtttgaatccaagcccctaccttcatagtctagacaccaggcagaagagactaactgctttgggctgtgaggatgagacaaaaaagcagctccatctactttgagaagtcaaatgtgtcaaatgcttgtttttatttgtaaagtaagacacataaacaatattgtgtttaaagaatgatggagggcaggtgcagtggctcatgcctgtaatcccagcactttgggaggccaaggcgggtggatcacttgaggtcaggagtttgagaccagcctggctaacacagtgaaaccccatctctactaaaaatacaaaaattagctgggcatggtggcgcacgcatgtagtcccacctactcaggaggctgaggcaggagaatggcgtgaacccgggaggcggagattgcagtgagccgagattgcgccactgtactccagcctggtgacagagcaagagtccgtctcataaataaataaataaataaataaataaataaataaataagaataatagggctgggtgcagtggctcatgcatgtaatcccagcactttgggaggctgaggcgggcggatcatgaggtcaggagtttgagaacagcctgaccaacatggtgaaaccccgtctctactaaaaatacaaaattagccaggcgtggtggcgcgtgcccgtaatcccagctactcaggaggctgaggcagaagaatcgcttgaacctgggaggcaaaggttgcagtaagccaagatcacgccattgcactccagcctgggtgacagagcaagattgtcgcaaaaaaaaaaaaaaaaaaagtatttcacagatcccagagcacctacaaagtaagagttgttttatgcatttgccaaatccattgaaaattattttaagactgaaaataacattttcaaaaattatttgccaccaaatgtgcctgatctaattcagtattggggtgcgaacacacgccgaaacagtacaaaaataggcttatcccaagcacattaatgaagaacatgttataagatgattttaaactaatctgcagctctatcactaagcatctagcagaacacattataagcgttctatcaggttatttctggtgtagacaaacgaaaagccagtttctattatttgactggtgcccatttgtattaaaggactaagatggaaaagaggcaaagaatttcctaattactgatgacaatgatctgctgagtcaagtcagaatgtgattcagtaagattggaggggaagggaatgcaatataatggatgggtacagtattgctggtactgtgttgagctgcaggaagattttgctgactttcttgagaagtgaggggatctggtgcctgagcaatcaaccatgattcatagtaacttgctacagtgctgtttgaacagaaataaaatttgacctttttctatgcacccaagccactcaacaaaatatatttgtaaatacaattccatcttctgacattggatctaggcggtttatttaaaaagctgggtctttatgattttgttttgcatagacttaaaaaaaatttgtgtttgttttatccaggccatagattcctgctctactgctctttttgcctcctgcttctgtttctcagaaaaatagaaaattgactttgctttgttcaggggagtccatggcatgtccaccactcccatttaagtcaggttaacagggtaaatgctgacgatgcactgagtctactggttctaaaagccctttgtatttgctttaccaccttataaaaaggcatggatcagtatttgtgttgaccttgaggcttttcttctcacaccacgcagatatcttaacacaggggttcacacatggtgaccgggcagacagatgcgtgtgaaactaatgtgtagactaaatgcaatatacagttaatgcctggtgggaaacagaattttcctttaattgcccatttgtaagattgaataagtaggcaggcagagtgtaaacacagccccatctatagacgtgtgtcttgggaacagaaaggatcacacattcttaagctaagacaaaggctttagtttgaagataatgtctttgattatttcagcatggagggctatagatagcctcttggaggctccgctagaaaaaattcggaatggattaagtatatattttcccactagctgtgtctgaacacatcactcacggctcatgcgaaattatttctctgccaggcgtggtagtgcatgcctgtagtcccagctactcgggaggccgaggtgggaggactgcttgaggctgggagttcgaggttacagtgagctatgatcatgccactgtactccagcctgggtgacagagtgagaccctgtctccaaaaaaagttatttccacaattcattcctacattccggaaaagaataaaccatattaataccacatcccaatgctagtattattagatctgagtagtgaacacatagactggtattcagagattccccaaatcaatctttaattgttagacataataaaagtgaaagggcagattcaagtccaggaacgtggacagatcttaagaaggaaaatctcctttctttcaatctcccagcttctcaaacccgtagctgagtcttgagcaggcaaatgactcagaaacgtttatggtctccctggtactaaagtactgtatacttagtttcttaaaagaatctgattcatagtgagccattctactgaaattgcacgatttgtatccaaatagcaatacaacctctatccaatggcttttggtatataataaatgctctccaggctatatgtaacattcgttgtttactatattagaaccagtagtttgctttataatttgaattgtataaagcaatacttatactgtgtgtctactagattttatgaaaataagacttgaaaagatgacattcctccaacaatgaaaccatgtaaattgaagacagggacctgattatactattaagtgaaaagctaagttgctgaacagtctctagcagggtctacatctgttatctgtccatttctgtatttgtgtataaaggaacaacaaaagttagacgaaaatgtgacaccggaatttatccatttgtctcaaagaggcgggattccaggaagttttaattttcttttttatgtttttccttttataatcagaggaatgtcatttttaaaaggtttgagttgtggtgtaatacacatagcatagtttgccatcttaaccatttttcagtagacagtcagtagcattaagcatgctcacactgtggtgtaaccaatctccagaacttcttcatcttacaggaatgttgtttttaaaagagagaaccaaatacttctccagatgtatgtgttttgaaaaatcaaatgcaaagtaagtaatggcttaatcagaccgaaccaccataattgaatagcctgaccaattcgtgaaagaactagccatgggcctttcactgtctttttttgtttttgtttttgtttttctgagacggagtcttgctctgtcacccaggctggagtgcagtggtgcaatcttggctcactgcaacttccgcctcaagcaattctcctgcctcagcctcctgaatagctgggactacaggcacaagccaccgcacccggctaatttttatgtttttggtagagacgggatttcaccatattggtcaggctggtcttgaactcctgacctcatatgatccaaccccccaccttggcctcccaaagggcttttgattcagcacatgaagaggaaatcacgggcagagctgtagaaatcgtattagaatttcatctgtgtagttccttagaaagcttttcattgaaccacctgtttcaatttccattttttaaaaaaataaaatatacctctgtctgtaatcacgctacgatgagcagctgacattcttactcaggacttagaataataatgctttagagtcctgcacgaagcctccaaaagagtggaaaaaatacacaacccttcgaaacaggtttactcaagcacggtgagagaggctgggcggtcattgattaacagggtatgcgttccttctcaaagagatggcaaaggaagcttgttctaaacttttccaccatttcaatggctactttctcctgagtcattaagggaacactggtattaggttttgtgtcacagttgtaccaaggatacctcgccagctaaagttaatgcttttctaagtgcttatgaattaggggacagtcccggttctgagctgaaggaattctcatctaaatgcaaatcaagacaagcctgtctaggatgcataaataggtacagtaatttttccaccatttaatgttcagccccccaaatgcattttcacacaactctattggtaaagaagtatcccttattagaattaaacgacatttgctttcttccccgcaccggctgttacataggtagaaagtgttcagagtcttgatttggttgacttaaggcatgggaaataaaatggacaaagagaatcattttcctaacctctgcttctccacatcagacttctaaatccacgtccgtgccatttctatttgatgtcccaaaggaatgaaagaaaatgtgccccagatggaactgaggtttcatcccagctctacttctccgtccagtgtttttctaatttaatgacactgtcatccttcctttcatgccagaaactggagagtccccctagagtcctcttcccacacgccacatatccaggctgcacttttataatgaattccttcctctgaatctccactcctgtggctgtaattcagccttttgtcacctctcactgggctactgcagcactttactggttttctggtttagtcttttccgcataaattccagcctctagcctgttactagagtaatcattccataaaatgcaagtctgttgctgggcgtggtggctcccagcactttgggaggccaaggaaggaggatggcttgagcccagaagttcaagaccagcctgggcaacacagggagaacctatctcttcaacaacagaaaaaaaattagtcgggcatggtggtgtgtgctggtaatcccagctacttaggaggctactcaggatagcttgagcccaggagtttgaggctgcagtgagctatgatcacactccagcatgagtgacagagggagaatctatctctaaaaacaaacaaatacataaaacacaagtctgggcttggcacagtggctcacacttgtaatccctttggatttgggattactttgggaatctttgggaggctgaggtgggtggatcacctgaggtcaggagttcaagaccagcctggccaacatggcaaaacgctggtctcttccaaaatttaaaaaacaaaacaaaacaaaaaaacgacacaaatctgaacaagtccctcctctggaaatcatggcaagggagggaagggcaagtttatgctgtttgtctgtgccacttcaaatgtgcagcccttccttactcaaggaggttaaggggaagaacaaagacccttccaccttcactttatgttactccaaatctcctcaatcagcccaaaagcagagtgtgtaattctataacgctctgaaggcaaggagtataatcttcaagtcctaactctgctggattatttaccacttggccaacattttctttttgtttttgtttttcaaacagggtctcagtcctctcgcccaggcaaaatcatggctcactgcagcctcgacctcccaggctcagatgattctcccacctcagcctcccaagtagctgggactacaggcgtgcaccaccagcccagctaattttttgtatttttaagagagatggggttttgccgtgttgaggctggtctcgaactcctgggctcaagtgatctgcccacctcggcctcctagaccgctgggattacaggcgtaagccaccacgtctggcccactttgccagcttagtggccagtctgatcctccttaagggcaggacaaataactaattccactgccctctccagtggaatgcactccacgtctttagtgaggcaaagcactactgtttgtcccttgcctttctggggatgagactcaatctgcccctttgcattggatgttccaacaagcaactggctagcagtataaagggaagctctggcacagattagtcacagattggcaaactttctgaaaaaagcccagatagaaatatttcggctttgtgagccatatagtctctgttgcagcaactcactctgctgttgcagcatgaaaacggcaaggacaataaataaatgaatgcacgtagctgtgtgccaataaaactttaatcacaaaaccaggtggtgggccagacttgacccatgagacaccatgtgccaaacccctaatcaggtatatgagctaagatgctgcgtcaaccttggatcagctgagaatctcggatctctccagaggtgacggacaaccatgctgagaacacggattctggagcccagctgccttggttcaaatcttggctttagcgtttgctagccattgagcctttgggggagtaactttacacaattttatctcatttgagcctcacagcaaccctgtgagataaatccgatattcccatttaacagaggcccgggtacagtgggatccaaggtgcaggaacttcccattagcacagggacatgccgagtcactctcatcttttaaaagaggtgccctccctgcctgggtccccctcctcctccagccaagccctcactcacatctcctcttcacaccaagcttcttgataaagctgtccacatcctccacccttactttgtcatctcacactcactttgcaaccctctgcaactggcttctgtccctggctttgaaattggtgacagttttatcatgatggtttcttagacaagaaatacacatatttaaggtctactgcatacctaggtgatgtcctttattgacattgccagcccaagttagggaaaaagataatcacggtgcactctgcctcccaatagaggtgctatatgtaggttacctgtgattcactctagtgaacatctcaactctacaacaccaatatttgagccctggcctcacccaggtgaaggcagggttgcctctctaggatggaaaaattcaatatgaaccctaaagtggccatcgtcatggttaagggatgcagattttatcttgagaactctatcaaccaagagagcaaaataatacactactggacatttccatttttcaccctacacttgcatccctgtgaccaaaatgatgctaatccaaggccatgcaatctgtgcatctgtaggagtaggtatttcatctgttagttttgctgccccgtgagtgaagaggcaggatgcacccttcaatggctttagctccagagttctgcttctacaggatgcaccccctttttgctggggagactctcaaagagaggaatgatctcaactgtctctgagtgctcagtgcctaggacagtgccaagcagataggaaatgaccactgaacaagtgagtcccctcatgggtccctggggagacgacagaggcagggagtttatcacattaaaaagatccaacagcttttctttggagctcagctaccctggggaacagaatgagtaagaatcccaaagaccccggccactgctcagaaaaaagggccacgctcccagtcgtgtgtgtctctctctctgccttctttctgttcattgagtcatgattccaacagtgcaggaacataggaagaatgccaattataatatttttttgacagctgggagaatagacacactctgcctgtctcttcagcacacaggcagcacttgtctaagcgccagctctcgtgataaccaatcccgctgagaatcagttctctctgtagctcctactccttgacccaatgtgaaatttttccaaactatttttaaagtatctaatctgttgtgagtcacagactatagagctgctagtttaccatttctgggcagacagctttaacatcaagacctgatgaggttgtaagggtatttaaaatggcagtcaggaatataagagcaaagtggtgcatataaagtctttaactgttccttaatgtcaagcgatttgagatatttatagattttttaagtgcctttctatctttgaaagaaaaggtaattatttcacataacaaccttgaaagactggtcagtgatcttctcccagattttcataataggagaactaggggtcttggagactgactgaatggcaaaagacagtccatttttaaaaacaacccaaagctcttgagtttattatccatggctcaattcactgagctatgctacctcccctcacaccggatgaaacaagtattagttatctactgatccataacaaatcaccaaaaactcagtggcttcagacaacaataatttattatctgttatggactgaatttatgtgttatgtgtttccccaaaattcatatgctggatccctaacctccaatgtgactgtatttgcagacagagcctttaaagaggtaattaagtgaggccatagggtaggccctagtccaataggacttgtgtccttaaaagaaggagaggagctgccaaggatgaaagcacagtgatgcctctgtaagccaaggagagaggcctcaggagaaactgaacctgccaacaccttgatcttggacttccagcctccagaaccgtgacacatcaacttctgttgtttaagctgcccagtctgtggtattctgttatgatagtcccagcaaactaatatagtatctcttatggtttccgtgggtcaggaattcatgaccagttcagttggacaatcctggttcatggtcttttatgaggtctctcagttgggtatagctggggctgcctaatctgaaggcttgactggggctggatgatccacttccatggtatgccctcccatggctggcaagctagtgatggctgttggcaaggggccgtagttcctccctgcctgggcctaatgaaacttcttcattcagtcctaaccaaccatcctgcagccttccctttagtttagttatatattaaatatataataagaagaaataggacagcccttattttctcctgtcaggattttggtaccataaatttaaaaatgaaggggagaaaaatcccatgtattttccatggtgcactacccagatcccctttcagaaatgaagggtattttcccagctgttgagaaccctgccaactgacaaccttcaactattagccgggattgcccttggctaaagagagctgccttgcccaaggtcagctccctgcccaggacagctgtcgtctactgactggctggtgtcagagtataaaggcctagtttctttgcaccaacctgggataactctgatgagccgccccagcttagtcctccctgtgggttagctgaggcctttgttgagactgcattgcatcacaacttcaccctctgcccaatcttcctgccttcccttctcccacaggtgtcaatcctcagagcacttcatgataaacatcctgcacaccaatctcttcttagagtttgtatctgaggggatgcaaaccgcaacaatctactttacaggaagattattctcagagctgtcaaccatctaaaaatagccaaatgaacctccagattctatctagtacatcatgtgttcaactgcagacctagctgttgaaaccaagtgataaggtagattgtcttggtagagatagaggtgtgcctaatcctccacttcttcctgtatccactccctctgtaatgtgactgccacttctgcttcattttgttggccaaagcaaatcataaggccaacccagatctggggaggaggaaacagattctaccttggataggaggaactaccgtgtgcctgttctgagcctaggcctcaagggaccttgcatatacttctgtctctcttggaaccctgtcacaggcatttgaacgagctggggctagcctgctggaaaagagaccatgtggaattgagacaagttagctgttcctgccgaggtcactctggtccagccagtccccaagtaacctggtaggtgaccaaagatgtagtatgaataagcacagtcaagaccagaagaatgcccacccaaattgctgacccacagaattgtgagttaagtaaatggtggttatgttaagttttggggaggttattgctatgcagcaatagaaaaactgatgtagtatcagctatggtttggatgtggtttgttcctgtcaaaacccatgttgcaatttgatcccccaatgtggcagtgttgagaggtggggcctagtgggaggtgtttgggccatgggggcaggtccctcatgaatagattaataccctactgcaggggtatctcacaggaatggattagttcccttgagagcaggttgttaaaaagtgcctgtcttcctcagtttctctctcttgccaggtgatctctttgcacatgtctgctccctttctgctttccatgagtggaagaggcatgaggccttcatcagatgcagctgctccatcttgagctttccagcctccagaatcatgaatcaattaaacctcttctctttataaactacccagcctcaggtatattgttacagcaacattaaacagacaagactcaaatctgctggatacatgaatcagctggcaaaagaagagcatagagaattcagactatagaatatgtcctcgattcattttaatgggctctggtgcacccagctgctgcagaagctgctaccgatggctcacacctgcaacctttttagcaggatcgttcttgggtgatcaaagccatctcagctggaggtgcatctcccttgtcctgggacatcctataactaaagcctgtcttgtgtgagggcacaaaatccagctgtcttgcctcaaggtagggcaaattctggggcaatttacagcaccaatctcctctgctgtcacaggctgagagtggatctcatctgcaaccacatctttgctcagcttcttcttcctttctctcaccctcttacaggttccttccgagagcactcccttaataaacaaacaaacttgctcctgaaaccccagctcaggctctgcttccaataaatcaaaagtgaattcctaggagaaaaagatggggagcatgggagtgactgctgtggaaggaaattggaaaagcgctgatcatcctaacacctttgcagtagaagttttcaaaccaatagaagatgactctcctcccattggtccaagacaaacgtctccatcgcaagtgcttgatgtgctcccactgcctataaggaaacgcactcctttcctttgtaagacgggaatgacactttcttttctctccaatctttaatttctccctgcactcactctttccccagtagggtttgagtctattcctctttgtaggaagatgccatcacctccattcttctagctacagcccctgtcctctctctcacatcaggatacttgagctatctacactagagatcaccacttctttatcccttaatcatcaactcacattacatggcttctgctgtcgaccctgccactaaaagtatccttgccgaagtcacaacgaccttatgttacacaactagttggctgcatttgatgtcactcaacactcttagtatgtgaaacacgattacacacattccctttgctcctgtgatgctgtgttcacttggatttctgcctcatttccagggaattcagaatccgtttttttcgattgtcccttagatgtccacgtgttttctggttctcttttcacctgccatacatttctatgaattatttcacctactattatagcaccaattgccacttatatctgaatgattttcaaattgaagttccagctccagactcaatatccacttgccctttgggcacctcgacttaaatgtgccacaggcgccttattggactaccaccacctacacacacacctgtgcacacacctgcatgcacacacacctgtgcacacacttgcacgcacacacctgtgcacacacttgcacacacacacacctgtgcacctgcaggcacacacctgtgcacacacctgcatgcatacatacttgcacacacagttgcatgcacacacacctgcatgcacatacctgcatgcacacacacctgtgcacacacttgcatgtacaacttgtcacacacctgcacacacctgtgcacacacacttgcatgcatacacacctgtgcacacacctgcatgcacacacacctgcatgcacacacacctgtgcacatacccgcatgcacactcacctgcatgcacacatacctgcatgcacatacacctgcatgcacacacacttgcatgcacacacacctgtgcacacacctgcatgcatgcccacatacacccacacacatgcactcacatatacaccctgccctcttcctcctctgctccatacccccagagctggaactatcatccatccacttttccatggcaaaacctttggaatcacccctgatttgtctccttccccttcaattaatcaaccactaccttccaaattcctttcaattttaccttcaaaattgccctctacttttaaacacgattccatttctttctaccttcagctgcaacctgggcctagattacttcacactgcatctcgtctgggctcctgttctaaccacctccaatctaatttccataaccagttaggggatcaccctaaaatgcacagctgattattgcttttccctgttgaaaagaatttcgacttcctctgggatcagctcttccactcatcaagataggatggggtttcctcccacaataacggaacgggttctatcacactccattgtaatgaattacctgtctgttcttcccaaagaaacaaaagctccttcctttgttcaattagtagatattcactgacaccttcctatgcataatgcacggagctgttaatcaaatggtaaataaaacaaacattggccttttcccattagcagggctcacatatttgtcatcctattacccatgctagcagttttaggcacataagttgcttaataggtatttgctgaataaatacatgataaaatgagtgctgttggccgcgcgtggttggctcacgcctataatcccagcactttgggaggccaaggtgggcggattcacctgaggtcaagagttcaagaccagcctggccaacatggcaaaaccccgtctctactaaaaatataaaaattagctgggtgtggtggtgcatgcctgtagccccagctacttgagaggccgaggcaggagaattgcttgaacccagaaggcagaggttgcagtgagctgagatcgcggcaaggcactccagcctgggtgacagagctagactgtctcaaaaaaaaaaaaaaaaaaaaaaaaaaaggagtgctgtcttctaaagactaattttctccattccattccctattttagaataaaattcatgggaacagattttataaaaatgatcttcatggtcgatgtttacagaaagtatctttttattacaaaaggcagagataaattacatccaaatattttcagaccatcaaaagtctttaagtaactcacattcctccacagagattatcctggtagccaaattaacagaatcagccaagcacataaggaacttagcacataaagatactcaataaaatccaattataaaggagcaaatttctacgaacttgaaactaccacccaccctgctgccagaatgtaatgatatgttctctgcatgccaaacatatcttctcccaaaagataacaactgttttgggttgaatagcgtcctctgaaaagaggttgaggttctaagccctggtacctgtgactgcaaccttatttggaagcagagtctttgctgagtaatcaggttaacctgctgccaggatgctgaaagcagaaagggcttgagccaaaccttggccacagaggctgtgaatgacgcaggtgaaggcagcccttgctggcctgagggctgaaacttacaagtggggtgaggggcttgcttaccatcaggtaaccaatggggacattctcttccattccttgaaatacaccctttcaaaatgtaagtggggagccttgggccatcagcctgattttcagaagctcaaatgacataaaaattggagtcttgaccagatcattcctctttttggtttatggtgataaatatacataaaagttaccatttgaacttttttttttttttttgagatggagtttcactcttgttgccctgggattacaggcgtgagccacctctcccggccaccatttgaactatttttttttgagaaggagtctcgctctgtcgcccaggctggagtgcagtggcgccatctcggctcactgcaagctctgcctcctgcgttcaagcgattcccctgcctcagcctcccaagtagctgggattacaggtgtctgccatcacgcccgggtaattttttgtatttttaggagagacggggcttcaccgtattagccaggatggtctcgatctctcgtgatccacccacttcggcctcccaaagtgctgggattacaggcgtgagccactgcgcccagccaccattcgaacgattttcaagtgtacagttcagttgcagcaagtacattcatactgttgttcagccatcaccaccattcattgccccaactctttcacttttccaaactgaaactctgtctccgtcaaacactaactcatcttttcccctccccccagcccccggtacccaccattctacattccgtctctatttggatgactctagggactcctataagtggcattatgcagtatgcgtccttttgtgactggcttatttcactcagcacaaggtcctcagggcccctccgtgtcactccctgcgtcggaacttcctctctttttaaggctgggtactattccatcatctgtatacaccacatttgtttatccattcacgacatttggattgttgttgaaatcccactcgactgcacactcctgctgccagccgcgtgctgggcacagggcacgtgctctgggtcagctgctgagtatgggacacagctgagcatactcactctctctctgaccccaggacactccctctctgatcaccgtggcaagcctggaaggacctatacttgttggccttgaccaagggctgcgtggttgtgtggggtataaacagttgggttataaggagataagaacaccactttcctgttacactcgcggggaggaagctgacagcaaacccagagcactccctgtattctcttttctttcaactgggaaggctctgggcttgtccccagcacaaagctgctgccgtcaaacatcagggactcgtggaagagccctgcgtctgtgtctgtcactatcccttcaaatgatctcaaataaatcgtggttttctcgtcaaaccactgtctcttcttaaatggggttattctaatccatgatccctagtcaaagcctaattttcttttctagaaggttctcccttccctctcccttaatgtaaacactgacagtactccaggctcagcccagcaggtgacgtgccttgaagctgtcattgcccttatcagaccagcggttttccgtttctccctcctgtagggccgactgtgccactcattatcccggcgaaaccgctctccccctttactgagctgttttgccccagtactgttcagttcccaatcagattgtaagctctagaaggcaggaacaataacttgcagtttaacctttggcacctgaaataatactttgctacacctgtgtttaataaaataactgaatgaacaagaataggaatagtatgttctcagcatggcaacgcatcttctcctaaaagataacaactgttacagattggaccgtatctcctaaaaagagatgttgaagttctaagtcccagtacctgtgaatgtgacttttggaaatagggtctttgtagatataatcaggttaagatgataggggtgggccctcatccaatgtagcttgtgttcttttttttttttttttttttttgagacagtgtctcgctctgtcacccaggccggagtgcagtggtgcaatctcggctcactgcaacctctgcctctgggttcccacggttctcatgcctcagtctcctgactagttgggattacaggtgcccaccaccacgccaagataattttttgtatttttagtaaagacagggtttcaccatgctggccaggctggtctggaactcctggcctcaagtgatccacccaccttggccttccaaagtgctgggtttacaggcatgagccaccgcacctggccttgtattcttataagaaggaaattgggatgcaaagaaagacaaagggaagatggctatgtgagaacgggacagagactggagtaacactgtcacaagctgaagctggagaaggcaaggaagaactctccctagaggctttgaagagagtgtagccctgccaacaccttgactttggacttttggcctccagaacagtgagacagtacatttctattgttttaagccatccagtgtgtggcactatgtcatgccccagtgacatgcgacactaatgtgacaactgaatggagtggttccagccatacaggtagacccagggatgtggctctcacagtgtcgctgggcacgggaataatactgggtacctgcggtaattaaaccagcagtgacagctggggtctcagtagggcccactgtgttgaaacagagagtgcttaagtgcttagtgaagccacggagattcgctgcctcggtctcaggaagtgctggaggctgcacacgtctgtcgctccatcccactcctctatgaaatgctccccttccaaagagggcatcctaagtctgatgatgtcatcagactcaaaatcttaaacctctagaataacacttctgttttactttttttttttgctttacctatgacattttatgaatactgtagtatcccaagcaaggtaaattcaaataaagctttcaatgaatgatttttaagaagctgaggggaaaaaaacctcctcctggtcatgtcccagatgttaccatttttcattttgtttctttttttcttttttttttcagacagagtctgctctgttacataggggctggagtgcggtgtcatgatctcagctcactgcagtgtctgccatctaggtttaagcaattcttatgcctcagcctcccgagtagttgggatacaggtgcacgccaccacacccagctaatttttgcagttttggtagagacagggttttgccatgttggccaggctggtctcgaactcctggcctcaagtgatctgcctatcttggcctcccaaagtgctgggactacaggtgtgagccaccgcacccagctattttttgtgtatttccatttgctattgtgccctcaccatttctccctcagcctgtgatttatggtacaatatcctgaagatgtcgggagcacacgacctcagcctcggctgcagatagactgctcagcttggggcaataactgctctgccctccctctgccacccggcagccccacccacagaagggcccagacttacggctttggagggagcatagtgtgtcggtgatgccagtggaggcctggtcgggctctggaaggaagacgggcagaacctctgccctgtgtccgggggggaagacgaggcatagatgcgattctctaaccgttcaggctcgtgcttataggattccaggggaaacgtgtgctgcttggtcacttgggtgggtgttgacggagaggaggagaggccggaggctgcagaagaaacaccaaggacggtcagaggtccggcttccaggaagggacgtcgggggtggtcagaggtctggtctccaggaagggagatggggagaggtcagaggtccggcctccaggaagggacgtcgggggcagtcagaggtccggcctccaggaagggacattggaggtggtcagaggtcccgccatggcagagggaggctctcaccattcctggtgcccaaaacctcaaatggcaagaagccaaattattctgaatgttgaggaaaagctttaaaaaccaatttctagtctcttagaatcagctgtttccagaaacgcctcactatccacgctcggttgtgggcagcatcccctcattgggaacggggtgctcacacggtcccgagttatctggtgaacttttacacacaccctccagaggctattttcctccattcagccaaatatcatttgatctcctctccttctttccccagcatggcgccaagagcaaacgcagtggtgccttatttattgaggtaaaacatggggaagttcggaaaatgtgcagcagagatgcaggccaatgctgcagaagccatgggaccatgtatctgaggagggggagggggaggggacgggaggggaggggaggggaggggatggatgtgttattcctaccaaaacgtgcaacatgaacatcaccactgtaagttcccagtagcaagacttcactgcgaagataaatacccaaggagacttcagggaaagggtgggactggaatggggtctaaaaagtgaaacagatttagatggtcaggaaaagggagggggcaaataatgggaggggcaacggtgttagtggaggattgtaggaagactggagacatgaatcttctgggagttaaaggttctccactttgacttatttctaactaacagaaacaactctatttcttccatagacttatttatgtaatttttaagtggcgagtgtacacctaattcattaccatggtgcttttgaaagcagagctggagatgcagaggctcgtcaagaagaggttaaataaatcatggcacagtgcacaggtaggatgtgacctgtgaatgtgaccttatttggaaacagggtcttttcagatcaaccaagtctagatgagattttgctggactagggtgggccctaatgcaatgtgactggtgtccttataagaagaggaaaagagacacagaaacggatacccagagggaaggcctcgtgctggcagaggcagcgatcggagcaatgcagctgcagccaaggcgcgatggggattgctggcaaacccagaagccagggcgaggcaaagaggaatcctcccctacaggtttcagagagagcgtggcgctgccaacacctcgattttgaacttctggccttcaggacagggctaaattttagttgttttaagccactcagtcggtggcactttgttataacagcctgaggagactgatgcaatgcatggattgtgttctaagagaagcagaatctggctttgggtctgatatctcaaatctctttttcttttttttttgagacagagttttcactcttgtcgcccaggctgcagtgctgtggtgtgatctcagctcactgcaacctctgcctcccgggttcaagcgattctcctgccttagcatcctgagtagctgggattacaggcacctgccaccaggcctggctaatcttttaaaaatatttttagtagacatggggtttcaccatgttgggcaagctgctttcgaactcctgacctcaagtgatctgcctgccccggcctcccaaagtgctgggattgcaggcatgagccatcacactcaccctctgatatcttacatcttacaggtagaaaaataaaattttaaaataaaatttgaattatgcaagtcaaaccaaagatgtcagtgaacatgccctgttaaattacatgtagcctagagctgcctccttaaatattttaagtttggcctaaagggttttctgtacattgtgaactgtaacagaccatagcctacattcgtgccagccagagttttggcaatcacatgtagccaactgttccaaccgtgttcaagtaagacaaatgctgagctgtaaccaatccaggtgtttctgtgccttacttccgctttctgtggtcactttcctttttctgtccatcaatcttcttccaccacatggctgagagctgggctctcggagtctactctggctcagaaggctgctcgatttgcgaatcgttcattgctcagtcaaactcctttaaacataattcggcagacgttttccttttatcaggtcctagagccaccagtcactgtttctggtctggacaaggctgcgtcacctacagagccacaggcctggttcactctccccaggcatctctgctgggttcctcctcctcgcagctcccagaaccacccgtgtccctcctgctccatcctcatggggaaggacctgtcctcctgtccctcgtgtcaccaaactcataaagccttttcactgtcctgtatgttaccacttaatgacaaactgtttaacgttcaaaccaaacataaaagtatgtaagtcccctctccccaccaagatctaccgtctgtcttggggacgggggtcctgccactccctctgggccccagggcacccagtgctgtcctgagccaaggggtctggcaaatgcctgctgccaccaggcaaggaacagaaagaacagtgagaggaccggctcaaggtcagggtgaatctgttcctctctgtggagagtggggcgcatgttttgttttgtgtgtccgggggaggtttaggaagtcacctattagagaaggagcccccttttccagggagtcccttcaggagactgagcagtgtgagtggaaagccctctggaagccccgggctggcacttgggaggcagctctgggtggaagcaggaggagagggttaggacccgaaacttaaaatgtaaaaggccctcacaacaaagtcccaaactcttgaaaaatagaggccaggtgcagtggctcatgcctataatctcagcatttcaggaggctgaagtgggtggaccacctgaggttaggagttcaagaccagactggccaacatggcaaaaccccatctctactaaaaatacaaatattagctaggcgtagtggcgcgcgcctgtagtcccagccactccagaggctgaggcaggagaatcgcttgaacccaagaggcggaggttgcagtgagctgagattgtgccactgcattccattccagcctgggtgacagagtgagactctgtctcaaaaaaaaagaaaaaaaagaaaagtagaatattttcccccaaaggtcttgagaagaaaaccctgctttgaggtggggtggggaggaaggagagggaagaggaagagtgggaaggtcctgatgtggtttagcagctcttcagagatgggggtgtgtcagcaggcaggaccacaaaagggctgccggcccatccggacccttctcagggccaggctccagctgcttggcactgagaaatagagacagtagccagggctcggggaggcctgcccggggcctctcagggggatctgcaggggcagagcaaagaagcctgtgtgctattttgtgtgtagtgtggggcactgcctggggccttagaccccagagtcatatccttcagtggttcctgcagcaacaaagtctccagcaggggctcgtcctggtcccacaatgcacctaggacaggctatctcctctcctgagagtcaagagggaatgttctcatcctcctctcccagcccctttccccactggacacagggccccttcagtggcacttcccgggggctgtgcccctgcttcctgtaggcatgtgcagggacctgatggggcagagctgaataggatgtggtggggggcgttttaggttcaaaaacctgtgccaccccccacatcctcatgacctgtgacagccctgcagagaaacccctctggggggctggggtcttcgtgtgtaaaggaaggggccagccacagagatctctaaagcctcctccatggacaatgctgaaaagtagctatgtccatccctgagcagggcatgatcaaaactagccctggccaggtgcggtggctcatgcctgtagccccggcactttgggaggctgagggagaaggatcacttgagcccaggagtttgagaccacctagggcaacatggcaagaccctgtctctattaaaaaaaaaaaaattggccagatatggtgacatatgcctgtagtctcagctacatggcgagattgcttgagcccaggagttcaaggctgcagtgagctaggactgcaccactgcactccagcctgggtgacacagcaagatcctatctcacaaaacacaacacaacaaaatgagcccaaactgcacccatgcaggcattgggcaaaggcccagaggaaacaggtactctgtggtgcctatctaggcaccactgatcaaaaccacaaacgcgcatgttcctggacccagtaattccatttctggggccatagacttatttgtgtaattgctaagtgtcgactgtactaagtgtcggcttattcattaccatggtgcttttaaaagcagagcctggagacgcagaggctcgtcaagaagaggttagataaatcatggcccatctgcaggcacaggcagccaccattcctgtcggaacatgacagggatcctcgttcctttcatctccaagatggagcggtaagtgaagaaagccaactgcagagccatctgtatcgaatgataccatttgtagttttgaaaaaaggaaagaaagtatctatattctgcctgtctgattttgcctagactatctctggcaggatctggaaacactggctgtctccagggaagggaacaactggcagggaggactttcatcatatcccctttttgatttttcaaactttctatcatgagaatggattatccattcagaaaattacttcttttcagccactgctttgcttttgagccaagaggctggcgaaggccatatttaagcactgacctgcttcctgccctgcctgccccgacgcgccccccagctctgtgcaggggtgtctcccacgaggaccaggaccaggacctctgtcctgtctcccactagaatcagggccatggctgtgccttcctgagctgtcctctcccttgctctttctcttcgagaagtttttccacttccaacattcttcagggatgaagcttagtcactgttgtgcaagggatgttcacagcccatgaaaactccttgctagttctttgggtacagaacgttcatctttcaagtaaacagtttaaagagaatgcaactgtgaccaagcccctccccaccccctgccgagagctcttaagagcacaaaccacggtgtccgctcctcccatggccctgtccccttgcaggccacccccgtgtgagtactggaatgatcctaacccagtcccaaaggaggtgagagaggtggcgggatgcaggagtgaacctctggggccgaggagatgagaaggtggactgttcatttgggggtgggaacacctcatttctggtggggctgaatgattctctatcattgccatctttccaagttcagaagctgctcccatctttccacctggccttcctgttccttccagagctggtgactcctgtggggaaaacaggtggcactctggactacagagggggaagggaaacttttagaggaagggacaggtgaaatgctgagactcacagtgtgtgcattagggatatgtgtgtagttaggggcatggggagtgaaccctcctggaacctaacatatgccctatctgttgactgatacccgaaatgtttttaagagggggtagagtcttgcagcatcaacactttttttttgttttttgcacgatgccaccctgtttacagagggcttacacactctggccccctctgcccctcacagatgaagaaactggtagctggagaaagttcagctacttatccatggtcctttagcgaataaatggcagggaccacacctcagctccactgtcctgactctataacccagacactttctgccacaatcaaactggggtatcaccgagagaaagaacatgaagacttaaaattacattttagctgtatgaattactctcccagaagtggggcttcacggggccaacaggaaggagagcttggatgacactgggtgactgcagagggaaagaagaggtgccacagaagagagaagggcacagagacggagtgagcttgggaccccatgtgcttcctaaggtgggacagccccatgtagggagggacaggcttcccccaaagagggttttcttccatgccagccaggaagggtagaccaacaaagaagtgacttctactcaggtttatgctattcaatcagtagagaaacaactgtcttatgagtcaggtaaggtgggtagtaagaatgattcctaagctttttttcttttcaatgttggtatcactattcataaataaaagggaaaatgggcaatgctgacacaatccctcattactttttttgagacaaggtctcactctgtggcccaggctggggtacaatggtatgatcacggctcactgcagcctcaaactcctgggctcaagtgatcctcccacctcagtctcctgagtagccggaactccaggcaaataccattacaccagctaatttttttatttttgtagagatggcatcttactatgttgcccaggctggtcttgaactcctggtatcaagtcacctcctgcctcagcctcccaaagtgctgggaatataggtgtgaaccgccatgcctggccccccattacttttaaatagaccaatgtatttcttaatcataaggtcaactgctgaactcaaccttgggtctgatcagtaaatgaatagttcctggacagcttccacgggccaagtatgctgggggtgttgaggaaggaggtgctaagatggattagagcaagtccctgtagtctgtaggagaaatggggacaaaaccaaaaaatcagccccaacaccaccatgcaataaagtcgagaaccaggaaagcaggggggagctcagggaagaggagagggcctgagggtgggggtgggacggtggctcagaaaccccaggaaagagctgggccccgatcctggaggaggacacaggtctgccccggcccaggggcctctcctaagggcccaggcagaactgggccatggccaaagtcacccaagaaggctctggccaaaggacagacaggtgccccctttctgttccttctgagaagacatctcctcctttttcctgctccttaaggactttgtttaggacgccgccagcctctgcagtgaacaatgcctttgattctcccagggcggcagccaggcccagtgaacagcccagcgagggaacagaaactgctcctggcagccacacagaacaccacgaaagggggtccagacactggggagccatgggctggtgacttcacagggcctggccctgctggcaggcgctggagaggaggaggaggagaacagaggtgccaccaaagggaactgagccctgctggaacggaatagctgtgctgggtggaaacagaggcctggccctcagaagccccaagctctaggtctggttttaccactaagttgccatgggctctgggacaaatccaccccttgccttggtaaaaataaaccaggtagaccagatgcctatctggtgcaatccggcccctccactgcgtaaatggaatgagctagagcctcattcctgcctgaggaacggaacgacaagaaggaagtaatgtattctgctgactgttgttacaagagccatgaagtgagaagagcaacatttccattgacactggagggaggctttgcttatacagggttttgaaacctcctaccactcatcagagtgaggggccaggtgttgttccctactttggagggaggatggcgagcgccgtgagggggaacggtggcccagggaggtgcccaacgaaagtgccacagccagagagggacaggagtacctgtgctgagtagctgtagcacacagagggatgcaaccagcaggcaggcggagaccctgggcggcgcgagaccctgtgtgacacaagttcaggccaggcaggtgacccagaacccagcctctgatgtctgcttaggactctgttttctcaaggagcaaacccactgcttcaatgttttggccctttctcaggtgccctctggcctggctcctacaccctctccccgcacggcccctattgcccgcaggttttaccttccacccctcattccagagccctaccctccagggccgctggagctgagtgcccagccctctgactccagaatggctctgggcagtgcaggcaactgcaggaggctgggggagccagggaatagaggggcagtatcctcagggaccctgcctgccatgcctccagcaactcctcttcccctcgtcgctccaggcctgggcggtaatgactcctgaaaccctgcccacacccctgggaaaagccccttcagaaccccagctgaatgtccttgtttcctgcccccaacgatacagtttccagcctccactcccaaaccaggataaggactggccagcaccgtggaagcagctgagctctggggccagaaacctgggctggaccctaagtcaccactcgccagctatgtggcctcagaggagtcagctcagaggcttgcttcattctttgaacatctgagctgcccgtgggctttgtgtgatgagtaagaggtaagaagcaaagcaccctaggacactgaatgataaggcccgtattcagtatgggcagctgccattgatagcaggtgacgtctccgggagaagaccctgctggtcggaagctcagagccagctctagcttctgccttgcctgggggacaggagtgtgacacacctgaagttcaagctgcagctcacccctggctgactccaccctgcggcccctccacacaggctcagtgtggaggtgagaaatcccagctgagccctctctgacaagttggggtctcctccaggcagtcctggccatagccatcccagtgcccccagccacagtcagccacaatgcactctggaagctgttcctgagggcgtggaggccagtccctggtttctcatcacctggagacgtaagaaattggaaaaagctggtcacccccaagacaagctccaggtgccacacgtcagttcattgaacagcgcctggaccagggtgactttaggtatcagtaccacttaggcccaggagtccacttcctctataacccactgcaggctgctgtttcatttgcacagaggcaggaataccctacacagagcgggcctgcctgagccttcagccatttcttctctttccccccagcccagggtgggagtggcgaggtcatcttcaagaccattctaccattctccaccctccgtgttggtggatgcattccagaatgatccattcaacctgaactattctacctcccacagccccagctgcccaatacttctctgaaagaagcctgtcctcagggccaccccaccaacacccctatcccatgctcagcttctctttgagaactgctgtggtagacaaatatttcagcttcagcacccctttacactcttgaaaaatagggtgtttaacatataatgagtttatggttgtcatttataaatgaattaatgtttaaaattttctcagttttaatttctaatataggctaggttcggtggcttaggcctataatcccagcactttgggaggccgagaagggaggggctgggagctcaggagttcaagatcagcctgggcaacatagtgagacccccatttctacaaaaaataaaaaattagctgggcatggtggcctgtgcccttggccccagctactcaggaggctgaggagggaggattgcttaagcctgagaggttgcggttgcaatgagccacaactgcgccgctggactccaatctgggtgacagaaagaccctgtctctaaaaaaaaaaaaaaaaattctaatatggtgaatattgattcatatgacccacagaaataaaagctccttgggatcctcatttttttaaaagtaacttctcagcaatctatattttttaaaacaaaacaaaaaataagtggcatttttactttttgcaaatgtcttgaatagctggcttaatcgaagatgctaggtttatgtatctgctagtgccctctttccctgtgagacggttttgctctaaacccttgtctgggcagtccccagtccctgtccccactgagtctaacccgacatgctgagtagagcatctgagccacagagacagttaggatgcttctcaggcttcagttctcaaacctggctgggccaaaagtcacctgggagcattgagaacacatgtgcccataggaccggaagatcctgaccgatggggccaggaggagcctggggatgtgagctgtgtgacgttccccaggtgacgcgggtggttggacatgttttggaaccattcatttaatccaatctccctatttcacagataggaaacttctaaagtaattgttagttcccattctttatggtcatgtggtccgagtgcctccatcctgtctcacagctcccttctatggaagagcaaattcccttccttctgagttcccagccacctgcttggactctgataggaatgactctccctgcagccaaggtcagcctcatgcagaaacgccctggaatgatgcctcgtccccgggtaccaggcgtttatgcagctgccggccaggccagctctcctgagctctgctgctcctttccagccagctgctttgagaccttgctctgaatgttcctaaaagacaagtttcacacccgcctggtgtcctccccaccccactccagccctgcccctgcaggaccccctctctcagcaggagtttctggactctggcccctttatagctgaatggccctggccctagctgagctcactctcaattcatatttcaatctggagtaaggtttcaggctgcagatttcggttctaggctctaagaatctgttttatgatcttttgtcattgaaactgttcaaaatatgttggaaaatatctgagtgatcttcaagtcaaagcatcatggtaatatggaaggtgaaaaaatatttctatttaaaaaaaaaactttcaggaatttttccaaggttattctcctaaaaggaatccggaaaatatccagtcttatagggctttgtatacccaataacattctgcacctagttatgaaatagttggctctagcatatgggtatttacatgggaactaacaaaacaaaacagaaatggtggtgcaggggaaggaaaggagaatctcacaggggctaattttaaatctgtcccaactctgacaatgtggtcccagcctctgctgtctgccctgttccttcttcacgcttgcttggaggtcagagttctacatcatggacccaaaacgtaaccctagatacttcgcttgggcaaaagacaacagcagatatgcatcttgatgttgccacttagaaagcagtcctggggaggcacaggggaggcccctctgctgctttgtgagagagagaaattctgccacagaacttttcccatatacaatggtttcggaaaaacaatttgctaataatttgtcaatgaaagggaaatgttagcagcctcagtccctctaattatcagtatttgtggaatcacaaaagcaacaggcattgtttggtgctgtggagatgaactctgccgaatgtgatagtctggaatgggccagcatgagaatcataggtggtaagaatgggcatgaccttggacaaacatctcagaacctcattttcggtggaggaagtgcaggctctgagaggtgaagtgtgtggccgaggatctaccccccaccccagaagcaggtccacagccatgactcaggtcttcaggccgcagcccagggccttgctccattccaggaggtttctgacggtgacctcatccctgtggaatgttggggagaagaccgtttgtatgggcgacaggaaaaagcacacggtcgcaccaggcgaggtgggtgcctcaggtcagaggtgtatctgccttgggctgcctctccgtgtccaccctcctccccaacggggctccctcggccagctgccaagggtgtatagggtggagcgggtagtggaaggccaagacttggcactttgggtttggaaggggagggaggaggaggaggaggaggaggaaatgaggcccccccccgggctccttgctgagtcagcatggtgactactgtcatttcctagaaggaaataagggaaggacaccaattcaataggagacctgggggactttcatactctcagctgatgccagggtgcccagtgagcaggggaaaggcttcctggccctggcggcaggatggggccagaatattcctgggcaggagcccccccaggtggcccatcctgcctgagcatgtctgaacatgttcttaggtcaggactagagttcgagatttcagaaatgtcattctaaccttgatctcttcgagatgcctgtttataacacagcatcgttcatgccaattgtctggcaaagccggtatacacggctatcgctatgatgtaaaacagcagatctcatgtgagggtaaacttggaatttaccccgatgagatgcggtgtggggagggtccagtggctgcgaggccctggaagcatgcctctttcagggaggcctccatcatcagagcttccgtctgcaacgtccctgccctgtgctggccagggaactccgcggcgggctcccccactgtgcccgggattcggacactgcttgccgcggagtgtttccagtccctcttgaaattcctggttgttgacaatttgtttattattctagctcttgaggaaacttcctaaaaactggggaagaagtagttcttcaactttcttgaatctcaggacacttggatcatctgacgaaactgatgaatgaagcatgggtacacagatttctctgtctctcaaatcacttcggggcccttctaactccccaaaagtcaggttttaggaatctgtattccgaggggtctcaaaatgttcacgtggttcccctctcctccagggtggccggcctccctgttccatcttctgagaggagctatacccattttgcaccctgaacctccaaactcagaagtctctgaggagccctgaataggagaaaatgtggctgaaaatgaagtggaaaatcagtgtgataaccaaatcaagatcacgcctcgctgggaccctgtcacactaaagcttccagagcatagtcgtttttaaaatctgtaatagtacctggagttttttcctgtgctttctataattcagctctttgagtctgctctgaacccttggtggtagctcactgctcatgaacagatcccctcctggggggctccagtggcctcccacaatggtcccattcctgagctgtttatcctcactctggagggctccctctgatcatccaggctcacggctctggatgaggcacaggtgggaagggctgtgggtgatgcagggagggctttcagtcaccatcccctcctggaagtgtatcccaagccatttccaggtgtacagctctcaggggagacaagaatgcattgttctacctggcacgatggggtgtgggccacgtggggtatgggccacagaagcacattcccaaacctccactttggagagccacgtacagcgaagcaggagaaggcggcagaggcggggatggggagaccgtctgtgagtgtggttcctgcccggctttccccttcccgccaggtctcccaggaggccaggtggcggctgcagccggtggcagacactcccttcctggggtgctggctgcagccggctgccatgggactccaaccagggctctcctggggttctgttgactcaacacatcatctgacgccaccccggcaggccctctgggtgtcaggtgccagtgagacgggttggggaggctgggacggtgtccagactgccgcctctgccccagagctcgtttccatggtgccgttcccagctccaggagctctcctcattcacatcatgaagggagaggcagggatcgtgagctctagtggttgtctgcctccagtgattaattggtacgattctccacggaggaggaagagaagaggaaggaaagctgcagatgaaagggaaataagcgtctcgtggtggaaacaaaagtattggttgcatcctttcaaagacgatctggaatctcaaacctagggtttacctctgcccctcgatggcaacaacaattctgggagttcagggccatgataaaaaatgacagcatcacacctgaattgctgctagtgtttttaatagacaggtaaccactcatcccgagggaggtgggaaaggagccctcttgctagggagcttggaattcctaatgctgcctgtgtctgatggacagtacctacccctggtagagctcgcttcgcggggagggagaactcagccctctgtttgcatgatctgaggctctggaaagccccctgcccccttccagatacctcatctacttgacaaacttccaagatgccctgcctcccctttctacacattgctcttccccgaaaggttcctgctctgttattcttggtcaatctgcagaaggcaggccggatactccacaaaggacccaagagaggagcagccgttaggaaggtgcaaggctgggagggaaggacaggaccagggttcccggattcaattgtaccacatcatacatgttgcctccatgcaattttctctttagtgccaggtttctagaatcagtgcatgaaaaatgatatctgaatacggtgcttaggggagccgggttttttccacttctgattcactccacagcttcagcatctattgtcagctaagctcatcttctgtgaagccctcactggtttctagagtgaatcattcctccttttcatgcacttagcacattccaatgttatcaaatgatagagtgctgggttgtttcctgatgcacctcgggtcttccactaagcgtgaatggcagtgagtctcgcttatcgctatcccatggggcctggtgcactgtcccagctcaagaaagatttgtggagcttgctttgtacatagtgctcaacaagtagacaaatctaactttaaatcttaagctctttaaaatacgccgttaagaaaatgaaacaagaaacatgacagagagaaaacacagctatccctctgtgtctgcagggaattgattccagaacccctctcaggcaccaaagtctaggatgtgcaagtccccgatataaaatggtgtaatacgtgcatatgacctatacacaccctcctgtatactttaaattatctctggatcacttataatacctaatataatggaaatgctatgcaagtaattattatgctgtgttggtttttcatctgtatttttattgttgtattattatttttattattttttcccctgaatatttttgatctgaattggttgaagctgaggaggtgaaacctgcagatatggagggctgaccgtattgcaaaacacatatatgataaaggacttgtagcagagtatataaagaactctcaaaactcagtaacaacaacaacaaaaaaaactcagtaaaaaaaaaaaaaaagtggacagaagatttaaacacatacttcagcaaagaagatatacagatgacaaataatgatatgatattcaccatcattaatctttagggctatatacattaaaactacaatgaaacatcactacacctactagaccagctaacgtctacaaaaacctgacaatactaagtgctgacaatgatttggaacaacaggaactctcatttgtcactggtggaaatacaaactagtatagccattttggaaaatagtttgacagtttcttctgtagttaaacatacatttaccatacaacctagcgatgccactcttagaagatatgaaaccttgttcacacaaaatcctgaatgcaatgttttcagtggctctattcatagttgccccaaactggagacaattcaaacatccttcaactggtgaattaataaactggtacagcactttgggaggttgaagcaggaggatcatttgaagccaggagttcaagaccagcctaggcaacatagtgggaccccatctctacaaaaaattaaaaaagttggctgggtgcagtggcacactcctgttgtcccggctgcttgggaggctgaggtgtgaggattacttaagtctgggagttcaaggctgcagtgagtcatgactgcgccacagcactacagcctgggcgacaaagtgagaccctgtctcaaaacaacaaaaaaacaaaaaaaaatgaaaaacaaaccaaaaaactggtgcatctatacaatagaacactactcagtaataaaaaggaaagaactcttaatatatgcaacacaatgaattaatctcaaatgcatttttctaagtgaaggaagccaggtccaaatatatacatactatatatttccatttatacaacattctggaaaaagcaaaattatagcggacagaaaaaaaagtcagtgtttgctgaggatgaggggagaaattgactataaaaagggatgcggaaatttctttgggtgttggaattgttctatgtcttgacggtggtgctgattacacaactgcagatgtttctcaaaactctcagaatagcacatttttttttaaaagggtgagttttactctacgtaacttatagctaaataatcctgacttttacaacagtgccctaacatgagttcgggggggttgtctctgcaatgggggaagcaggtgcttttcccctgggccttgaaggagggacaggcagggctcggatggagacgcctcagcatgatggtggaaaccttgcctccgccttggggcccaagacctgctcacataaaaatagcagctgaattccctctccctctggcccaaaggtcatctcctgaaggtgacagaatggagccactaccagggggcgggggagtgcgagggggaaggagcgaggtctcagaggctcaggcaacctgggccctgtcacccagacaactccctcccctcctggagacagctgtgctcacacagcctgtaccctgccttcccctgctgttgggagaaggggagggggcaggagagagctgaaaggttaggctgggagcagaaagggagatcccactccttcacccgccctcaccttccaccagactcagtcacccggcgctcctgaggacaggggtctttggtatatctctgcatatccctgaaaggtgtggacaggtcaatgagtcttctctacagcggctcttggcacaggtccgaacatgcagaaagcctgatgatgtcctgctgcccagggcaggcctgagacccgcagcacaggaggcccaaggcggccataaggagacccaaggccctccgaggggcgcacgaggggttccagggaaaagtgagaaggtgaggccctcaccaggtggctactcatcccagagaggagtttgcaggcctgaatatgccccacccgtccctcctccaggcccatcacctccccgggccatcagcagccacgctaggcccacgagagggttctatgcaatggctgcaccttgagagcttgctttatttttagctttaaaagttgtgttttaaagacatctatatactgagtataaaaatatttacaaatatccaagaaatatgttagtaaaactttctgaaggctgtggtctgaatgtgtgggtccctgccaagtccttatgttgaattctacccgcaaggtgatggtgttaggaggccgggccttgggaggtgaggagggtggtgccccatgcccttacaagagggaccgcagagagacccctcctccttccaccatgtgaggacgcagccaggaggagctgaagcaggtcctcagcagacacagaatctaccagcaccttggtcttggactctagcctccagaactgtgagaaagaaatttctgttctttttttgttttgagacggagtctcgcactgttgcctaggctggaatgcagtggtgtgatctcggctcactgcaacttgtgacccctgggttcaagcaattcttctgcctcagcctcctgagcagctgggattacagttgctcaccaccacacccagctaatttttttctatttttagtagagacagggttttaccatgttggccaggctggtcttgaactcccgacctcgagtgatctgcccgcctcagcctcccaaagtattgggattacaggcgtgagccacagtgcccagccacaatttctgttctttataagccacccagtctatggtatgattacggcagcctaaacagacgaagacgctgagttagctaatttgttgatccaaacagtccactctttttaaacatttatttttgattttgttaaaatgcacacaacctaaaattgaccatcttcaagcgcacagttcagcagcattaaccacactgctgtgcagcccccaccaccaccatctccagaaccatttcatagtacaacactgaaactctgtcctcataaaaataactcatttctccccacctgcaacccctggcaaccatcttctacttcctgtatctgggaatctggccactctagggacctcatatgagtaaaatctggcagtgtctgtcccttcatgactgcgttctctcactcagcacaatgccctcaaggttcatccacaaggcagcacctgtcagaatctccttccttttgaaggctgaatactattccaccacatctacacacagcacggagggctttctctcacaattccctcccggctttgccatcgctttgctattgctctgtgtctcccaagagatcgctgcccctcctaggtctgcagcttccctttcctgtggtgacagcaactatggttgctgcctgcatggcctggtgtccccatgtgcccccaacaccgagggccagagcaaggagtaaggacatccgatgcaaacaccgcacccacacgtttcctggggatgccccagtccctccgggtcagaatctgtcagcctgtgcccatgcctgtcccttccttctgggccacggtcacaggacttgggtcagcaggcccgggcagggagggagcccgggacaacgccagacattcctgccttcctgcagccaagtttccgatgtgctgttggaggaatcctgccaagggtaatgtgacatttacatgatgcctggtggggctgcccagtgacataacaggggggttgggggtgtgtctctgggcacagagcctgcagcccggcagagtctgatgacactgtgttgtgtaaattgaagcgacagtcacctgtttctctaagtcatggctcaaacctgtttcctcttatgtgaccataaaatcacaccgcctgtcaccttgatctttgggactcttctgtcttccttctgaataaagctacttgataaacacccatccacttcctgcagggggagaaggccaaatgccctcaggtgcattcttttgagagagtccagagagcatgagcccagccagaagtaggcatttgtgatggcctttctgtgcacttgtgcacacaaactttctcgtgtgggtgccctaagtgccggcattgtgcaggaagctgtgttgggggctgggagcacagtggtagcagacaccatccctgccctctttcaactgattttgcaaggacttcaggaacacattctagcacaactaactagagctgctcacttatgagcagagcctcagttcagccatcagtgaaatggacaaatcaaataggaactcttgaatgggccacctcccctgggcagcagggtggcgttgcttccaaggtgtgcttaaagccggctctcttctttgtggtctgagcagaagctgtaaggctaggccctggccttgttcttagctgtccctggcctacagacctttgaactaatcactcttggtggtctgaattctctgtagacaggtggaaaccgtaggcactgtgtcctccagacctcagcacagcaagaacagtctggtgttcatccgggcagaggaagcagaccccaccctgtgtttacacgacaccagctcttcaggggtccgagggggcgggcctgatgccggcataaggtttgatgttgccagctagaatcgccaacacatccccggaagcccagtggcttagcctcctatcagtgcctcctctgcagcccctgccagggctgccaggagctcagccggcctttgttctatttcaccccaaccaaatacctcctcctcctcccttctccttattcgttaaaattcagcgcatgatactggcaagcttcagccgcagctcacagcactttcagaggaaaacgtggcgcgcccggggccttctcacagccatcgtgcagccgcctgggcagctcccagctccaatggcaactggtagcatcaggagagtatggggttccccagtggggctccggggcagcgcaacgccacaggaccttgtggtggatgtggcaaagcatctgctctggtggcctggggcaggtgaggaagtgagcgcttctcaggagcagagccaggtcgtctctgcaggcccaggcctgccggcgcctcagccctgacgccatcatctctcctttgactgagaacaaggacctctttccttgcctaaatagcctacggctaagaggaaatcacccccagttacgagaggtttcaggaagccccccgcaaccttccacccaccatcatcaaactttcaaaagcagagagtctgggatttgaagcccctgtctgaaaagtaggtttcagatccatcggaaggcagggtcaggccaaacctctcctctcaagtcagataaaaacgatcacaccagggaggagaggcctgaaaaggggcagctgaagggaaaaagagctggagagtggggagcagcccggagtgtctcctctggctgggaggggccctgtggagctggcagcagcagctcttgggagcagacagaaggccgctccttaggaccaggcgctgccacctgcaggctcaggccctgttcacctgccgcagattccccgagagccaggcagaaaaagtggaccctgcccccagagcgcaggcccagggagaggcaggcaggtggccagtctgagtcagcgggatggaggcgcctggcatggggaaggggtgtgtagcctgggaggggccttgggcgggagcatccccggggagagagctggagccagttcccttaggacacatgataactggcagaggaagagcagctgctggggaacggggggtggtgtgtagggagctgcacaccctggggtggtcaaggcagaatgggcaccagctgcagcccaccaggcctgctcttggggtcccaacaggcagggagaagtggtggacctgtgtccgagcatcagggggcgctgcaagtgggcatgctgggtgcccagcaggggtaccatcattccccaggggtgtagagagtgggccgagcccgggagccctctgaggaggctctgccaccacctgtgggacagcaggaggagcttgaactctgtggggacttggagcagaaaggacccgccgctggaagtgagggtcacaggaaaggggaagccccggagcccctggtccttggcttggagagctgggtacacaatgatgcccaaccctcataaggtccacacatgacagggtgcctccaatccactgtggacggtgacaggtcagcaagggtctgacataaccccttagctgtggggggcacagagaatgggcacggctgggatacagtggtgcgctgggtgcagggagggggtgtggacgcagggaggaggcaggtgccgggagcagacatcagagcccagaaaatgccacagaaatcgagcctctctccaccctgccttccaacctcatccacccagtggctcaaggctgccaggataaagaaggacgggtgtaacgggtcaaggcgaatccaagctttgaggtgtgcaggtacagaggactcttgtgtggtccccacagccatgggtgcacaggccagtgggtgcattcaggggacacggcagagggaggtgcatttttgtgctgttttcctctgtgccagccccctgggaagcaggcactgttgatgccctgtccctaggtctcacttctgagttcgcctgcagctgggaggcagttcctgtgggcactggggcttcccacccacctcaaccctgcctgagagtttcctctggtgcccaggagctccctcgggaggagcgccgccagcttggggaactaggggtttggtccccacagggccacctgggctaatgcccctgggggcacattcagccagcacttcaccaggtcccttgtgaggcctcagctgtccccactgtccctctgagcctcctcctggtttttcccttcactgtcccatcccccaccccctcgcctgtgcttcctgggatcatcgctggtatggtttaggtgttttgtcccctccgaatctcatgttgaaatgcgacccccgagttgaaggtgggcctggtgggagaagtctgggtcatgggggcgaatgtcgtggtgctgtcctcgtggtagtgaatgagttctcgctctatgagttcacacgaggcctggttgtttgaaggagacttgcacctcctccctgtctcttgccctctcaccatgtgacacctcagctccccctttgccttctgccatgactggaagcttcctgaggcctcgccaggagcagacaccagcaccatgcttctcctacagcctacagaattgtgaactgaaatcaacctcctttcttcataatttgcccaaactcagatatttatagtgacacaaatggactaacacaatctcccaaaccaactccctgacccttgtcaccagctctgcttttgagggaatccacattacaggcaggggaatgggtgcaatggataccagcgtcagccccttgcagacctatccagatgcaaggacttggctctttggaccactccaagccaccctgagatgccacgtggaaccctaggaaaacccacctctgcaagaaggtcctgaaatcaggtaacttctcgctacagtgtaaatgactgataggctcaaacgggccgtgggagggtttcaggacagggtacaggaaatgacctgcaagtctgcagagccagtctgcaaactctggggagcacccctcaatgcccttaggccacctttccttctctgacctctgtccccatccctgccccaagttgtgtctctttgacacctgggatgtaagctgtgaaagctaaactgcactgtagttggagactcttgagaaaccgaatgaacaatatttctgaagatctcccacgaaggttgcctccctccctgcggtcaggctgcctgcaggcctagtcccagcagatctccgggagatgctgactgctggccggatgcctgtgtggttacgatccggttacatctcagccccctgctgagaaagaggcgctaaggtggccctggagccgtgaattcactgggattgagatcatctcggcgactttatcatgaaggccagcacaggaggcccctccttcctgttggagatgtttagttttatgattaagaaatggcaaagggcctttcagactacttttgctttgaaataaatcagtgaatcaatgagatgagaagtattcactgggcaccggctgtacagggaagaactggaagtgggatatgcagtgcctgggcttggggtaacagaacccagcctacgggccagaaagaaatgcatgagccattaagacagtgcaggaagcatctgatggaggacacgtcaatcttttcatcaatcattgaaagcaggacgaggaggctgggacacagcaaggtgctcaggccctcagaggaggcagtggggaggttcttgatataggctggtctttaagaaggactgggactaagataaactggggtacatagcggaggaagaagggagtagaggggcagtgctctgctgccacaggcggccgcagatgggtgcccccacattgcagaaacagcctcaacaggagccttgtgtacctgccaacattttgctgcatacaagattaatgaaatagttccactgaaatctggtgatggagttctcggcaatgtggtttttgtcctgtcatctcataggaaacaggtctttgaataagtcattgcatcattgcaaaatgatgtttcctccccaacaagggaaatcgggggtgacgtttagcagctccttctgcagcagtgttttaagttgagtggctagaaaagaaagaggcgtattatacgccgggctgtgttctgggtgctggggacagtgaacacgacagagaagagcccagccctcgtggagctcaggtttgtagactctggctccttggagtatggtctgaggaccagcagcctgtttgttagacacgcagacctccaggcccccaccccagacctacggagcctgaatctgccctttgacaagactcttcagtgaccgacagacacgtcagggtgagatacgcggctgtaggccaggggttccgaattttggcaagaatcaggaccccctttttaacgcaggcttgtgaatctgtggatttctgagccccaccctcagagattcagatttgggaactgggatggaggtccagaaattggcttttctgatgaggttccaggtaatgccaggcctgccggtctggggctcacaccctgagagccacctgctgtaggagatcatctgagttctgggagaagactggggctatctccgccacgcgtcccaggccctggagaagctgacggtagcttccaggcttccccttatgtggccaggccatagttcccttaacctcccacacccatcccctccacacggggggagcctggccttgtgccgaaccccaaataatcctcagtgcttggcctgcccgtttagaggtcaaacatccatgcagaacccatccagcctgcccgggaaatccgagcagggatcacacaggatgtcccaggcatttccacacaggcgagaccacagagcattatgcagccttgatgtgccaactgagtcatgcaatgtgctgcacacacgagcacccagcagacgcctgtcctctcctcccctcagctgtcaggcacaagagtccacccccttccacctcccactcctcaggggctgccccccagggaagccccactggagcaggcacctgacccagacctgaggcctgcgtcactgggccgggggaggaggaggtctgaacagaaacactaaattagccaccttctccctccagtctctacctgtgctgtccaagaggcagccactggcctcacatagctatttctttataaaattcaagttcagctccttagttgctgttatgggttgaaatgtgtctccccaaaaagatacaatgaaaacctcaccctggtacctgtgcatgtgaccttagacatagggtcattgcagatataatcaagttgagatgaggtcatactagggtgggtcctcatccagtggccggtgtctttataaggaggaggaaacgtggacacagatacacagggagatggaagctgagattggagcggtgcatctttttaagccaaagaataaggattgccggccgggcgtggtggctcacacctgtaatcccagcactttgggaggccgagacgggcagatcgagaggtcaggagatggagaccatcctggctaacacggtgaaaccccatctctactaaaaatacaaaaaattagccggcctggtggtgggcacctgtagtccccagctactcgggaggctgaggcaggagaatggcgtgaacccgtgaagcgggggttgcagtgagccgagattgcgccactgcactccagcctgggcgacagagcgagactctgtctcaaaaaaaaaaaaaaaagaataaggattgccgagaactgccagaggccaggaggcaggtggggagcaggttctccttcagggcctgcagtagaaaccaaccttcccacaccttgacttcagccttctggccggcagaactgtgagagagtcagtttctgctgtttgaagccacccggtgtgtggtgctctgttgtgtatggtagccctgggtgctaatccagctgcactgtccgtatttccaatgctcaacagccagatgtggctggtggctaccaagatggacagcatggatacagaacacttccccctgtgcggggagttcgattggagggtggtgttctgcagaatgctttctaagaaagaagcaaaggttaaaagtttaattttcagaaaaagttgctggggtagcccagttgcatcttccacatcctttacatccctagtgccggtcccccaaaagagagaggaggcctcatcatcaaagggacatcagtaggcacacactgactctcttccctgacatgagaaagtccacctagacattcaggccggagctttcgtccatgctgacagcagacggatggggatgcaggtccacactgatcctgagagtcccacccacagagggagcccccacggcagtcttgccaggtccctgcccacccgcttgccttccttcccctatctcctctccccatctgccaggaagcccatcagggcactgccaggtccgctctgtacacagacaaatgcaactttgaagtttcacactcaccagttggcaatgcattccttaggatggaggcattcatagtcccaagaatcccaagttaaaatactctcaggagaaacaccaagtcctgttattggataataagactctagcatgaattaatgatcagagtgaaggcctggggggcacagcccctaggatagcaaagttttggttgaggggatgaggtgatggcaaggagggcgaggaccagagcccaaaggtctctcctgggaagggtccaagttcaggactgtaggtctggaatgccagaagctgggggtgatacctctcgccttccagttccgagaactggagcaagtagagtgaatgtcaaactgccaagggcacgattttgcctctaagcatccgtccatgtactactcacctctgctcatctctccagggacccagcctctatgctgggctccctaacctgcctgcccagggagaaaagggaacacctggcagaagacacctctgccagcccttcagcctctcacattgcctgctgctcaaatagctcatctttcttcaaggccatgatggcttctctgactcactcatcagcgcgcgcgaagcaaagaaggaaagaggaaaagcgcaccttctccgtcacagtgaatggcaccctgcaaaggactgcgggtgctctaagaaaggaaatctgttttcagagctcctgcagctgcttttcaatgtgtcttcagtttattttaccaatgagcaaataaactggtgtttcccctgcagtgtcttctgcccagatagcagcgattctgctctccgctgtggccggagcactggatggctccgtcaagccctcagttgtcttactgatgagaacaactcaaggaacttctcccacatcatctggccacttgggctttaaaaaatgttttatggagcataatatagaaaagtgcacacattgagagtgtacagcttgacaaatttgcacaaagttcatgcatccatgtaaccagcacccagagaaggaaaggaatgttactacccacatggcagcccccttcaatctccctgccaggcaccacctgcctcctcagataatcatcatcattctttttctatttaaaaaaatttttttggctgggcgcggtggcttatgcctgtaatcccagcactttgggaggctgaggtgagtggatcacaaggtcaggagtttgagaccagcctaaccaacatggtgaaaccctgtctttactggaaaacacacacacacacacacacacacacacacacacacacacacacacacacacacacacacacacaaattagctaggcatggtggcaggtgcctgtaatcccagctactcaggcggctgaggcaggagaatcacttgaacctggggggcggaggttgcagtgagccgagattgcgccattgcactccagcctggatgacagaccgagactctgtctcaaaaaaaaaaatgtgggtacatagtaggtgtatatatttatggggtacctgagctgttttgaaagaggcatgcaatgtgaaataagctggtcacggggaatgggatatccatcctctcaagcatttatcctttgagttacaaacaatccaattacactttttaagttattttaaaatatacaattaagttattattcactacagtcaccctactgtgctatcaaatagtaggtcttattctttctaactaatcttcatgattctagcatcatatgttttgcctggctgtgtattttgtgacccagagctgcacattttgtattcttttgcttcaggcttctcttgctcagtgttggttgtgagatgcagccacactgctgcatgtggctatagactgtttctccacattgctgtaggaggttccattatgcaaatctaccatcatgtgtttaccatttcgactgctgatgggcatctgggcggcgtctactctggggctattataaatgatgctgtatgaacattctatacatatgttccccagaattgctgcttgcttttagttaatgtatttattcagcacagaagacattatagagagatgaggaaaggggaggggcccaagtctgagcatttgtggaacacctacaatgtgctgggcctgcgtatctactgcaatccacgcggcacctaccgggtggggatttacaactctctgcctcccggggcgccacggcttggagaaagagagtgagtattgccaagggaggcacagggagagcgaggctgctcagcggtgcggcaggttttgaacccaagtgtaaccactacaaagcctatgatttagtggacagaccacgtccccaaaatgttagcgcttaaaagtcctgcccctgctagcctcagcaacgggaataaaacagccatgaacgaaatgaggtttctttggtgtgtcagatactatcttctataggagacaccactgaaattaccagccaaatgctgaacacatttttgacgattagcaagttaatgagaatttttcaaccttctgataaaacgtaaatgcaattgagttatacttccagctgctctgaacagaggcctggtgtctgaaacgtacaggataaaatgttcaggttatcaagctgctctggaaacccctctggtctcagagttggctgagaatatcaggctcccttttcattcctactgataagcccacttcctctcgagcaacaccaaggaaacaagggattatggtgttttttctcttttctcaatcgggttgtaaaacacacacacagatgtacatggattggaaattaatccagccgggaaagttggctggcaagcactcggtcccaagcaggatcaccccggtatgccgaacacgcagccggcatctggctgcaagcatctgtctatcacacacagctgggcgaggggacagccgactgtctgtgacagacactccttagggagacagatagggggagggctacgtcttttcagagagaaagagacgtgagaggtaagcacagttttcccaaaggcccataaagaaagcaattctatttgtccaggatcagctcactaaggtcctcctagagcagggtgttcgattggagggtgctctgctcttcaaattaatttcagtctccctgcttaactctccaggctctggggtcccctcctagagcaagagtgttgactcctccttacactgccctctgcaggttggtggcacttccttgtagaaatctcataagtggcccttcttagccgatctcatctcacccgctgcgttttatttgacattcctacacatgttttatgatttcacatccccccgccccccatctgtgcacctgcaactcccaagttcactgttgttgagggtagaacttcaagccaggagcctgggtctcttgagtcttgctcatcagggttaagatgaaacgacaggtatgtgaaaccatgttgtaccctgcaaagcatgttgaaaatgcttcccggagtaaaaggttaggtaacacaacttcagtgtgactcagcacagcagatatgcagcacagagaagaccctgggacatgcccaaggccacacagctggctggtgtcagtcagagctccagccaagccttgaagtctggctctggagaccaagctcctgactgctgtctcctcctgcctctttgccctgtagcaccaaaggagaaattaatctttcctcctaggtggtaatgactagttgcaatcaaggctgcagagagacccactcatagcccaggactgggaggtcaggctcctgcctcgccctgcctttaacaagtcaaattctccaagacatccaactcatctcccagactgtgaaactagggtcccaaaagggtcaggactatctccccacctgggacagtgccttgctgtaaagattaagtcccaggaagacaccgagatctcccaccacgaggcttcttgcagaaagccagagtacgagcaaccagcaccctgacctgcctcctgctttgagcaggtgtgcactggaaatgcaaatgatggtttttatagaatttcaagctgaaatcttctgactttcttccaaggaatgtattcaaaggaaagatgcaaacccattttggctgtctcccagactaggcgttagctgtggcagtaacagcagcttcagcaaacgctcaacacagcctgagtctagaatacgttccggcaatggcttctgcttctccaacctgagccggaggccacggtggttccccatgcatctcagcccaattggagccacctggcctggccagggactagatggagtagggcactcaaatacaccctccagaggcgtctaccatgagggaagagggtgcctctggcccaacccaacgtcagcctcaaatgttcggacctgcctgcagtcatgcagaggaggccttccccctcggctgcgtcctgggtgccccagccttactgagctcagccctgtctcagtttcagaaggaaatgctcacaggggaccacaagtccccaggacatttaacacctggtcagaggacaagtccaagcacctggatagcaactggaccatgtcatgaaacccagtcctcctccctccgacgctgcccaaacttgagctgccgttgtccaggctagacggcatcctggcagcaggagaatgaacagcagtgtcccattcattcaacaggtgagcaggggacctcaataaggcaagtccctgataaggcagtccccagaatggagtgtggagcagggtagctgaggtgtggctgcaaattcctagcaggtccctcctactaaacggtggtcggagaagctgctatataatgaccgtttagtgacattcctagaaatgtttcttcccgcccttgagcctgcatttcagcttccagagctccccaaacctcgggagggtcacactgttggctctgggggagaggaatgggaatttgaaggccagaggctctctggctcgcacccatcacccgctctcctctctggtggggtgctcccgaaggtgactcagttctccaagccaaatgcagccatctgatgtcaccacctcatctccagaaggagtcctgagggagaactgggtcctcaccactgctgcagtggcaaacaaaggacacaaaaataattgagtggctggtcaagaaccaagttaaaccggccagccagggagctgggcctacgtcagtagggggctcagaatagccacagagcccgtgatgtgcccaactcaccccggggccaccggggccaaagaaagcccaggcatgagccagcaccggccccaaggcaggaaagcccaatagcgaacatggtggacatctacccagagaactctcggcccaacccagacggggcaggggaggacgcacagagaaaacatgctgactgtccacctgcaaaggcccccggacatgaccactgggtgtgaactggcccccgctgtccacaaggggggcgctgtccccgttgaaagctggggaaatggaagtaggaagagatgaaggggcttgcccagcaacatttggctgacctggacctgaacccagggttgtcaggctccaaacctccaattgcttcttaccctaaactctccatgcagccagctactgtgaggtattgtgaaaggaaagtcggatgaatcttattatttcttttttggcttactagactctgaaaggccgcattagtgaactcgggactctaataactcctggtgtcaggccttgccctcagaatgatcgtccagtggggcactgtgtggcccctcaaacccccatgccaacctggcacctgccagccatcgaagagaatagaagcaacaaaaaataaaaatagtaaatgtaccagtatcttctatgcagcgtaaagatggttttcactctacagccttctctgtttagcaaaggaatgcatttgtaacgaaggattttcagccaccgagccagccaggtaaagggaatttggagccagagggtcctcatggcatgcctgtagggtcctggcaagtgaggatacactgtccacgtggagggctttcctgtcgtaccccgtgttagccatgtaatgtgggcagtgaccagaggggatgacaaaggtaaaatgtccagcaattcacagggaacttgagcacagcaaagtcactgggtaagtgcagtggccggcagctgcctctctggagtgcccttggtgaggcagggccttttaagttccatgtgagccaacagcctggtgctgccacctgacactaaaccccagcacaggttcagctcggggcacccatggacagagctgaaaggaagccaccagggcacgccactgctctcgtcagagcccagcagaccagctacctagttctgtgagaataccagaagcagaggggccggaaaccatgacactgtgtgacactgtgtgatgggcgatggtgacactgtgacactgtcacagtgcatgacattgagtgacgtgtgtgacactgacacgtgatattgagtgatatgacattttatgatggtatgtgatattgtgacaatgaacaatgtgtgaactgtatgacattgagtgacactgtgacaccgatgtatgaactgaatgacattgtgtgacacagtgttgtgacactgacattgtgtgaaatcgatttgtgacaatgtgtgacattgtgtgacgatgagggatgtatggtactgtatgacattgacactgacaatgacgtgtgacattgagtgacgtgtgacaatgatatgcaatgtgtgacattgatgtatactatatgacagtgacattgagtgatgtgatattgagtgctgtttgtgactgtgtgaccctgcatgacacttggtgatgttgagtgatgacattgagtgatgtgacattctgtgacattatgtgtctgtgacatgagattgacactgagtgacctgtgtgacatggtgacattgagtgactttgatatttgtgacattctgtaacattgagtgtgacagtgacatgtgatactgaatgacgagtgacactgacacatgtgactgtcagtgacatgatatatgtgacactgaatgacacatgtgacattgtgtgacacacacataacactgacactgacaagtgacattgcgtgacactgagtgaagtgtgagacattgtgatattggatgtttcttacactgtgacacggagtgatgtgaagtgatatgtgtaacattgacagtgatgtgtgatgctgtgagtgatgtgtgacattgagtgacagtgacgagtgacgtgagactgacattgagtgatgtgacagtgacagtgacatgtgatattgtgacactgagtgacgtgtgacactgagtgcctgggggactcaatggccacttcgccttccagagggctttcaggaggaaaagcatttacagtagagccccacggagcactctcgagtctagaagggtggccggagcccagtgaatagaaactgcactggtgtcttcagctcagttccaagtcggagcagccacctcagcagaagggccggcctttgggagccgcctctcccctgagctgaggcttggatgcaccagcagagagatggcagaggcaggtggagactcaggaggcacctctcacttcaggattgaaaccagaactctaagtccgggactttctgccacccgtgccccgcccagcctgtctctatctcagtgcgtggcacccctgtcccccagctgccgaggcttcgctctcgccccccgccctgaggcagcacaccaagtggtcacccaccagtctccccaccacaaaagactcccctcccctttgctccgctgccacactgaggccacatgaaccttcgtgggaagagaagaccccgtcactcctctgctcgaagctctgcggtgaccccatcacacttagaggaagactcaaggggcagccccttcagggcccgtgcatgtgctgttctcccctccccgggagccctgccctctccctgctcttgcatctctcccagggcgcagccacccaaagtgaggcctccctaagcataccatctaagagggcaccgctcacacacccccatttgccacatgctcattcagcttcatttttctctcttcacttgtcactatccgcccagatacacacatggagatgtcatgacatctaacacactctgcttgcccctacaagcaaataggctccacgaagccagggactttgttctctgtacctctgtgtcagcagagtctagaatattgcttggcacagagcactcatagtggtaggcagagagtgtcagcagtgctgggtccagagtactaagagtgctaggcttacaaagtactaacagtgctaggcatatggtaccagcagtactagccctagagtattgcgagtgctaggaatacagtactaacatgctagggttagagtactaagagtgctaggcttagagtactgagagtgctagacttagagtactaacagtgctaggcctagagtatcaacagtactaggctgagagtgctgagtgctaggctgagagtactaaacagtgctaagctgagagtactgagggtgctaggcttagagaactgagggtgctaggcttagaggatcaacagtgctaggcttaaagtgctaagagtactaggctgagagtatgaagagtgctaggctgagagtactgagtgctaggctgagagtactgagtgctaggtttagagtactgagggtgctaggcttagagtactgaggatgctaggctgagagtactaatagtgctaggctagagtactgagggtgctaagcttagagtactaagagtactaggcttagagtactaagagtgctaagcttagagcactaacagtgctaggcttagtagtaacagtaataggcatcacagtaccagtgatgactaagcactttagtgtatgcacttcagaaaatagtcaaagagttaatattcaaataggttaatatatttcaacactttaaatctattgcttcctttaatctccatccaccaaggaggacagcaatattatccccattttatggatggtgaaactgaggcacaggaaagttaagcaacctgtagatatttatcaaatgtgttgaaggaacgaggaagagaacaggctctccatcacagaagtgtttaaactacttgttagggttactctcggatatgcaggttcctgagagccgctagcctgtctcaactcagatgcaagttctacaatttagaaatctttggaccccaggactcttcctagccacagcctggtgctaactctagacatggggacacaggtccagtgttggtggcctgccaccgactgggtttggcaccatcacccagaagccgccctcctctgggtttcccaggcgccccaggtggctgggctgtgtctcgggtgatggaggaggtgtacagatcccatgtcagggtgtgactgcccggaggcagtggcggcagaatgtcaggtgccaccagggactccaggccttcctccgcggcgcgtacgtgcatcacgtggtgtaacatgactgggcggctcagtgtggcccccaccctcacgtgccctcctggcacccagcctccgcccgaccctctgagagctctgaggagtgtgaacaatgggacgggctcaggctcactcacccgggaaggacgctctgctggctcagcaggaaggggcctggcacccaaagcctggacatcctgtgtggcctggagggagaatcagatggggtggccaccgcaggagactgggtccctctcctccactccctggcagtgactctacactcaggacccacgagactgctaatggtaaccacagggacagccctgcaggggccttgctctggcccactgtgaaagggaaagtccccttcctccactgatgtaacaaaacaaatctgctcttgttggccctgatgagctgacacccggccagagccaagcccagggatgggaggtgcccactggcctgacctcggacaccagctcctgggctgcaggtccaggaggcacccaggcacaatcaggctcctgttgccaaaaaagggagtgcatgcagagtaagcaaaatgagtgtgccccataaccacattcagtcacccggggccacgctgtgctgagggagggtgtggaacacaccacaatcctctccagcctccatctctgtctttcctgggagaggttctgaggcctcgtggagatttacacaaagcctgatgcttcagaggggaaaatgctctggccatgcaaattcattccgttttccatcactcattttgggtgcaggatattttcagcactttcccagcatgcaaagcaaagacaggattgtcatggagagccctgtgtgcttggaacgtgccaagagcagaggggcgtgagctggtttggggcattctctctgcttccctacaaatgcccagtggatggcccttcctcggagctgaagcagttcccatttctcctgtatggcactgtcaaatcgaggcagagggacgggaaatggtgaacagagaaggaagactcaagggcaaaactcccggaaggacagggggtcatggaagaaggaattctgagcctgacatcttagaaaatggatatgcagtttgcagatctacatccctcacactgtcttctgggaatggcgagaattgtggactttgtttccttttgctctgatatctttccccccacccaaagcagacccttttgtttaattctgatgctgtaggacgcaccccggcttgcaagccaggctgtgaatcagcggtttttgaaaaggatatggtaccacagctcacacatgtatgtaatgcagtattttctttttttacttttttagtatggaaaaatttaaacacatatgtaaaagtagacagaacagaataatgaactccattttttctagcatgccatttcaacaactattaactcatgaggatggtgtttttgcttttttaattttttttttttttttgagacaaagtctcgctctgttgcccaggccggagtgcagtggtgcgaacacagctcactacaacctcaggaggctcaagtgaccctcctgcctcagcttcctgagtagctgggattacaggtgcaggccaccacacccagttaatttttaaatgtttcatagagaaggggtctatgttgcccaggctggccttgaacttctggcctgaagtgatcttcctacctcggcctcccaaagtgccaggattacaggcatgagccactgcacctgacccccagtgtttaaatgtagctaccatgacgtatgcatcaaaatcacctacaagtcttatgaaaaatgcaaatttcctggatctcaccccagatcaaatatatcacaatttgggggttcaagtccaagaaccggcacatacccccaaaggattctcacagacagtcaagtgtggggggtcactggtagcggttagataactcgggctggggtcccagccctgccacttactagctaggtagctgaacaggtgatctccattggagtacgggctttacggggttgtcatggggaataaacaagatctcacaagaagagcacctagcacagagtcagcgctcattaaacatcctatgcagttactcaccggcctaacttacgtttgacttctaagccttgaggaaaatgtgtgccaaggtatgggggaggcggcagggcttccgagagagccgtcctcccatcccagccctgccatcctcccacacgcacgctgccgtcctcccatccgcgccccgccgtgcctaggtggagaggcggcagggcttcccggagagccgtcctcccatccgcgacccgccgtcctcccatccacatgccgccatcctcccatccacgcaccacgtcctcccatccacaccctgccacctctccctggtggccttgcccttcgtgtatctgttcagggccattggtgaacagagaaaaaaactactctagtaaaaagcaagtttcctttcattataaagaaaagtgaaataaattgttaaacatctacttctaaattaagaataagtgggccgggcgcagtagctcatgtctgtaatcccagcactttgggaggctcgggcaagtggatcacctgaggttgggaggttgagaccagcctggacaacatggcgaaacctcatctctactaaaaatacaaaaatcagccaggtgtgatggcacacacctgtaatcccagctactcgggaggctgaggcaggagaatcgcttgaacccaggaggtggaggttgcagtgagccaagatcgtgccactgcactccagcctgggcaacagagcgagactccatctcaaaaaaataataaataagaaaaaataaataagaatatgtgatgttaaattctacccaattaaaagcaatttttttttttttttgagatggagtttcgctcttgttgcccaggctggagtgcactggtgtgatcccgactcactgcaacctccgcctcctaggttcaagtgattctcctgcctcagcctccaaagtagctgggattacaggtgcgtgccaccatgcccaactaacttttgtatttttagtagagacggggtttcgccgtgttggccaggctggtctcgaactcctaacctcaggtgagccacccacttcagcctcccaaagtgctgggattaccggcatgagccactgcacctggcctaaaagcaaaaaaaaaaaaaaaaaaaaaaaaaattattattattttttttgagacagagttcctgtctgttgcccaggctggagtgcagtggcacaatctcagctcactgcaacctccacttccaattctcctgtctcagcaattctcctgtctcagcctcccaagttgctgggactacaggcacacactaccatgcccagctaatttttttgtatttttagtagagacggggtttcaccatattggtcaggctggtctcgaactcctgaccttgggtaatccacctgcctcggcctcccaaagtgctgcgattacaagcgtgagccaccgtgcctggccaaaagcaaattttttaaaaattccaatttgagttgtgatctagaaagggaggatggagtggaagaagagaaagatagggggaaggctgaagaattaaagatcatgccagggaggcagcgaacaggaaagccaagaccacagaaaacaggtgctcaaggcgaaaggcaaaggcaggagagagggcggggcggggcaaggagccttggtgcgggactccactctcctcgctcacagggcggcggtcccatctcacggcatcttaggcttccaggaaggattttcgagaggcacttttatatatttatagatgaaatgatatgtcttggatttgcttcaaaataatccaaggggcaggggaggtgggtgtgtgcagggatggagctcgattgcccttgagtttgtagtctggggttgagcagaggacacacagggcttcagtacgctcttttctctttgataagtgctggagatttgcctaatacaagtttaagaagtttaaacatttacaactatacacaaatcaggaagttcacaggctgatgtcagccccatgggtcagatgtggtgctgaacctgaggtgcccttggcctttaagaaaaccggagattagaggaggccgagtgtgaaagtgttgattatgacatgtcaggcaaatgtttgccaagtgaatggatagagacctccatcgggtgaaaatgctttgtgttcaagccccctttgtgaccctgggcacctgttagagaagcaggggctgggcaggggtccgtatgtggactcccaacagagcaagcccaccttgtccaggcagggcttggatccacaagtcctggcctcaccactccaggctcaaagggcagccagccagctacatacttgttcccatgcttgacacgcacagaaccccgcccagccttgcacttaacaggtgcataataatcccttaggaaggagggtatgggacactgttgccccattctgtagaggtggaaactgaggcttagacataatcaacctaagaatgggacttcatataaactcattctgcaaagaacggggaccagtgaaattagcagtcagtgttttgaattcctgaaaggaaacagcgtctgaaacacagagccctgcagaaagcacgtaggcctgagccacgcagctgctccagcccccaagcccgcgtggagcagagatgggtacacaccccgcaccttcagcttccagagcgttttagggaaatgagtgttggcaggaaggggagcagtggcgacttgccccacaaaaattcgaggcaacaaaagagggaaagaggtgggccgggtgtggtggctcacgcctgtaatcccagcactttgggaggccaaggtgggtggatcacttgaggtcaggagttcgagaccagcctggccaacatggcaaaaccctgtctctactaaaagtataaaaattagtcgagttgggtgacgcatgcctgtaatcccagctactcggaaggttgaggcaggagaattgcttaagcccgggaggtggaggttgcagtgagctgagatcgtgacattgcattccagcctgggcaacagaccgagaccccatgtcaaaaagaaaaaaaaaaaaaaagaaggaaagaggttgccttcataaagctgtaaaatcgcataaaaagagggtgcaatcagtcattgacgagagttacccaagagactgtaattacatggttaaagaatttggaaacacctagaactccactcaaggtgactggggtcatttgcagggaggcaagaataatatttgacttgaatttcatatgcaggaactttctggagaaacgccaggtgaagagaatggcagaagggtggtgtcccaaggaaagggcagaaaacaggtggctccagatgccttttaagagaagggctgccccggccccagactcaccggctggtacagtgaccactcagcagctctggactggctcccgtgtggccctgccaacaggatggggagggcctggcatgtgtgagtagccatgcccacccacgtatttgcctactatgcctgccaactgggatgaaaaagctttggatctggctaagtttctgtgaaccaggtaataaatctgttcttggtgtgctgaaaatagtggggtttttcagcctataaagttgatgagccaccctgagccttggggacccaccaggaaagcatctcctcatgagaaaggagctggccttgaccttgctggggacctgcctcaaattcactatccctgcatgggtaggtgcttgtcattctttctgcccacgcagcatctttttacacctcctctatgcctgaccttgggagtggggggaaggggctctgatgtgagggtcgtcctgggccagactcagcttctgctacatggaagcagatgccaggcaggaggtcctgccttccagagcagacactatcttagtcatcttgggctggcagaacagagcacatagatggggtggcttacgtaacagaagttgattttcttacggttctgggggctggaaagcccaaggtcacggtgccagccctgttggtttctggtgaggaccctcttcctggcttgcagacagccgccttcccatggtggtgggtggaggggggggtagagctcttcctcttcttgtaaggccacagtcctatcagcttacagccccacccttatgactttatttacccttaattacctcctcaaagccctatctccaaataagccacatcgagggtcagggcttcaacgtatgaattcgggggacacgatctggtccacagcacggcacgagtcctccagctgcatgcaggtcatggtggctgtgcccagtgccacgtgggcctccgtgtccccgctctgtaagtcatggtgggctcctctcggaaacccaccaaagtccccagtaaaagtgctgagtagctcatgaagtccccaggatgcaaaaaaaaaaaaaaaaacccaaaaacaaaacaaacaaaaaaacccaggttttttttgcatcctggggactctgtgagctattcactgcttttaatacatttttgggatccactacaaccagccagaatgaatctctgggcccgtagctgactggagggaccccttccatggagtccaaagatgacggctcaatgggattctctcattcttgtccaccaaaccagaaggcaggtctgcccacctcccctggcccttctgttcaagaactggcttcatctctcttcagcatcggcctctgagacctaaagggctgcctgtttccctgtgttcctgagggtgccagcctgcatcttgccaagtagtttcttagactcagatgattcctgttctctctgtgctcagactttccaacccacccacaaacattcattaagcccctgataagtacaaggccccgaactcagggaaatggaggggactgaaggagacgtgtgccaccctgttccccgagcgttgctccgggagacgagatgtatcttgcaaccagctcagcggtggaagcagtggaagtgcagacagaaagccccatggcagaagggagagaggtcctgccccactcccggtctctgcaacatgcttcccggccccggcacgctcagccctggtccaacttatcatacaagttcttgggcaagtgggactttatgaaggaggtagtcacagagacccaccgctcaggcctcctgctgggggagctgggctataacttccgcttcccccttcacacagagaccatgctcccaacccaccccaaacccgccagcaccctcagcccctgccctgggctgctcccagccaatgcctaagcgccgggtgctgggtcaccctgagactctcgctgtccaatcttccctgccaccgtggccgcaggggtcagaaagaagatgccccctgtcttctgcctcctaccctcatccttcccgggcagttcccccagtgagtctggtgtgtgttgagtcctgtcctggcacctgcctctcaagggacctgcattcctgcctgggtcccgcccacagcaccactgtcttgcgatgggcactgtcactcccacctggcttcccagagcctatgtgggcctggcaccctgatctgttctcaacaagaaactggagcctgcccctcctccccctgagtttgccaggcagcctgtaagttggggctccaagtaacgccttccctggcccctgtgcctactgaggtagttctgttatttcactgaggccgccacattcaatctgcaccttcccatggaactctcccaattggctgtgcttgctctgcccaggtccagaccaggggcagctctggcccagtcctgggctcctccaggtctgtgagcacccccaggggatgtgcttaggtcagggtgaggcctggccactagcactggcccaggggcgagcccttccaagatggtccaatcagaatcagggaagggccctcattccacagtagggggaaatgccctttcttctttctctccctccagatcataaacctacaaactcctccagtggctgcagacagccgtttgtgaccacaaggaaaggtagtggaagcccagatggacacagagagaaagaacacagacttgctggtctgggacaagcattgttgttcaagccagttcgcgtttgagtttctgttacttccagccccaaaagcaccctagataggagagtctacctaatacagcaagaccatggccctttccagaaagggtggaggctgctagctcaggaggtcggtctataggcaattaaatctctgtgggtgtaacacagactgtgttcttactgctatttgtggaaaacaattttcttaaaatagatagaacagaccttgacaccctgaagtcaagcactgacagcctctgttttgaaaacaaagcaccgtcaagctctagaaaatgcatgcagggctccagagcccgtccagatgagcagaaatggcagagggggacagagggggatgaaggaggagagaatggaggggatggagggggatggaggggatggatggggacagagggggataaaggaggacagagagaatggaggggatggagggggatgaagggggcagagggatggaaagggatggagggggacaggggattgaggggagagagggcaatggagggtttggaggggatagaggggacagaagggcatggaggagaatggaacgggagggagagggtcagaggggatggttggggacagagggtagtggtggggggaatggagggggatggagagggatggagcggggtaataagggcagaaggaacagaaggagatggagcaggcagaggggatggagggaatggaggagaatgaagaacagaggggggtgaaaaaggacagaccagggtggaggggcatgaagggggcagaggggatggaggggacacagagggcagagggggacagaaggatagaggatgtcagagggctggatggggcagcctggccacctacccaggcatgggagccagaaccctgcagccgcccagcactcaggcttttctggggtcccatccctgcagccacccatcctgcatcctgaagcgggggtcctgtcccctctctgcatctcgaaaatgccccttcctgcttcctctgccatctcctcggtcactctggagctgccttctgcctacaactggagctctaatgccaacaggaaagggctgaagacagggccagggccagggccggggccagggccggggccgaggccagcacagcgctatggggcccagctggggtgcctgagggcctggctccccagagcacgtcctccctccaaggcctctcatgcagaaccgagggtgaccagccacctcccacaggaggcgtgccacccctctgccccatggtcacctaatgtccccctccaggcctgcccgtgacagtgggggacatatgctaggaccccctggggcagtcaaggacattctaccctgttggccagggagcagcagggtaggcccctctaaaatctgagtagagatttagtttgtctggagaagacagatgttttggcctcggatattcacagtgtcaggccaacgtcccatcaagcatgtaccagccaattatgtttgctttcatagacgttatctggccttaccattcctctctgacccaggtcccttagttcccatggtgactctgtacaaacactacacatactccttgtcctagattctttccccttatctgcctatcccaaccctgctactccctcgaggcccagttcaaggccacctcctccatgcagcccaccctgactactccttcccacacaatcaccttgcagaattcctcaagcgtggctgtggcattctgtcttgtgggtgagctggctattgtttcctgcatgtgaatatgatggatgttgtagaatcctcctggcatagctcctagtgcccacagcacagtgagcctgtaacccgtatttctcattagttggctctctcatttacccccagagacattctttacaatgcaggtgtagactcagatgtgaccaagactttgctatcttataaaaggggttcagcccattgcagtctggttttcctagcacccttcctcctgacgagctatgttcaggggagcgttagttcgttacctgcttgacatggcactgcctgccaacctcaccttaggaaaagggtaaataagtttacaaacattaggatgggtgaaagcagccatctttcagccaaggatgtcttgccattggcatcctttcctctcctactcttggcatcaaaacttccagcgaaaggactaccatcacttaccccagctccctccccaggggtctcctcgtggagctcatctctcactgaggaaagaagggctcggctttgataaaggaatgctagactttagcaggtgagtggcgggggtaggatcctgtctattctccagaaatgccatgagactcccgtggggacacacggacatgcagccccatgctctgcgaggttcgtgtgcaagggaagccgagagtgtgcaccgccgcctccccaccatcagccaacagctcaacaccgattcccagtcccggctgtcacaggcacttcttattatggatgtgctactaacacacagcaaaactgattagataggcacaggcccggcaggtccccattaaaggacattcttccctgccccagaggccttttaatcctccagctgctccccatttctgagcaccccagccccacaaccacatccttggctcctcttttcttaggtctctgcctcccaaaaagtggaaaacggaaggctgcagacaggaaagacatcccctgcagcctgcccactcctcccctccaccgcaggagaactggagaaattctatgctagtcaccatctctttctgtgtccacagccccggctctgagaggtggaccacagtgacgttgtgcatctcctgggctgaatgtcagtttagaatcagtgttctgtcacctccaataccctttccctaatgcccagttgccctggtaaaagccataagtccctttggggaagaacgggagagaggttaatagtatacatttttggtagtgcagtggagtccttcttcaaggggacccagcctccccctccactcaaagagttctgggtctggaaactggctcaagcctaagaattgattgaaggaccatgacgcattcgagctagacttttgttcacttggcctacacttctacttatacagatcgagttagaatgtagtaggcttcccatccatttcacttctaagaacatggtggcgaactggcccacgccctaggtcacgcggcccaccccaaggagttgagtctgacggtcctgatggctgcttggcctctgctttcgccgatgggccgcacctgccttgcctttggtgattgtttccacttggcccctgccatgctgggacccagatactcccacttcatttaggatccctggtcagtggcagtaggtccccctgtgatttccaacctacagggagctcttcaagggcgctgggctccctcaccacagtcttggtgaaaggtgtgtgagtggcaggtgagttggtctcaactggcaaatcctctccagtctccctgagccatgatgcctccctctgcagcagacgcaggcgtttctggtgtttcaactccgttcagcatgggccacctttgggtccatgtttcagccaacccgcccgtgaagcctgaagcagctccatcttgggagcaaatcctccacctcggcttctgatcaaccccggttccagctgatctactgttctgtgtaagagcaagtacttgtcataaatcctgcccttacggcaaatcaaccttgataaactccacggtaaatcctgcccttaggcatattcctacaccttccctctggagcaccatacctttgccctatgtatagaagccctgggtccggggggtgctggtggggacctacctgtcttgtggttgcccaagactacacttctgcccgtaagttcccccaataaaatcaccctataacaacacactggatttgtctgtcttgttctttggtttctgggctctttctgcatttgggggtcgctttgcatacagggccctttcacagacacagccagacagactgcagggctcttccagctcccagcccctttgtcatcctctcagcaagcccagggatgggcatctccacagagtctgtcggccctgctgtccctcagaggttgcacctgctcccgtcctcccctcctgaggaagggggtgactggtgacttcccaaggcagggaggttcccacaggccatgctgctcagagcccgaggatgggaacttctgcgcgggcccttggagggtagagctggtgctggctcacttgtctccaggtcccgtcgtcgccctcccaggcgctccctcccggcacttcccgggctttgggcacccttgcttccctcttttcaaaggaccctgtgctctcggaccctgcgcaggattccagagcttgcacactccctagccggagcagccgcttgcccgccccacaagtgcggctctccgcgccacgctccctcctgctagggctccaagtgccgacttgcagaggcctcgggagtgacagtggaacagagggtggcaccggcaccagaaagcaccccccgagcctagatttctaccttcagaaactccgacagtggggacccggggcgtggcggggctgctcagtgcgtcccagctcctcctcggtgcccaaggaggctgccactgtggccgtgagtccaggagaggcctcccaaccctggcctgtggatgcatcgacccctttcaccgcgcctgacgtgagtactcctgccccttcacgggccaacaggagcgaggtcggccctgcctcaaagggcctgtgatccccctaccgtgtgatgatacaaagagcaggcgagaagcaacccacgtgtccatcgacgcatgaacaaaatggggtccacatgcacagcagaatattactcagccttaaaaaagagggggatcctgccacccgccacccacacacacgaaggacatctgtgtggacatgatgcttgagggaaacaggccagtcacaaacaaatactgtctgattccgctgacgagaggtccctggagtcatcaatgcatagagacaggaagtagaagggtggcctccaggggctggggaggagcatggggagtcagggttgatgggccagagtttaagtgcttcaggatgaaaagggttccggagatggatggctggctgcacagccacgtgcgtgtacttaatgctactgagctgtacacctaaagatgggtacattggtaaattttatgttatgcatatttaccgcagtgaagaaaaaaaaaaaaagagccaggctgggtgtggtggcactttaccattccacagaagagctaatatcaagaaaccaaataaaacctaggcaaaaatacaattatttataatttgtattcaattatatacagacagttcataccagacaggagaagacagataagacttgaagtgtggggaagacctcagcacccggggcccccagggctgcacaggggctggtctgcaccctgcctgtgccctttctgccactggtgggagaagaaagaggccgagaggagctatgtcactgcacctcgaaatcccggtggctgagcaggttgggccctcccccactttgattttctttgatttttctatcctagggatgaaggtgatctatttttagtgtagaggctggtataaggagttgctatagcgacagctggtggttacaaaccaggtcctgctacagttcccagtcatgaataaatcccaaggctgagcccgaggaagcaggcagcctcagagatggtgctccctctccacaggggtcccacctgctatcttcatggtgtgtccttcacaggcagcatctaagtcctgctagtggggaagcagctcaggacatggggcgctggggactgcccatcagaggaaccgagggcttcagcagaaatgcatgctgagcctcaactaccaggtgaggcaaagcacctgcgtgtgcgcagagccggatggtggcagaagagagctggcatgcagggcgccaggttaggaagcctggggaagtgaagacacagcacctgcttacagaatcaccagggaggcaggacacacacacacacacacacacacacacacgcacacacacacagagctgatgccacattatttactatggctgcgtgcgtaccctactaccagtaatcttagtacgagtccaacagaaaggcacaccaacgcacaagagtgcccatgagagcactctgtcacagccccgactggaaaccacggtgtccattaacaactggacggacgcaggagtcgttgtctgggcagacagcggagggttctgcagcaatgaaatggagttgatgaacttcaacgccgcacgcaggcacggctgcatctcacaaagtgcaagtgaaagaagccagaccaaaaaaaaatcgtgtaaattcaaaaccagacgatgccaatcttgaggggaagtagctgggagagagtatggggagcttctggggtgctggctacacaagggtgttcagtttgtgcaaattcgtcatctatgatctgtgctcttctccatatgcttacactttagcaaactttgccttaaacatttttagaagttagcacagcattgttagtcaagtatcaaaaaggtgatactggctgggcgcggtggctcacacctgtaatcccagcgctttgggaggccaaggcgggcggatcacctgaggtcaggaattcaagaccagtctgaccaacatagtgaaaccccgcctctactaaaaatacaaaattagctgggcatggtggtatgcgcctgtaatcccacctactcaggaagctgaggtaggagaatctcttgaacccagcaggcggaggttacagtgagccaagattgcgtcattgcactccagcctgggcaacgagagcaaaactcagtctcaaaaaaaaaaacaaaaaacaaaacaaaaccgatactcaatggtatttggtgttggtgggctttgaggcagacctgcctgtgggggactgggacctccaggaggaggcagggccctacgcccctccaggctgtaatgagtgcaggggcagaggcatccagccatcgaggtggggaggaccccaggtgagccaccagcagccacgggagccccgtggggaggaaggcaggctggggcagcaggagaccagagctggggtgcccctgggcagggactctggaagggctaggaaactgaggctgatcaccctgcaggctggcgcacgggtgcctgcctggagacgcaggggtttgctccttttttctgtgctgccaactggacatccctcctcagggtcactggccacagctgctcagaggtcactccagactgcagccactccctttccatcagccttagctgttctgtgatcaaaacagggctggccaggcccaggagcgagaaggagggagggagggagggaggaggggccttcaggccctgtatcccctgggaggcgcagggcagccgggtcagcgttcaggtgctgttcattgatgaactcactagcattagctgatgtgtcatctcttccagccaaaagtggggcccagccaagcatcttagtgatgtgagtcatcaaaacttcctcctgggtctgctttgagccccaccttcctcctcctgcagtcatgctcttagcctcagggccctggggcggacgcccggacactcccccagcagcctgctttccagaggccactgcgctgctcagctccgggggcccgtcctccgtggatccctccaggcccagcagagtgtttgaccacgggcctgaccgggaggggagacgccacctcctggggacttgcaccccaaccagcaccactgtcatgagacacccggaggccagcagtccccagggccccaagaacacacagcagcaccagagactgccttggccctcagggaacgttcatgttgatttacgctgagagcacctggactttgcctatttttttcttctcaatcgctaaaagacaaattattaccgcagggcagaattcatcttgctctctgaatgtaccaagtgctcactctcatctggaaattggaaccccgggtgaccatccttgggtgccaaggctccctggacccacgcacaagccctgagtgaggtcctgtctcacaggatgggggtgacagagcagcaggggctggccagcacccagccaggctgcggccccaaccccaggtcaccaagctgtggtggcttctctgtcaccgtccagagtcactattttaaaaatacacccccttttgaatctcctttctccctgcttcattatttaccccttcaggctctgaaatctttccctttcgtcttcggacactttcagacgctgcagtcctggaattgtttgtccagtgttcagcttctctgctgggaacccgggctctccagagggcggctgctcccagagccacgccactgtcacgacagctcacctctcacagccctgatgagcgcccctgggagagcacgcacctcgctgacaccccaccagcgcccagccccgtccacaggcgatgctcacctgttcctggggatttagtcttcctgacttagagcagcagctctgggtgactgggatggggtcagaaaagggaaaggggcacttgaccgtgacatccaaggacacgcaccagagctgctttgctaccctgccaccctgtgaggtgacagccgcctggcctgctgagtgactccgggagtcctcggggagcagcacctctgggagagctgggccacttgtccagggttccaccaggcagcgcttggtgacagtgacgtagggagaacaggcagatgggttatgagcttttccaggcatggatgagagtggggcggacagggggtggcgggcgggcctcaccaaatccacggctgggagtggagagttctcaaattgtgtgaacactgtcccatcatcccaaatgcttctactcactggctacagtgtccgaaaccccccaaagacccatcctcacaaacaaggatgccgcacccctaggagtcttctgtttggacacatccagcagaacaatgggcaccagggctggacggttttgggtgggaactggcaaaaggagaggtgggtgggggccggggagggccttggagccagaggggttgggggagggacagcctcagccccagctgtctggcacataataggctcttaatagtgggctcagccccagctctgtccgcactccacttgggcaggccagtccttagcccatcggtgctcaagacccccgagggccttcatctcaagcaggtgtgatccagagccctcccacggtccacaagaggggcatacactggctgctgtgcccagcctcagcctcatctcctacctgccagagaccggctcctgtggctctgcctgctgccgtccagccccgcaggcctctcggagtccctagaacacaccgcaggctcccttctggggcctggcctctccagctctcggaagggtctgagcacaggcatccacacagccctctccccatcacccactgaaccgacccctcgccctgcctccacggcatcaccaccacctgacctggtgatgaaaatacgtttgccatcgaaacaaggcagacgcaaaaggacaaacactacgtgattctatttctaggaggtccctggagttatcacattcgtagaaagtagaatggtgtttgccaggggctggggtcaggggagtggggagttagggcttagaagagacagtttcagctgtgagtgatggaggacatggcaggtggtaatgcctacacaataatgggaatgcatacgtgaaatggtgaagatggtaaatttgtattatgtacatctgaccacaattaaaatcccctcattcatctacccactctcaccaggccgtgtggccccgagggtgcatgcatctctcactcactgctgtccctagtgtgggaacagaggccagcacaaagaccctgaggatgcaggtgagaatgacagaacctgtcattgttaaccctggaagacagatgctgttatactgttctccctacttctgtattctttcgaaaatttctggccaggtgtggtggctcacatctgtcatcctagcactttgggaagccaacgtggaggatcgcttgagcccaggagttcgagaccaccctgggcaacatagggaaaccccgtctctttttaaaaacaaatttaaaaagtaaaataaaaagaaaatttctattggaaaaaggcaaacatatatattgggaaatttcagggcaaaaccaatagtgataccagcagccaggccagcagatgggcgccagaggcagtgtgaggactatgaggggtgaggaggagcaggggggctggatgggggcgggagagaccacaggcttgacttctcagccctatccctctgctgaagtgaagagcacaagatggtccccacagggccatactcagccaagggcaggagagccatggcacgcagtattggggtgacctgaatgttcatgggccaggaaggatgctggcgttctgggcaagaagccgttgcgtagtcatgcggtgtgggctcatggaaggggaggtgggtataagggccaagcgtcctcagaggatgtggtctccggtcttactgggaccctgggcacacaaggatgaaacaccagcttcctgacacaccgcttggactcctggctccagtgctggcctcagaaatgagcccttaagacgctaaatggtttttatttaattactgccctgtaattgcagagggtgaaagcgctactacagtcattgctctttgatctgattagcataatcctttcctaatcttccctctacatttttattattgttgccacataccctttgtcgacataatctggatttctctttgccaaagaggccgaaagaaaggcttagccaagctcgtcacttgtctagcgcctggagcctgaaagctggagaggtggggagcttcccttctgtgccagacatggcctccctgcctggctctgcagccagagaggggtaagggctgagcactcctgagtcagagcttccagggggctctgtcacaaggccagcgggtgaacatttccagcgacagccacaggctttccagtggaaatgccatccaccgcaattacgaatggacctggtgattccgggggctgcagggccttgatttgatggctgtggggagagctctgtgtgtgtgtgtgcgcacaggtacatgacatgtgtgtgcgagtgtgtatctcttgacccggggaactgcagggaagcccccagataaacagtgtgcaccttgtccctggggaagcagctccatgctgagttaaggcagaggagcccgtggttcctggaaaagactgacacagccacagaggaaacccagtggatgggagggacctgtgccaacagcctaggtgggcttcctgtggagaggagggaggagaagtcaatgacagggatttcatgaccctcacagaagctttctcagggagaagaggcctcatctaagatttttgtttgtcttttgagacagtgtctcactctgtctcccaggctggagtgcagtggtataatcttggctcacttcaacctctgccttgtgggctcaagtgatcctcccaccttagcctccccagtagctgggactacaggtgcacacaaccacacccaactaactattttttgtagagaaggagttttgccatgttgcccaagttggtctcaaactcctgggctcaagcactcctctacctgcctcaacctaccaaagtgttggatcacaggcatgagccacagcacctggcttttttttttttttttttttttgagacagggtctagttctgtcacccaggcgggagtgcagtggcatgatcacggctcattgcagccttgacctccccaggcttaagcaatcctcccaactcagccttccaattagctgggactaccgacatgcaccaccacgcctggctaattgttgtatttttcatagagatggggttttaccacattgtccaggctggtcccaaactcctggactcaaacgagccacgtacctccgcctcccaaagtgctgggatgacaggcatgagccaccgaacccagccctgagattctatctccgggaataactgtatgaaggagagggcgttgctgagagggaatttaaaacacaaaaccctgaagcaatccttcttggagaacagggagcaaccctgggctggaacgttttccagctatcgcagagccagcggtttttatggagaacctgcgatgctgcaagacctagggttagagctacagaccgtgctcctgagatatcgcccctgttcacaagcagccagatcacagaaaaggcacccagagtggtttttctttgagacggagtctcactgttgtcacccaggctagagtgcaatggcataatcttggctcactgcaacctcctcctcccgggtttcagcaattctcctgtctcagcctcccgagcagctgggattacaggcacctgctaacacccccggccaatttttgcatttttagtagagacaaggtttcatcatgttgaccaggctggtctcaaactcctgacctcaggtgatccacctgcctcagcctcctgaagtgctgggattacaggtgtgagccaccgtgccaggccctcagggtggttttctagacagtgatcgttcagctgggtcttgagaaatgggtaaggtttagacaggcacaggcttgggagggagggcttggtcaacactcttggactgtttttcctcactcagtgtatccacgcccaacactgtctgtggggcacagggctcccgcctcccacccagcctagctcttggctcttctcactgacacactaaccaaagtcagacatactatcaacccaggtccctgggctccagcccactaagaggagccttagcctgagcaggggctatggcctcttgctgtttcccaaattccagaggaaggctctggagggacctccgattttcttgaccctgtggtcagagcttgcatctgcatccaggctcttacaaaacttggttgagatgtaaacattgtttttgatgtcagaagcgtaggagacaggatgacagccaaccgttaaacacaaggcgggaagccactgtctggcacataataggctcttaataatgggcctgtccatccccattagcaaaaccagatttttagttaataataggttctggtttaattctacagtagataagtgtttattactttattacttaaataaaagtcatctttttagaccgtgttagtgagtctcccgtctaggattccatccctcctctccctgctcagggctgggtgtcctattcccgtgcacagtcaccatttttttttttttgagggtcttgcgctgactcccagcctggagtacagtgatgtgatcagagatcactgcagcctcccctcccaggctcaagcgatcttcccacttcagctttctgagtagctgggaccatgggtgtgcaccaccatgcctggctaattttttatttttttgtagagaggggtctcatgatgttgcccaggctggtctcgaactcctaggctcaagcagtcctcccacctcaacctcccaaagtgctgggaatgcaggcttgagccaccgcacctggcctacattcacctacaagtgatcccccaaccttagcctcctgagtagctggaactctactcgattagacgccgctctctagttctctttatggggctttcttcttcacaagattgaacactctctgggttcaaggactgctgtctccttcacctgctctcccccgaggactcagcacaatctgagcctgcagacgcttccaggagagctgcccaaagcggatatagcaagaaatacaggcagattttagatttacctttttctttttctgctcttccagttttcatttacagttcagacattttgccaaagtcacctccctgttacacataatgacaatatttttccacttaacacatcacattccggtcaggggacatggcttcatacaccccccaggctcctcattttactcatcccctaggctgtgtctccccagccctggtgaaactcagctgataaataacagcactggggtaggggtcctgctgttccatcttgcagtgggctcttcaggaataacctatgccatgcaagcagtaacgctggcaatgcgctgactctgatttgtttttttagatagggtctagctttgtcacccaggctggagtgtagtggcccaatcacaactaactgtagcctcgacctcctgggctcaagggagcctcccatctcagcctcctgagtagctgggactacaggcatgtgccaccatgctcggctaacttttaaatttttttgtagagagaaggtctcattatgttgcccaggcttgtctcaaactcctgggttcaagtgatccttcctccttggcctcccaaagtcctgggattataggcccagcctaaatctgattcttttttttttttttttttttttttgaggcagagtcttgctctgtcgcccaggctgaagtgcagtggtgtgacctgggctcactgcaacctctgcctcctgggttcaagcgattctcctgtcttagcctcccgagtagctgggactatatgcgcacgccaccacgcccagctaattttttgtatttttagtagagacagggtttcaccatgttggccaggctggtctcgaactcctgacctcaggtgatccgcctgttttggtctcccaaagtgctgggattacaggcatgagccaccgcgcccggcctctgattcttaataaatgaaatctgacatctaattttgagtgggcaggtcttaaccaggtgtggagctaagaaagctttggaatcgacctgtgtggctgcagacagacaagggcaaaacccactccaagtctgcaggtccttgaaaatactgaaccacagatgcttcaccacctgttccacttgccctgaccccatcctcctgtacatggaggagctgcagaagttgccagagaccagggagaccacaatgcaagcttctcctcatggggcacaaattaggcaggtgtttcccctcccacattagcccacgatctgtcagattactccgctacggaacctgggaagaagacctctctcttcctgacctccaatagtttcctctaaactgcatgtttcatttttaacagctgaaaacaacagtgcccatccactcttacttttcccctgagccacagtttttgcataaatgaatgacaatccaatccatcactagcctccctgggccaggtggggcaagaaaggaaacagcttcagaaagagtattgtcaggcggctccccacagcagcactgccatcagcaaggaaacacttcccacgtattcctctaaccaccgcctgatgttatatcccagttggaagagagtggctggaaacagctactgcttaggagggtgtgcacacacgccgtggggttccctcccaaggacagaccaccaggggctcgggaatgggcagagtcctaccgaaaaggccatgaggctccgactggcgcctctccgtgcttcgattttggtccttgtgtttcttgttgctcctgaggctcccaaagcgcttcatgggtagctgtggccacaggagtggcgacaggtgaacatatcaggacccacagaaccggtgtcagccccaggtggccgggagccagaggagcatcagcccgacaggcacagggcgccccaaaagctcagagtggcagcctgtgctcaggtgacagcccgggttcaagcgtcctcaccagggggtcttcagggcgacctcaccgcagccccagagtctgtgaggcgccagggagtggagccgtcctgacggggctgcacctccggccacagcagctggagcgtcagcccggctgtccttaagtagcaagaagctgccggaagcgcaaacagaacttcgcaggggatttgttgatgtagttaaggtcagctgctcactgatactctccagggctttttttttttttttttttctccttaaaattaaaaaaaggagggaagaccagataggcaaaggaggcacaagcctgcaagtcatgtgcagccgtgcatgatgtctctttaaacagactgtaaaaggaaaccaccctgggcagacaattcttggcaccaattggccagagcacattcccattgtgacatgacatcacacaactattttgattcatgggttccagggccccacggggtcagaaggctccggctgctgccgggtggagaagccacacaagtccctgggctggaaattgctgaatctaccctggctcacggttccactcaatgaaagcagcaatgccgtcttcaaggaggggatacagctccccgactggaatttaacggaaggtcttcggcaaatgcgtaatttgagctctggacttgctgagaattgcagcatgacagagctggaagagattttagagagatctagtccaactcccttctatgacagatggggaaacaggctcaggacagggaggtgacttccccaagatcctgtcgccaatggtagaaccaggactggagttctaatctccttgactcctaagccaaaccgctgatcaagtaaaacctaaaacatttataatttgtatatgttttgcaaccaataaaacaaactttggaagcaaaagatagaaaaaaaatccttgactttttgtctgatagcctcactaaagttacctgctttgctactaaccagctttgtgaccatcagaaagttacttcccatttctgaacctcagtttcccccttagtgaactaagacaagaccaggtcattttaggatttagtctagggccaggcacggtggctcacgcctgtaatctcagcactttgggaggctgaggtgggaggatggcttgagcctaggagttcaagaccagccagggcaacacagtgagacccccatctctattaaaaaaaaaaaaagagagatttagcctagttccaacagtctgaacctctcatggtaactgattcttcccaaatgactatgcacatgaggaggagactatgtcagaccagttaaataacccccgagctaaagattagtagcctgggttcttctggccgcccactagggtgggataacctcccaaaactgcaacgccatcagtttcttcagcggaattgttattatctacggctcgtccgaaaacaaggggatggagtgtggggtggaagcgccccagcagcttgccactggagcccaggcctcctcaggaaccacaggtccagcctcccaacttgggttgggctgcttttcatgccttttctctcacctctttcatttacagagctcagtgccactggagttgttggcccagtcactgcagatgcctgatgagataaagatggctccacactcgggcaacaggaaggagggcaagggaagtcttccattctatccccatgagatgaaaccctggaagctcagctcccaccccagatctgccattcccatggggcctccatccacagaagccagagatgcccagatctgccactcccacggggcctccatccacagaagccagagatgcccagatctgccactcccacggggcctccatccacagaagccagagatgcccagatgtgccactcccacggggcctccatccacagaagccagagatgcccagatctgccactcccacggggcctccatccacagaagccagagatgcccagatctgccactcccacggggcctccatccacagaagccagagatgcccagatctgccactcccacggggcctccatccacagaagccagagatgcccagatctgccactcccacggggcctccatccacagaagccagagatgcccagatctgccattcccacggggcctccatccacagaagccagagatgcccagatctgccactcacacggggcctccatccacagaagccagagatgcccagatctgccactgccatggggcctctgttgggagcaagccccccaaaatctggccataaactggccccaaaactggccataaacaaaatctctgcagcactgtgacatgttcataatggccctaacgcacaagctggaaggttgtgggtttacggaaatgagggcaaggaacacctggcctgcccagggcggaaaaccgcttaaaggcattcttaagccacaaacaatagcatgagcgatctgtgctttaaggacatgctcctgctgcagttaactagcccaacctattcctttaattcggcccatccctttgtttcccttaagggatgcttttagttaatttaataactatagaaacaatgctaattattggtttgctgttaataaatatgtgggtaaatctctgttggggctctcagctctgaaggctgtgagacccctgatttcccacttcacacctctatatttctgtgtgtgtgtctttaattcctctagtaccactggagttgttggcccagtcactgcagatgcctgatgagataaagatggctccaggctagggcaacaggaaggagggccaagggaagtcttccattctatccccgtgagatgaaaccctggaagctcagctcccaccccagatctgccactcccatggggcctccatccacagaagccaaccgggttcgggtctccccagctgagctggtctcggtagcctccatctgcaggggacacacaccagctcccaagaagcctgctcggccccggcatggctccggtgtagctggagctggttctagcatttcagatcccatcgactggtagagcaactgctcacgtgattggacctgacctattaaagatgtgtaagtgtgctcttcctgcctaggggacctgacccatctctgtctagaatgacctcatagtcataccattgcttagccgatcaagaaactatggtctcaacttttctcatgcaatttctaccaaattgactgagtaacaactgtctacttggtgctgtgctgaatgttgtaaggtcagggagtcctataaggcatgacccagcctttatttatttatttatttatttatttatttatctatttttatttattgagacagagttttgctcttgttgcccaggctggagtgcaatggcacaatctcagctcactgcagcctccgcctcctgggctcaaatgatcctcccacctcagcctcacaagtggctgggactacaggtgcacaccaccacacccaggcaatttttgtatttttcgtagagacgggggtttcgccatgttgcccaggctggtctcgaactcctggcttcaagtgatccacccgccttggcctcccaacatgctgggattacaggtgtgagccaccacacccggctggaattttctaacctacctgctttcgcttacaccatttgccctgcctcctaagcccgtggttttcagctctgcctgctgaaaccccatgaaacccttacggcccaatccagagaccgtgccttcccccaagtgagccctccctcatcactccccaaagaggggacttttctctcctttgaaagattttagctcttctattctatatgtgaatgtcgcccttaccacagagaagactgggaaccccaaaaagataggggcccaggcctcacccgttgtgaggatctcccaagcctacagcaaggcacctgctttgggaggcaccggacagtcaccctgaacgcctgcggtccctccagctgcccctgctccctgatggagccgactggagggactacctggccaggctcctcctcccgggctgctggttagctgcagccaacagtgggcacagcagacgcccgaaggagggaggagttgaggctttcatagctccctacatccctgcagggttgctctggccttgctgtgtcatctcccaagggaagaattcagctcctctcagagaaaccctccctcagacctctgtcttgggtcagggaccctctccttcatccttcaggcacagcagtggcagcagccctgctgatacgaacccgagttactgcaccagtcctagggggttcctggcagcctgcccacacctttgaaagtagtgtctttattcaattctcctccagtgatccaaaaagttcagtgtgcctcctttctcctgctgggactgactgatagatacggggatcagatatttgtagcaaggatgcatgaatgaacacacaaaataggtcttgctctcagtgactttgcaaatgagctggagacaaagataaacaatgctaactgcatgaaaaagccgtgagtatgtgagccgtggctgcaagtgtcgtcagcacaaaggaaggagaggagaaggcccgtgtggccctgcccggagaaggggaacttgagatgggccttcagggttggagggtgtgaagaagaggggggaacccaggccaggccaaatcaatgccggaggggaccccagccttcccaaacaagccgcgaaatctaccgccagctaggtcccctgatatactgatggattatttctgctgttaaatatggtagcccaaacttaactgtgattaaattctggaagtaggtaagtttaggagtttcatgtttagatgtctttttttctttttaaaaatcagcttctaacaaaaattgttttctcgatttaaaaataaaataacacctggtgcggtggctcacacctgtaatcccagcactttgggaggctgaggcgggaggattgcttgagcccgggaggtccaggctctagtgagccatgatcctgccactgcacatcagcctgggcaactgagtgagaccctgtctcaaaaaataaaataaaacaaaataaaataaaagtaacaaagcaaaacatctttaggaaaagacctgaacaagtatcccaataagaaagaggcagatttgattaaaaggaaaatgaaaaggttttgtttcagccagtgtactattcttacactacataatacaacggacagaaagaacatttcaaggccgggcgcagtggctcacacctataatcccagcattttgggaggccgaggcaggtggatcacctgaggtcgggagttcaagaccagcctgaccaacatggtgaaaacccatctctactaaaaataaaattagctgggcatggtggtgcatgcctgtaaccccagctattagggaggctgaggcaggagaatcgcttgaaccaggaggcagaggttgcgatgagccgagatcatgccattgcactccagcctgggcaacaaaagcaaaactctgtctcaaaaaaaaaaaaaaaaagaacatttcaaagtttagtgactgaggtaaatgtattgaaatttgtgtggaaaataaccagcaacttaggcaggcctgacgtttccgtgcttgagtttaaatggtcattcattcaacaggtagttattaaacctctagtaagcgtgcagggcagttgttgattgaagggatgaggtgctacaaataattcggagaaattcctgtcctctaagaaccatattttatttgtaacataataacatttactgaatgcctaccatatgccagctggggtgctggtcaccttacagttattattttatttcatccttcccacacatgagcagggcaggtataattaacatttcattgaaattgaataactgagggtcagagaagtagtttgacctggatggcacagctggtaagttgagagaagatggacttgtcccctcatgtggacccgattcccaaattcacatccttccaccataccatactttctcatccatgtgcacaggaaaattcagcagccattcaataccctagcctgaatcccataggactccagaggaccgctgtggactgaagggatttggaaaagaatttctctctacatcctgatttttcattttaggctgggaaatttaaaggcaaaagaagaagcatgtttaaaaatcctgactgtggctcacgcctgtaatcccagcactttgggaggctgaggcgggtggatcaaggtcaagagattgagaccatcctggccaacatggtgaaaccccgtctctaccaaaaatacaaaaattagctgggcgtgatggtgcgcacctgtagtccccgctactcgagaggctgaggcaggagaatcacttgaacccgggaggcggaggttgcagtgaaccgagattgtgccactgcactccagcctgtgcaacagagtaagattacatctcacaaaaaaaaaaaaaataaaataaaataaaaagtccttatttgcattaaagccacctcgcaacacagaccagacgagtcaggaggctacaacaagctgacctgccttgtgggtacaccgtactctggaagcacaaagccggctgcttcctccccgaggccacttctaggtggctgagcacagaggtggggcacaaaaaactcctcactgctggggtctttctgtttgactcacacatgcctgaaattccttacatgagggacaaagctttggatcccacgattagagatgaacgctgatgcgttgggagagatggcgccttcccattgcagggcaggggctgaggacccttcttcagcatacgtgggcgggggaaagttgaccactcacaggcggatggggacaccaaaccttcccctcttctgtttccgccagtcgatgatcccacatgaatagaggggaaactccctgccacaactgtgaccctgctcagagttccttctaacagaatgcttttcacactcagaattcttttttaaagggaggggctgaaaaaggaaggaaagaatggctcccaaataggaaccgtattttctaatgtatttttaaagggccagggcctttttggatcacagtttaaaactcacacccctggctggtgctgcaacccaaagcctggcacgggaccaggtaattcgggtggcagatgcctttatctcttagcagtgccccgtgctgtgtggccaaggcttccaggtcaccattctgacactaggtttataagatctgggagggagtgaaatcagagctcagctcattcaacgtgtgttctttacgtgtgtcttctggtggctgttcttttagatttctgactacaaacctacctttgacaactcgaaaaagaaaacagtgtggaagaatactaccacaaggcatttcatactgttagcatgcttcattgttttctggcttttggtttaattttctccccagctagactgaaagctccccgatgacaggtatctcacccgcagaagaaagaaaaggagcgattactgagttcctccacgagactcaggagcagcatgatgggtcagggaacagcaagccagctgctgctccatgctcggcatccctgggagcagcatgtcctgttcctggaggacgcttttgtggctgttctggagccagggaggctgtgctgactgctcctctgccctcggcagggctccaggcttggccagccagggctgggctgcgggaggccatggcactaggtcccgttcactctaatacttggattttaccaggtgtgccagcccccccacatctggatgctgcaaaacattccacagccagactgtgcactacacagcagagctgggggcgagagagatgaggaaggagaggtcaggggaactgcagatgggctcgaagatggagcacggtcacccctgcttcctgcacatgaggataagtggcgtgaaggcgaccacccttccacaagagacacaatggcgctcctgtggctctgatatgtaacccccacccccagactccggtgacccaaaacatgcgagtaaaccctttaattgctggaggttctcagccggtgccccggggccacgttcccacggcatcggggaagtgccaggacatgtggcacatgttgtcccactaacgtggtgctggtccaggctgcaggttggagccccaccccagccttatcgcctggtgaatgggactctgggtctccgttgtagacaccatggttggtgcctagcctccacttgtcccccaccccaccactgcagtgggcatctgagagccgagggcgtcatcaggccgagctgcctcctactccaggtagcctgtgaatacctacaggatcaagccccttgaagcccaccctatctctggacttccaattatatcaaaaccaaatttttgaaaagaccccaagctttccgtctcatcaaagccactttgcatgttatgtgaagctgcaaatagtctccttgaagctgtcactggggacccatatgagagaaaagtcactgagactccgtgtaaccaccctccctccatgcgcctccattcattcatgagactggcacttcccagggcagggctgctgaggcctgggagcaccgcgcaggcagaatcagcccggccgaccgagagatccaccagcagagcagggcagggggaaccctagtcacccacaccctgcggctgtacagagctgggagactttgcccgcagcagtttcctacattcttctcaaccatgctgtgtggtagggaggccagccatgactattcagttcaagaaataacatttttcaaaaacccagaagttcagaggtgctcagtgatttgcccaggatccgtgggcagcttgtgggattgtgggggtcgacactggctctgctggttcctcatcagggggccatcaagagccaggctgcctctgctccatgggtggacggctgcagaagcaggtgaggatgcactactcaaaaacttcccgctcatcctgaacctttgcggatcacgaggccatacctgcaaagcacccagtcccctgcacggctgcgttccaaaccacatctcattatgcaagagggcacgggtcccctccgcgccggggagcagcaacacgccttagcacatatttgccagagctctcctgccggttgcaaaatactgtgtcatgtttcatggaaagttctaaaggtcactgctgcacttgactctgagatcgccacgtcgcctcactggggcctccacgccctgccccaggaggtgtttatgagctggcacctctgcggagcaccctctgccctgactcaagcccccacgcctctgttccacgtcagcccgacacactcatggtcatgcacagcctcgtggtgaccacaggaactggagcctgagtctctgagtgacaagagggtgatttttttggcagagacaaaccacctcagctcacacagctccactcacaccagcgatatctaaggccactgagaactggcagaggcaacaggggcatcttgattttaaaaacacagagaagtactaaaaaggtgaaaaacgatagcaataattatttttagcatgccgaaatgcagcacccaaagagtaagaaatccctggatctccttaaaatctggaaggggcatcgcattcccccatggagggctcggtggggcccttttcagtcccttctcgtggtgcctggcaaccctgcagtcgctcagtgtccaagagcacaccaggccaagagctctgagggctccagcggcaagaacctgccctgattccagctgctccgtggcgcagaagctgagcgctgggctcaacgggggccaccaagcaatggcttctgaaaaccagattctgaaactctgcaggccagccatttgggttttctgtttaattctctttaagtgatttaattctcttacaagtgctgaagtgagctgggaatgcaccgaagccttggagaaggacccggttaactcccggactcagcggaaagccagtttggcctgtggtctctcacttctaggcgatggggcaggatttccagtgtctggacctgggctggtcacagagcaatccacctcctcctgcacgtcactccttaagaagcccctagcttagattatgagggctgagctgaagtttgcctcagatctctttcttcttatagtgaaatatatttcaaaacaaggtaacaggtagaaaggtttaaaacacttaggtcagagaaccttaaagcaacacaggttcacccattggcatgcaattctgagccatttagtttattcttccacatttctcccataagagagaccattttacagggtttcaaggtgattaaataagacagaatagcaaaaatatcctgtaagctgcagagcatttcacaaacagaggacatggccattctctgtccctgaaagcagcctctcaggagctccactagctcaggcacaaggtgcccgaaaggacctcgcgtgaacagctgcggaaagcctgggtgaggactgaaggccgcctgctccagtggctgctcctgggacggctgctgggcaccatgctgagaattcagaggctgtggccggagcctggggagagagcgctgggctccacgattctggcctggccaggcagcgcttggacttgcaataggagctccacaccttggcagaacctgctctggatctcagcagagaaatcagaaggaattggacaaagccctgctcatcagcccagtgctcaaagccccagcatttcacgtcctgaatgaggaatgaagggattttctcagtaacaatttactctttttaaccacacatactaagaaaactttattcgcagcaaattgtgatggggcgggggagagggtaggtaccattcaaggcaggaacatgggctgccacagagcaggtagtggcacaaggaaggagacagagagggtgagcagaactcgggcagagggcacagacatcctgcctcaaacagaagtttgttctcataactcagtggctgctgctggatgtgttgacgcatatagggtgatctagcaagaacctgactcatctataaagagtgaaattacagtacttggtatcttttgaataagaaaactgttggctctcgccagtaatctcagcactttgggaggccgaggtgggtggatcacctgaggtcaggagttcgagaccagcctggccaacatggtgaaactccgtctctactaaaaatacaaaaattagccgggcgtggtggcgggcgcctgtaatcccagttactcaggaggctgaggcaggagaatcgcttgaacctggaaggcggggtttgtagtgagccgagattgcgccactgcactccagcctgggtgatagagagagactccgtctcaaaaaaaaaccaaccaaccaaacaaacaaaaaaactgtaaagtatgtaatgcatctgacacttaaaaaagatgtatgctctggtactcgatggcttaagttccagatatctagaaagttagctcacgtggcttgttcattccttgagactggcaagatacaaaaacaaaacaaaacaaaacaaaaaacaaaagtcattctaccacttgattgttcactctttcagattggctttatcccaaatgtcagatgttactacattcacggacatcactcacctcaaattcttttctgtttatagcatcactctcagtggggctaagggggtgaaaatcacctcttggagggggcaaaaaaacttactttttttttttttttttttttgggacaaggtctcactctattgcccggggttgagtgctgtggcacaatctcagctcactgtaactgccacctcccagactcagcaatcctcccacatcagcctccctagtagctggtactacaggcacgtgccaccacgcctggctaatttttgtagtttttgtagagatggggtttcaccatgttgcccagactggtctcaaactcttggactcaagtgatccgcccacctcggcctccctaagtgctgggattacaggcgtgagtcactgtaaccagccaaaaatcttacttcttatatacaaggaacagctatacttacagtataagtaaacaatagatagtatatgtaacaatgtaaacaatagatagtatatctgttttattaaaatttcatagaggttatcagaaaaaagtcagaaaggcattttagggggtaattttcaaaagattgatttttttaaaagagagcagagggaaaactgggaaggtgtggggtgggacattgaattatctgcccctccattttaataggacgtcaacatacaaggtttaacactgataaatcataaaatagttgacgaggcatatgatttttaaaggcttcttttggggtttggttgaggagggtgggaactactgcttttcaatataaattgttttggaatgtttggtttttttaaccatgcgattgaactacttcactgaaaattaaaatgtaaaggggagaaaattgaacaaaaaaaatctggtaaatggtgataagtatctatagcagacaaaaatcagcaaggtacattctcaaaaactccctttggcaaaagctaaaataaaaataaaaaaggttgcaaaactccgtcatcagcagcggcaaggaggaaagaacatccgtgccgtgccacctggccttcgccccgccgcgcccgcagccagagagatgagctgggcactttcacccaacctgcccccagtgacgacagtgagagtatttgctaatcattcgccaaaattttaaaacacagttttctgggctttaggcaacatggggctggcctgggtgttttggagcctccgagggtgaggaagaggctgacggttttcctcatagaggcccacgggccagatgtctccagagaggagatgctcaaaagaaactgtgctcactgcaaagcagaagagatgcggttaagcaagagaactggattaaccatccatccaaagatcaaactcagaaaaggaggctacggagaatttgccatcttttctctctcctcactagaagctttaaagggatagttagaccctgagtcagcctttcacattgtagcaagcagacacctggaggggcaatgagacagtcccccgtccatcagcctatcctgatgccccatttctttgaatcagtgaactgtagtccccggtatccacctccctcactctctctgcttcctccatttcagtaagcgttcagtgtctacatgggccaggtacagagaagcagcatatgaaggtgacgttggtcatcaaaactctgctgttatgaaacatttttgtgcatcagaggacaataataagagagtgaaaaggcagctcacaggaaaggagaaaatatttgcaagtcatatatctgataagtgtctagtatccagaatacataaagaactacaactctacaacaaaaagacaatccaatcaaaaaaatgagcagctgccttgattaaatatttccccaaagaagacacacaggtggccaaaaggtacaagaaaagatgctaaactttactagggaactgcaaatcaaaacagcaatggtagaccacttcacatcctctaggacaaccacactgaaaaaaaaaaaaaaaaggaaaagaactgggtcgggcatggtggctcatgcctgtcatctcagcactttgggaggccgaggtgggcagatcacgtgaggtcaggagtttgagaccagcctggccaacatggtgaaatcccatctccactaaacatataaaaattagctgggcatggtggcacatgctcatagccccagctactcgggaggctgaggcaggagaattgcttgaacctgggaagcagaggttgtagtgagccgagatggtgccactgcattccagcttgggtgacacagcaagactccatctcaaaaaaaaaaaaaaaaaaaaagaactgaaccgttggcaaggatatggagaaactggaaccttcatacattgctgatgggaatgtaaaacactgcactgtggaaaacattcctcaacaagttaaacacaaaatgaccatatgacccagaacctgcagtcctaggtatatacccaagagaactgcaaacgggtgttccaacaacttgtacatgaacgttgatggcagctctattcacaaaaggtggaaacaacccaaatggccaccagtggatgactgagtaagcagaatggagtctattctacaatggaatattattcaggcataaaaaggaatgaaattccaatatatgccacaaagtagatcgactttcaaaacaatctgctaagtgatagaagccacatgcagaagcccgcaggtcatggggttctgtttctgtgagatatgcagaataggcaagtccagaaaggcagacggcagcttagcatctgctaagagctgtgggaaggggtaatggagattgagggctaagggatgtgaggtttccatttggggtgatgaaacagttctggaactagattggggtgatggtcgcacaacactgtgactactgagttatatactttaacactgttaaggtggccaggcacagtggtatgttcctgtcgtcccagctactaaggaggctaaggtgggaggatcacttgggcccaggaggcagaggttgcagtgagccaagatggcaccactacactccagcctgggacagagcaagaccctgtctccaaaaaaaaaaaaaatttgttaaggtgctaaattacatattatatgcattttaccacaaaaaaagttaaacctacaaatactaaaggaaaatatggattaattctacaatctggatttctaatgatgactaagtatgctcatgctattgtctaatggctattttcatgtcttttgaggattgcctaggcatgtcttttgccatactgattcaaagattcctttttttttttttttttgagacggagtctcactctgtcgcccaggctggagtgtagtggtgtgatctcagctcactgcaagctctgcctcccaggttcatgctattctcctgcctcagcctcccaagtagctgggactacaggtgcccgccaccatgccaggctaatttttatttatttatttatttacttatttttagtagagacggggtttcaccgtgttagccaggatggtctcgatctcctgacctcgtgatctgcctgcctcagcctcccaaagtgctgggattacaggtttagtaagccaccacgcccggcccaaagatgccatattttttttacagctacatggtactctgctatgtagctgtaacttctttatttcattgaactactctatttattatttatttatttatttatttttttgagacaggttctcgctttgtcgcccagactggagtgcagtgcaatcacagcgcactgcagccgtgaactcctgggctcaagtgatcatcctgcctcagactcccaagtacctgggacgacaggcacatgtctccatgcccagctatttttgtttgtttgtttgtttgtttgtttgtttggtagagacagggtctcgctacggtcttgaactcctgagctcaagcaatcctcctgcctcagactcccaaagtgctgggattacatgtgtaagccacctcacctggccaactactctcttctatgtgggtgtttaggttgtctctaatacatctgctgagaaggcctagaagcaatgacaccccaggagtgacatgcacacgtaaacactatttgccactaaaagtgacaagggctctttagagcaatggctaattccagggctggggtgaggaatgtacaagatcagccagaaagccaggaagtgcccacagcatgatggggacagggtggggatatgatggggaaagtcaaaggacacagtgatccgcctggagaggctcctgctggccacgtctaggacaatttgagcatcaaaaacttgataatgaagacatggaatcaacctaaatgcccatcaatgacagaccagataaagaaaatgtagtacatatgtgctgcggaatattacacagccataaaaaagaaagagatcacgtcttttgagggaacatggatggagctggaggcgatcatccttagcaaactaacacaggaacagaaaaccaagtgctgcatgttctcacttatgagtgggggctaaataataagaacttacgaacacaaagaaagaaacgacaaacactgggggctacttaagaggcagagggtgggaggagggagaggaacggaaaagataactattgggtactgagcctaatacatgatgaaatacgtgggtgatgaaataatatgtacaacagacccccatgacacatctttatctatgtaacaaacattcacatggacccccaaacctaaaataaaaattttttaaaatatttgataatgagaaataacatggcactgaataggatacaaatccatgagtccatagatacatacacacacagggagagaagaaaaacctgttctttaaagtagcattccaaccagtcaatgtagaattcatgataaatttagaaaatcgccttttggtaattactatagtaacaattcaggcaagaaatacatatcaatcctaaaactagcaagtgaaagtttgatgagaaagaagacatttacacaatcccaaagtaggtccccctgaagccctgactggtgacaagggggaaagtaagccctttattaaagtagagaactttatggtggcagacgcccccttcaccaagtgaccggcgtccacttcaccggaaaggtgtcgcggccgcatcgggtgaccctgctgggatgcagaagcccagggcagcccacggatgggtgggtgcccacctgagggcggaggctggctctgatggtgaggaaatgtcgaagggcaggtgacacaagaactggccgttgtcctcctgaaaagtgctcaggtcgtgacagatgagacaggactgaggagctgttccagatgaagagactgaagagaaaggacaacgaaacaaaacgcgtggctggaggtctcctcttccaagaaatgacgcccctgagacaaggcacaaaatgtgaatgaagcctgcagcttagctgatagcatgatatttgtgctgatttcctgattttgacaattatactgtggttaggagaatgaccctgtttttatgaaacatccactgaaatatttaggggtaaagggatatgatgtctgcaaattcctctcaggggttcagaattcatataaacacacagtgagagatcgtgagaaatgagatatgggcagatctggtgaaatgctaacatcgggcaatctgggtgaaaaggatatgagaactctttgtattatttttgtgactttatgtttgaaattgtcaaaataaaatgttatttattatttaataattgtttttttagagacagagtctcaccatgttgctcaggctggtctcgaactcctgggctcaagtgatccactaccttggcctcccaaagtgctggaattacaagcgtgagccacctcgcccagccctaaagtgttattttaaaaaaggaattaagaaatacaggctgagcagtggcttgtgcctatgatcccagcactttgggaggtcaaggcaggaggatcgcttaagcccaggtgtttgagaccagcctgggcaacatggcaaaaccccatctctacaaaatatttaaaaattagccgggcatgatggtgcacacctgtagtcgcagctactcaggaggttggggtaggagaatcgcttgagttgcagtgaactgtgatcgcaccactgcactccagcctgagaggcagagcaagaccgcatctcgaaaaaaagaaaaagagctacagtgggcctgtgtgttaagtaagagcatgtgttagtgctgccttttactgtctccgaaggtgggagcatcaccaaagcaggccctgagagaactagaggactctaactcgctgagggcaaggagattcttccgggaatttttcgttggcttctcccaaataataacagcctggacacaggatgtgcaggccagccctggctggggacgtcttccaggctggcgccagagggcgctgtccccagggaccacacgggatgccaggccacataactctgcaatgtgttggctgaacttttcaggaaacttggatgccgcacatacttttcctttctttgtgggcaggcaagatgagtcacgtttttctggagtctgctcagccccagtattcagacctcatcagctgccctggtccggaaggctccagctgtggccagtgagcggggggcccagggtgcccgcgttggctgggccagcactggggcttaggggcagacttgggcaagccagagtcaatcttttttgtcgggtacagggtaaagctcacagtaattctggatcatggcaacatctggggacagacccagggccctttgtacaactcacagggcacagccctgagggaggctgggctttggcttcatatagtccctgttctcccgcccacccaaccccctccgccgcacctgactccccaccacctctccaggccctaacttcgagtacctcactctccagcacttcgagctgcacctcactccccagcacttctccaggccctaccttcgcggtcccctcagttcccctgcctcccttccttccgaaggccactgtggtattggaaagttggagcagcgacctgaaggaagggaccccacctgtgtctatctgcaggaagggtcgctgcaggctctctgagaggcaggctctgggatggaaatgagcatgttggatgtacatcagggagtgctcttgggcctgacaaaggggcgatggagaccccgtgaagccccgacagagagttctgaagcccggatgccccttcagagctgtcctgagcgggggtcgggggctggtcctttatgtacatcggccggttattgggcgtaggccggctctgggaggggctgaaggctggcgaggtggtgctccttagctgagggccatctgtctgtcacacccacagctgggagtgagttcctcattcttgaaggaatcgggaatctgggaggcacggcacagcacagcctcaagggtgttctggctccagggtgttttctagcagagggcctaggggacatgctcagcatctcagggtgtttcaggcagagggcctaggggacatgagcctgagcagaggaagacagggggtgggtgtgcacaagacacagtcagagccagcccagggtgacctcagaggacctcagaggccatgtgtggtggggcttggagttttcatttaaatgtgctggggcggcgtcaaggggttgaacaggggatgacatgatgggatttatgttttaaaaacaggagttggcaaattactacccaatggcccaatcctgctggccacctgcttttataaatacttattggaacacagctgcaccattagtttatactttgtctatggcttcgtagttgcaaaagagaccacgtggccttcgaagtctaagacatttaccatctggctttttacaggaaacatttgtcaactgctgtttgaagagactcctctccttgctgggcagagtcatttccaaggcagcaaggggactctcacgggggccacggcccctcacgagccttcccagtttcaccccggtgcctaaagcaactcactttagcagttgctcgtgttctttggtattaatgatataaatcacctgtgcacaccatgaggttcctccaggaggctgcggggccctcccaggtggaagtggagaaaagtcctcagtgtctctacctgtgcgcaaacacaaatacttccactgccctctcccgcctcctctcccatcccccattggtctcctcctcttctcaggcctctccccctggaccaccagtgatgccggcagccacaggtccctctgcccccaaagcaggtctcgcctctgcaccatcggtacagtcccacaggcccctgtggcctccctgaaagtgaggagtaaaatgactcacgtacaggtcatgtgagcaatgccccaggaacacacaccacacacgtgactgcaacgaaggaagtgtgggttccttttaacgtaggagccaccagagcttccccaggaacctctctgcctctgaggcaccaaaggtttcctgtccttgcaatgctgggagggaccctagatggatttgtgggtgcatctcgggcaccccgctcagcacatggctcaggcacacgcaacgactcagtggtgcctccaggcgagcgggtacctgcgctgctctcatgctcaatcctcacccctactctgcctggatgcaggggctgacctctgacccctgctgccatgtgtccaggctcccgctgggcaggagacagggagacaccttgggcaacatctgaccatagctacagcccctttggctcccgttcctgccagacagaccaactgcagctcctggttccagccccgccagggctcccagcgccgccctcttcccttctcccacctggggtgggaaaggattttccttactcatcggtgggtcgcttcccaaactctagtctggcgtctcagctctttcctcacctttataaccacgcagccacataatcagaactgtgacgtccgtgtattaaactccatctgcttttagtacggagagtaaccctcttccaggtaggacccgggctgacagctgagctagggccatctgcaggagacgattcagacggggtcagcgctgcgattcgggggagtaaccagcggtgagcttcaggcctaaatgctggagtcctaaaattactcgagtctgaccccccggtttttggtcttgctctatatttagggacaatggccctattgatgctcactcgctgaaccactgcctggcgtttgttctgcggggcaagctggagtggggtgctcctcagccccgggagcccttgggatggaaatgcaagactcagaggctctaaattaaagtcttaaaagcttgggctcattcctccacacaaagcacaaaacctttggcattttatgggaaaacagacttttatttgaaaaataaactcaagttgctgggatataaaggaagagctgtctgtgatccaacgctgaaatggtgtgaaaggacctgaagttttacaagttaaataaacttctctgaaagactcattcgaatttcaaacagctcccagcacagatcctctgaaaaagatccccagatgcagcaggatgagacacagtgcccgctccagggtgggggtcaaccatgtggaatgggagattcggattcaaccacaaacagagaaaattaaattccttttggatgttcaaaatacacatgacctcggtcataattgtgagctagtcttggaaacggacagggggaaaatctaccattccacatctctggcagaaacccgggacttacttccatccagcggatcctctgtgccctaagaaccccccaaaccagactcgcctcaaaggcgttccagacgcattctgctgttctctgaccatctagggtggtgttttccaaactgcaaccactgcccccgccaccccatcatgaaatcaaccgtgtgggtcagataaagcagctgaaacaatagaatcgaaaataaagtacctagtcagggtcaatattgcttcgtaaaagggcttttgttgatgtgttgtatgtgctggattatgccatcagatggatttgttactgtgggctgcagtcaaaacgttttcaaaccactgctgcgatgaagccctgcggctccgctttaccatctcagtgctgtaaatcttccccgggtgtcagagtatattctccaccttttgctttgtgcttgtccctaccagacaccatggtcatcacctagagtagccttcggtgtaatcaaagtaggtggctgtctaggccagtgattttcaactcttttttttttttctagtaggacaaagataatgtcccaatgtccagcagggctgatcctgtcagtagcagttactgggtgtgccctgctgcccccatcagacaagatgccatttcttgctccgtgggggccagctggccaaaggccaccttgtctcactccctaaaagctaccactgcatgattttagggttctgggaagacagtcgcttccaaaaagagaatctgtggcatctggttttgatgctaggaattctttctttgttatgagataaatgtgtcaactacccctgaactatgtcacctttaagttctataatgtctattttaaatatttttgccagaactgtttccatctgagggaggagggaaaaggataaaggcatgttgagctctaggagctgggagcccacagaaaggaaaacagagcagggagatccaaggtccccagagacatggtgttcttcccatgttgggtgaccatcagtgtaccccaaaggttccaaaccccgaaggcactgatagacctggggggatgaggaggtatgaactggaagagcttgggaaaataagaggcaagtgcatgaaaagctcaatatgtgatttttaaagagacaagaaggcaataggaagttatcacgagagaacacagactgcaaagagacttaaaataacagctatatttcagggctctggcagattgctcaaggcaaacagaatccagtaaggctttctgtagcgggcaagacttgaaggaggtctctgaggaggcgggagaccatgctaatgtatctccagatccactgcagggacccctcactgctcaccccagccctgtctctaccatctctttactgcacagtagccagacatctctctgcattgcatccgatcgacatccgatggctttctgtatcgctcaattaaaacctggaatcctgacctctcctgcaaggccccgccccactccctgacctcactccagcacctgctccctccctacttggttctggccacattgaccagctccctgcaggctcagaggctgctcctgcctccggacatttgcatcgtgggcccctccgccaggcgtgccatggcctccacctgtcctctccctggctccatctcaccactggccaaatgtctccatgtcagaggctattgctgacttgcccacatagagcagcacccccgcagcccctctcctttgactgttgttcctcttggcacttgggacacatgacacttttccacctgtggtaccgattgtccctagaatggtatccccacgagggcagggatgggctcattcactgctgcgttcccaagggcccagcacttagcaggttctcatgtaacgtggtgcaggtgaatatcctccatgccagacaactcccctttgaaacgcctgggcaggcaggtatccttgtccgctcctaacaccagctttcttctgtctgggaggcgcatttgaaggtgaaccgcactggaaaaaacccaggcaggaacgatacctgctgctttcccccaggcaggaccaacctgctcccagcaccagactcagcatgtgaggctatgtcaccccctagtggtcactctgtcacaaagccagaaaaaccagaggtgggctccgcctggccagctgttctcagggccaaggggaccccgacctactctctcacccagactttttctacgagtgaactcagatgtaaacagacattcagaaaataaaggtgaaaaggcatctaatattgaggccacattgtcttgaatgagggagagatttaacatcgacattcttccttctagtacgggctccaggctgagcggctgtcccaagatgtggactgtggtggggtagcaccaagtcattcctacagagtttctctgttcattgcagattatgtgggaatttatcaaagattagccttttctttttttaaaaaaggaagctgagatgggaggcaggccagagagaacctaggagaagtgaatatacagcaggcagagcccagacctgagcagctgggtctcccagaagcctgtctccatcagcctgctttgcttccttacttctttgagagagagctgggtgtttgtttattgtttttgaaacagagtcttgctctgttcccaggctagagtgcaatggcaggatctcggctcactgcaacctctgctgcccaagttcaagtgattctcctgtctcagcctcctgagtagctgggattacaggcacccaccatgcccggctaatttttgtatttttagtagagacggggcttcaccatgttggccaggctggtctcgaactcattatctcaggtgatccgcccacctcggcctggcctcccaaagtgctgggattacaggcatgagccactgcacccagctgagagagttttttaaaagctggggactgccctacagcatgaggcttttgctaatgtgcacttagcatttcctctgccccagacctctgagtggctctctctctggctccagtgtggtctccttaccagagaagacttccctcgccattccatccaaagcagcacccaccccactacccactctctcgctctgctttcctttccttgacaacgtgggggcagttaaagtctatctgtgctcccgtgccccatccctcctccagccctctgtctggaagattccaggctagctctgccagcttggccatgattgccttcagccaaacagcgcaccttgtccatagctcccctggggcaaggagatgtgtcaggataaagttaggatggcttcgtggcatgaacagaaaaaaataactgaaaggaggctaagccacaaggatgcttatcacctacaataacgaacagttagtaggtaggcagttgcaaagcaggtcagcttagcgaaactgcctttgcaaaagtatcactgttaggagaaatctgacatagctgattccatattgcttctgacctccaagtgtccttggtcattcctgggcacacacaggccaagctaattttgggagaaatttagtttatagtttaaactacatacagtttaaagcaaggatgatactagcccttccccaaactaaaacaccattgcaaaactaatgagaggccgcaaggttaggattgagagaggcctgaattctgctaagatgtaggtgtagttaaatgacaaccagccattgtcccgaggtcacaagatttgtaacttccccaattactcctgtagataacatcactattagagaacctaagattggccttttgagatgtctttccagacttctgcatttctggcaaccaatttgacctcacctggactcctgactcaccacccaaccagtcctgtggccccacccagaggaggagtcagtgtcattttccacacccctctgaaggcatcccaactaatcagctgcacccattccctagtccctgcccgccaaactatccatgaaaactgctaacctctgagccttcaggtagactgacttgatttgatagataactgtcctgcatggcatgaccggactcatgtcagttaactctttctttactgtgacgccgtggtctcagtggattgagtttccctgtacaagaggcggaaggacccatcgggcaatgacattggtgctgccaactgcgtggagaatcacctgcccacctttccactcagccaccttgtgccttgacctttgtcctcatggccctagaaaccatgtccccagaccacagtcaaaggaagaaaaggaaatttatccccgtgtgtcttttttgttgttgttaggggacgcacgtttttcttaaatccctagccgacttctcccattcactggcatgtgggaaggggatacttctgactgaactagaccaactgcagctcatggcctggggccatgccctgagttaaaccaggttctgctatgaagaaacaagaggcagccactgtccgatgggttagcacagtctgctgcgcacctcagcgaggaacaaactgtgcacatggacaaatgtgatggacttagcgggagaaggggcccaggacaggtggggagaagacgagaggaaggccctgcatggtagccgagggcagcaggatcccctacacgcatctccagggtgggaaatgactttccgcagtaggcaggcaactgttgcaagaatgagcccaatggaggaaggaggcttggctatctcacagtattgacacacgtactcacacacatatgttaattcttacatatacgacgtatacgtaagcttaaggagcaggtaggcaggcacaagaagcctagctgtggcctactgggagcctctaaagggagccaccactgagaggcagtgtcagttctgtgaggatgggggctaggaaggctggcatgggcaggtcagctattcatgggagcaaaatacaggggtttggtggaaaagaggcaaactatgccaagcatcctctgtgtttggggcagactagcccacgcacatcgaccagcacctctgagctgtgtgccgtagaacaagccacttgccttttgccaggatgagcagctgccttgcaggattgccatgtgttcagaattggactcaaaccccactgaagctcactgctaaacactgaggggtgggggacacaagagaggtccatctgcaaccctaagaagcatcctttacagagcagacggcacattcagacacatgcccacagcgcggctccctgactgatggctggctgggataagggcaggtctgtgaggacaagcagcctcatcaagaccatggggacaaacaggaggcgtcccccaaagcaaataagccagcagcctgagcaggacaaaagccagcactagagatgggcagggctcccgagtcgtgacagctctgtccctgctccctctaccggctcctcccctctcagcctgcacgtgcttctcccaccttacaaagaaccaactgaaaacgtccattaaactgaatccatcccctcgctaccagctcgccttaattgtcgggtgggctcggaagtgccacagtaagaattaagcgccagaatctaagctgagcccctaaaaaggccacacacagtcagacgcagccaaggcaggtctcacgctaaggcgggtctcctgctgtcctgctccctcctcacctctgtgtctctgcctccagccatcccggcacagagtcgagcacacgggttgctcttgatgtcttgggtgggaagtgacgcctgtcctctctctttggtgaaaccccatcatgtggtcccaccctgaccgcaggggtgggctgggagaggcagaggagctcctggctcttgcacaagcaccaagctcctggcacagatgcatccacctgcgcttctgaccccagggccttgaaggaagttcgctggctcctcagccactgccccacacgctttccttcccttcctggctactgaagctgctctcttggaaatcaccaatgacctgccaagtccaaagcctggccggacctccagggctgatcgtcccctctcttgagggactcttctgggcctctgtgacccatatgcctccttggcctctttcatggaccctgggcctctgccctccctcgtgtgccagccatacccagctgtctgtctccagatgccgtgcctggtctggctgatgccgtccagggctatagctgctgcctgtgtcacctgacgagccctaacacccatttgcagctgacagtgccctgagcccaggctccccttggagcttgcaggcccggaaacccgcaagctctggacagaacatgcagcctcactgctttcctccttgtgcgtctctacaggagttggtgtctaaaagggacaaaggcacactccaggtggagaggggcacaaatgaagttaaaaccaagttagacagggctgggacgggcagacagcctggcagaggagggaggcagtgtttgcgcaggtggacggggtgtgaattggggggtgaggttggccctgatctggcaagcagtttgagttttctgaagtctctagcaagggaatgacataataaaagtggtgatggaaacatctgtgcagcagccgctttgacagatctgcaatcacagctctaatggccacaggggacacttcaggccactgccctgggccaaagccagagcgcagcccagcccaggagagtgatggagagaccagcgctccagaagggagaaaggctgtccagagacccagaggttggcgcccttccttggatgctttttcattttgctatttgtcctttaagctaacaaacactcaactccagctctgatttgctgacacctgagctgagggcctagggacctgctacccccgcccagtactttctgactgtccacccccagtgccaagagctctccacctgtcagacgacccagggagagcggggaagtgcctagaggcatcccaggactgcgatggctacaccacgagtgctgtcaactccttagttcatgagtcctaccagaagcccggagacctcatgacctattcacactgtcctgcctcccacccaaccatgctcccaggagcaagtgggtcaggggcagagccaggaggtgggggcagtgtcaggatggtcagggtttggtcccaggacgtgggggcagggccagcaggtgggggtaaggcctcaaggttgtagagagacagggactccttccccatctgtgaagcatggggaggctgcagtggggactccaaggtaacacacctgccctctgcctcactgaaaacaacagaagatcatggctgagaggccgagcatcctgtctgctgtgtggccatagctttcctggacatttgctgtgtctgttctctggctgctgtctatggccaggggggcttaagcaatgggatttatcccttcacagttctggaggctgggagcctaagtcaaggtgtgtgtgagcccgcagtccatctgtattagtccgttctcacactgctagaaggaactacctgaaactgggtaacttatgcagaaaaaaagtttaattgactcacagttctgtaggctctacaggaagcatggctggggaggcctcaggaaacttacaatcatggcagaaggtgaagaggaagcaggcacgtcttacatggcatcaggaaggaaagagtgaaggggaagtgctacacacttttcaacaaccagatctcgtgagaactcattcactatcgccagaatagcaatgggaagtctgcccctacgattcaatcacctcccaccaggcccctcctccaacatgtggggattacaattcaacaggagattcgggtggtaacaagaagccaaaccatatcaccatctgaaacctgggggagccctttctgccctgcagcttcagggatcacaggcaccagggcatccccgtctcagctccaccagctccctgggtctccgtcatcactgggccttcttttaaggacaccagtcattctggactgagggcccacatgaatgacctcatcttaaataattacacctgccatgaccctatttccaagtcaggtcacattctgaggtcctgggggtcaggacttccacaaaccatttttgccgggaacatcatacaacccttaacagttactataggattaaatgaaatcctacagtgtattttaaaactctatctaattgcacctgaaataaattcttcatcttgtctaattccccaattagccctggcctgataacttgattttcattcctgtgtgacccctggcactcctgacccactaacctgatgctgatgatggcatcatgtgtctggattggggaccttcctaacgttgacaggtgattcatctgataatggttttgagtggctattgtgtgcagatcctactcaggtattatagtatctccaggaactgtaataaacagcaatttcagactcaattcatctcctttatctgtgacactgtgtgaatgggaacacaatggaccaaaagaacactcagcccatgccaaaatctcccaaaggacacagaggtgtcactgtaacttctcacatatgcgctgcacgaggactcggctgggctgcagatctgaaacctttgttcttccaacttcacttacagcagtaaagcccatttatcaaaatctatttcctttaaatgatggtaggaacggggaagaagtgaggtgggggagaaacttacaggaagagtcttgtcaaaaggagacattttggagtcaacaatggtaggtgggaggttggtgggaagtgaagctcaaacacagttcactcaacaacctgtactcagtaacaacagacatgttcatctcactaaaaaggagaaaaccaaaggcgaggcgcccagatcgtggataagtcccaggagagagtaaaagcagagtgctgagaccagctatcaccctgatttggaacactggctcaggccactttagaaagggggactggggatgacctatgcccaggcactagtgtgtttcaagaaaaaggtgtcagaggactgcaagttcacagacacctgaagacagtggggtctgctactgtgtgggaggctccctctcatttatccgtcaaggcccgctaaagtgtctccatttatcacaacacctctccgagccagtccggcctaccactaactcatctttctccaactctgtccgtacctacggcctgtgttgttccattcagcacatcaatcgtggagaaggcaggacatatccattccttgatagtcctatgtcatgggttgaattgtgtccctccaaaagtcacatgttgaaatcctaactcacagcacctccaaacgtgacctcatgtggaagtagggtcattgaagatgtggttagctgagatgagggttatactggagtcagagggtcccgtagtccaatagggatagtctccttagaaaaaggggaaatttgaacacagagacatgtgcatggaaaaacctctgtgaagatgaaggcggagactgggggctgtgcttccaagccaaggaatggcagtgatgaccagcacagaccaggagaaagaacagacgcatggaacagaccccctcacagcctcagaaggagccggccctgcccacaccctgattccagacttccagcctcttgagataataaactcccgttttgttttattttgttaaagatggggtctcactctgtcaccgaggctggagtgcagtggcctgatctcagcttgctgcaatctctgcctcccgggttcaagcgattctcctgcctcagcctcccgagtaactgggattacaggcatctgccaccatgtgcggctagtttttgtatttttagtagagatggggttttaccatgttggccaggctggcctcaaactcctgacctcaagtgattggcccgacttggccttccaaagtgctgggattacaggcgtgagccaccatgcccagccaacttctgttgtttaatgcacgcagtttgtggtgctgttatagtggccctaccaaatgaatacacctgtcatgatttgtagtcatccacactcgcttagatatcagtgcatgtgagtgaggctcaaagagtaccagctaattgttaaatcctgtggcaagtcactctgtgacgtgagtcattactcactgacttttttgaaaccaaatgtttctgtcttagacctgctcaaaggaagaactggccaaaagctctggttcctcttattctgattatggagccagagttaagtgctgctgcccagagattctcatttctccacagcctcctttttctctcagccattttcctctagaagcagagcctgaggcaaggattaagatcaaggtgaggtagggcaggagaagcagcaatgaaatgagttgtcatgctggctgctgatgcatgacaagctgcaaataataacataataatcagaataaagagcaggggagcttagaaagcatgttcacttggctcatgggactcctccaggagggttctagaaaggaactatatgtggggggatccatagccatcatcaaggaggaggtttctgcccagcttcctcaaagccacagttcctactggtcaagtattactctgtggagagctaaactcccccaaacttctaggctgtatcatgcagccccttgtcatcattcatgaggccaaacttcctgcccaaattttaggatattcttgaggtaaggggaatacgcctgcaatgaccccaccaaaaccccattagcaacggcaaagcttaaataaatcagaagcttcatcaataaagtttagaactcttgttcttcaagatctctcttcctattctttctttctttctttttttttctggagatagagtctcactctattgcccaggctggagtgcactagcacgatcctggctcactgcagcctctgtctcctgagttcaagcgatcctcctgcctcagcctcccttagtagctcggattacaggcacatgccatcatacctggctaatttttatatttttagtagagacagggtttcgccatgttggccaggctgctcttgaactcctgggctcaagtgatctgcccacctcagcctcccaaagggctgagattgtaggcgtgagccactgcacctggccagtcttcaagatttttccaaacagaccaagaaggctgcagttggtgccaggactaagtcaatggacaaggacagcccgtgcctgaagaaacagcgactctgtagccttgctctttcttcccatcctgggccactgtgtcatgattcttacccactcctaatccaatccccacttgcaagacctcaacagacttggagttctaatgcactgtggccttcctgtccccctgagatgctccaaagctccatggagggtgtccccccagtgcagggagcaatgatgctatctggttttaccaaagggctgtgtcagctgtgctgggcaggcagctttctacagtgttttactgcatttaagagtcacaagaagaaactaacccaggcagaaaggctgtgaacaaacctcagtcaagcaaagaagagaagacaagtgaaagtaaacatcaaagaaaatggcccaggaactttgaatgcagttgatgctgtggttgtagactgcgctgggttagacagtgcccccactaattcatttcctttccagaacctcagaaggtgaccttatttggcaacagagtcattgcagatgtagtcacttaagttgaggtcgcagtggagtagggtgggctcttaatctcctttgactgctgtcactttaagaaaagaaaaagagacagacacacacagaggaaggccacaggatgatgaaggcagaggctgaagttacgcatctacgagccaaggaaccccagggtttgtgggcaactgccagaagctaggagggaggcctggaacagagccctcccagagccttcagagggagcatggtcctgctgacaccctgattccaacttccagcctccagaattgtgggaacaggaatccgggcagcttaggccatgcagcctgtggtgcctgtgtgacagcccctgaaactaacctgtgggccatgaaggcacggatgctgcagccgcatctggggaggtgtggcggaaacacgaggtgggcaggtggcactgcttgcggggctggggtgctgggctgacatggccgagggtgcacccccaccccatagagtgggcacctaacctgctggccccagagtgcgtgtgtccactgctagggaccacggaggccaaattcagtaccttttgagaaataaagctaaaattctaagcccctaaccaactgaaagaaccccctcttggccacggggaccccagaaaaaccttaaaactgagttcccggccataatgggatgagaggtcggatgtgcctcattacaccccctcccttgctaaccaccattaggcttccttccccaagggttaaatggaaacctgcccttttgaaagacttgctccattcctgagatcaaccagctgtctgatgctgccccttccttttgcaggttcgacacaaccgaccagcattccttcctgataagagacccctgaccatggagtggctctgactagcctatggaggctgcacacagacagtcttcgcatccttggcttcaccctctgacatatagggcctactgtaatccatttaaaggttaagtctccaccccagcgtgaacatggatgcatgctgcacacaattagccaattatgcatgtctatgcttcctctttgtgaatattcatagctcctcctataacctgttgaatatgtacatttggccacgctgttcagcataaatccctgtcttccactctcgcagtgcctgtttccagcatctggctagagactatgcttcccagcctgtcagaatggtgacctgctggctgcagcctttttaaagaagtgatcctttccaaatgtaggaaccttatcattcttcaactgacactttgctggtcactgagcaaggtgtgctgggaggagtgagggctctgaggtctcgcaggttttctggggagcttgattcttatggagtgacctacaaatagcacatgtattgaaaacacatcaaccagtctcagagcagccctgtctcttgggttttaggagttcgacctggagctgtaggggggtgagatagaaagtggcctccctcctggagaacccagtgaacaaaccaccatgccccacgccccatccccgactttagcattaagcgttgcagaggctgagaagtaggggttccagccacggttgggtcttgtgttgaccattttccagtgcaaccacaggctccctaagattcaagcagcactgtgggcttatgacctcacacatttaccattgcagaaattatgccaaagcatgatcaaattatctgcccacaatgtataggttgcttacaaaaataaccagccctcctctgttccttacttcaggctctaagatctgcctgatttctactactgtaagaacatagaaagtaatctcattacatgcatgatttttaccctatcttcattccagctatgttattctttatgcttttcccttagctaaaatttcgatttccgctttacatttttggcattttaaaataaaacattatatcacttctatcagcaccacgtttcttgtctttccaagtctgctgatgctttcaaaatccccacgtcccaaactcagcaccattaaattggagtgaggctggtggtggaatgggaggtgggtgcttagggattattccacttcctcctttcctcctgcactctgttccaaagccagagagctccgtgtccttttgctgtatctgaacaactgtgggaggaatcattttgtatgcatgcagtacacacaatgccatctttcctagaagtctcaggctctggggtatatatcaatatcacctgaggagcctgttaaaactttcgattccaagactcaggccattgagtcattcgcttcactggtttgtaaatatctttgtacattagggatattagtcctccatcaattcatcatctccttctggtctagcacgtgtttttcacgtttatattgttgttttgtttcattttctatttggagtgggaagctgtatggaagtggtcatcttgatgtcatcaatgataattgcctctgtcccttcacagtttctggacccggtcgggcttacatatgacccactgaaatccctgggtcagtatagccatcatcttgtattcagaagcatcagcccacattttagaaagcattgaaaaacaagttaagttgttggtgaattaatttcaaacaatttgctcagtgccttcaggcgccattctagaccctgagaaagctttgaataaaacagaattcctgtcctcagacagtttacactctggtggggagagacaggcaagtgaaccagtaaatagacagtatatcctgtggggaatcagtagtgtagatgcctgcaaggagattgctactactttacccagggtgtcaaaggaaggcctttctactaaggtgagtcctttcaggaaatctgaagaggtgtctggagaggctgcctgggagccagcggtgtgcttatattcccaacacacataatgcccctttcagggggtcatctcttctatccctctcccaccatcctacacagcacaagaactgggcttcaatctctggtatgacgctcccaaactctccaaaatcttctccaaccaaaactcaccttctagaatcttcccttcactcacctggacccccgttatgcatttctctcttagacattcttcattctttctaacaggaatgcatccagctctcctctacctcatcaatatagcaaagctctgagaatcaagcctgcaaactttgagagaaggcaagaaaggctgtggatatttatatcacaaacaaacatattttttgcaccttctagaaaggcctgacatcccaagatttagatattcaaatgttttggaggtacattacttaaaacacttaaagtttagttccacacggaaattattttggtgtgaccaagagccaggtgtggtggttcacacctaaatcccagcactttgggaggctgaggtgggaggatcgcttgagtacaggagcttgagactagcctgggcaatacactgagacccaatttctacaaaaagttaaaaaattaaccaggcatggtggtgtgcatctgcagttccacctattgcgggcaaagggcaggaggatcgcttgagcctgggaagttgaggctctgcagtgattctgccactgtactctggcctggatgacagagaccctgtctctaaatgaatgaaagaaagaaagaaagaaagaaagaaagaaagaaagaaagagagagagagagagagagagagagagagggagggagggagggagggagggagggagggagggagggagggaagggaagggaagggaagggaaggaaggaaaggaaggaaagaagggaagaaaggaaggaaggaagggaagcaaggaaggaaggaaggaaggaaagaaagaaggaaagaaagaaaggaaagaaaggaaggaaagaaaggaaaggaaagaaagaaggaaagaaagaaagaaagagaaagaaagagagagaaatgaccaaggagccacttttatctattttttcgtaaatggctagctggctatcccattattggtttatagatccctaagatctattccattaaagcagagtctcagcacctggactaaaagtggacttcggagttcaaccacctgacttcacattttggctttaccacttggtagctgtgtggcctttgttccacaacttaagccctcgtgcctcagtttctagtttggtaaacattgtacaaatagaagagttgctatgaagattgaaagaattacatacaatgcacttagaacacacacagacttttataaggagcaaaatttagcaacacgacattagatcattctggaggtcctgccttgctgactgtgtaagattctttttgcttttttaaaagactttaatcttattattggcagttcatgaacacacagacatgcactttcctttcctcatctccaaaggcaagatcaccctaaaccaacttgcaaaatcttttgaagctaaagattcactgttctggaagctcctgcagccactcagccacgtaataattcttgtggcacaaggtcagccaggtaaacatttcaggctttgtaggccatggggtctctgttgcacctgctcagttctgctgttgaagtgtggaagcggcaggagaggaacacacagatgggcgtgactgtgtctccatgacagctttgtttacaaaaagaggtggcacgccagattttgtcccggggctgattttgtcatttgctgactgctgcattagagggagagacggaaaagtggggcattgttttggttggggtgtttgactctgatcatcaaagggaagtaggtttgatattccatggtggctaggagtatgatgagaacgccagccacactacgaatcctcacgctactgtacctctgaccagaggcaaatgttagtgaaagactacggcaactccatacaggcagcctctgagaggtaagatccttccagaagaaaggtctggttctcttccctgggcaaaaaacaccagccagcctaggtacttgctggtcccaagatcagctgtggaatccagaaccatggtccccatctgtgttccccctcctgtcttagagtgtcttagaagattgaattacctctttttcctttttcatttctccctctgaaatgacagtgatcataattttcatcttcctgctttctttccccttaataatataaaacagtgtttatcggccaggcacagtggctcacacctgtaatcccagcactttgggaggctgaggcagatggatcacttgatgtgaggagtttgagaccagcctggccaacatggcgaaaccctgtctctactaaaaatacaaaaattagccaggtgtggtggcgggcgcctgtaatcccagctacacaggaggctgaggcatgagaatcgcttgaacccaggaggtggaggttgcagtgagccgagatctcgccattgcactccagcctggtgacagagtgagactccatttcaaaaaaacaaaaaagaaaaagaaagaaaacagtgcttatcaagctctggtgtatatcagtattacctgaggagcctgtcaacactttagattctatgtttgtcatgtaggccataaattataggacagaaagatgagatgcaaatagaacatgaggagaagtgggcattaccttgagacagaagactcagaaaacaggggatcatagccacatcctccttaatgtcaaggctggatgtgaggctgcatcgccctccatgggggaagcagcttacacaattgtatgtaggctcgttgggccacgtgtgatgagggcatccttgcgtgcatgcacacatgctggccaaggagggtgggatgccacagtcccctttggattgccaactggacctcttatcctggaacttcccgccctacctcctggttcttggtcattctgtttctcctgcgtgatcctaccccccaccccgccctgattgattcagggatcctaactgggctaatcagatatcctgcgacaaggcatttaggacagtaaatggagagagacacagactaggacttctctggatctcttggaaagatccacgaattcttgctgctgaggcctcagggccagtctggttccttcccttcctgagtcctgagggttcagctctttttggaattccgtaaatgcccccaaatccttccaacacattgtttgcttgttaaaaaagtggtcgtgtgaatataaaagaagagggacgaaaactggattcagaaaggctggaaatgtatcccttaatgccttttgtccagatttggttcaaaggcttctagcagccagtgcagacagaggaaatgcgctattacacgattaatgtctgctagagacaaaagcagtcccgttgatcagaagttcagctattcttggtaccaagaccagacagcaagttcctcccaggggccttgtgtaatgaacgaagtcttcatgacatccctccagtggacacagtggctttcacggggctgtttcttcccaagaccctccagatgggccgatggcattactcacaggctcaatttcatgaagttagttctagggcagtgggggagcaatctacagtctgggaaccctgatccaggaatagatttcaagtacggagaaaagcagacagattttgcctcctccaggccagcctcatgccaggcacaaatgaacggccatctggaaggagctcagggtgacctcccagtcaagtaacaccacagcacagagacctggagcttcgtgccttatcagccatagggctcggggagggatggcttctttcagggaaagccaaggagctggcctcactgattctcaagggcaccaacatgagcaattgccctggggaccaggcttgctctgttctgaactccccatcccagggggcttctctgaagaagccatgcccccaccccaacctaatcaatccttgcccttgtgagtagctgagagccatgtcatagccttcctgagcccggcccctggctgtctaccccgatggtgtaaccgggctgtaacaggctctgccttctccatagtacctgacaagccagaagagtgaacctggggattttctaccaaggacattgaagggccttggaaatactcaacagaaaaaggcagccgaaaggagccaggagtcaggcctgtcttcagtggccaacgtcccaccatgtccaccaacaataaagagctgcagtgcctgactccctgtgtcccaagggagggcccaggccccgggtacacacgggccccagcaggcagccccaggtcccgctcccttcgcagctgtctgcacttctgccataggaaaaaagcaattcacaggctcactgagctcacagaccacactcaggcctggaggaaggcgcagatggcaggcccagccggggcagtgcaggcaccctaggtgaggaagcagcagttttaagtttctggaatgagaggtagctgaggggctcatataccccagtgtgtggattaggggcacaggggtgtggagctatgagtggactgtgggcccctacccagcaatgaggccttcaggtacattgcagaggatgatcaggggcctcacagtctctgcttctgagccccagcctcatccccaggaccccttgggtgctggacactgccggggtgaggcctcccgaaggtacagcccccacattcctcagcccgcagctggagctcctgcagtacaggagatgggttgggggactcactctctgactccacctgcctgtctcggcccctggctttaaggaaagggtggaggggagtctgggagcttcctcctgtgcagaccacaggccccaatggaaggggccatggccaggttcagcatgggccccgaggtctagctcttcactgcggcagcaccccatgtggacaccagcagagtcatccccaggcctgtgcctgcgttccctcactgtgagcacagtgtctgctgggacccgctgagatccagaggggctgggagtcttggatccacctctgatagaggttgagtgtttcttccccgctctcaggttgaaattggatccccggtgttggaggtggggccccgtgggaggtgtttgggtcctgggggcagatgcctcatgaatggctgggttgcctccctgcggcagtgagtcctgctctcttagctgggtgctttaaagactccagtacctcccccctctctcttgctcccttgcgtgtgagctctgcataccccggctttccttcgccttcctccatgagtggaagcagcctgaagcccttgcaaacaccttggcagagatcacgacagcaggagaaggtccagcctggcccactccatcctgcatccagcctcacaggctggctggctttgctcattacctgggcggaggccaagctaacaaagggaggaatttagtttatagtttaatttgaaagcaaggatgataatagtacctccctgaaaccaactgttccttgctcagggactgaaaaccagctttgtgagatgaatgaaagaccacagattaggattatgggaggggcctgaaccgggctaacatgcaggtgtagtttctatgatctcgtactgctctggggtcatggagccagaggtcacaagacttgcaacttccccagttgctcctgtagatagtatcactatttaacacctaagattggtcttttgagataattttttagacttgaattctggcaaccaatggaccccacccagacccatgactcatgactcagctgaccctgtggccctcacctagaggccgactcagtgctggaggcccgtttccacaccactgtgatctcatccccaaccaatcagcagtgcccgttccctagccccctgcccatcaaattgtccataaaaaccctaagctctgagcctttggggagactgatttgagtgatagctccatctcccatgtggctggcctcacattaaacattttactacaataccaagatctcggtgaattggttttatctgtgcagtgggcatgaggctcccactggatggctgtgccctccccagaagcagatgctggcaccatgcctctgtgcagcctgcagaaccatgagccaaataaacctcttccctttataaatgacccagcctcaggtactcctttatagcaatgcaaaatggagcaacaccgcctcccatcctggacctccacactcagccatctgtaggttctccccatgccttctccaagccctgctacatcccagcattccccagctagcccttaaggctgagcacggggccttggctgtccccaggcattcctggtggctcaactctttcttctgctgttaccaacacccgcaacttctgttccacatctcgccaccgccccaaagctcaggtctgggagcttgacatttttttcaagatgtattcatttttaattaccaataagtgaagctagtctcaaaaaattggaatatcagataaagcaacattttccttccacccatccactcctaattcttcacttagaagctaccactagcagtccaatgcatgtccttttaaaaaataaaaaaggtatatatgtgtgtacacacatacatatatgcacatacatacacacatacatctatacaaatccaaaacacacacacacacacccatatatgctgtgttcaaattattatatgcatatgctttcttcccccataaatgctttccttacagtcccttctagctttgattatctgtctgtctgcaattctgtcagttactgaaagaaaacagttgaaagagattgaaaatctaaacataaataacaatgaaagatagtgaaaaggaggaatactttaagaaattgatatggtttcaaaaagagatttttccagacccagtttctaaaagaacagctcatttcccaggctgaacagtggacagcaccaaacctcccaccaaatgctgtactgagctgcagcctaggccctgaggactgaacaacttctcctgcacctcctggtgccactgctgggctcccaaagggaccctctgcctgcagggaccctcctcctcctctccccgctcctccctctcaccctctcctcccacccccatggagggctctgtgcaggagaatgatgtagagggaggcggagggtgatggttcctgccagagcttcaagaccttcccatgggagccagctcacagctcctacactcctttgggcacccttccgatcatcaggttccctgtgctgctctccgccccgctcagaaagcctgccctgtcctaactgagcacaggcagtaccatggagacaatctcgtcctttcttctgaagcctgcttgcctctgactaggagcccttgaaggcaggaatcctgtcttttcatccaccaattccagcacattcaatctacacaacatcgcaagttccccaacaaggcaaactgcgcacacatcctccttctctttgacaaatcccacctgtgtgacgtggagccctcacgcagctttcccatcaggacgggcctgatttccttcctctgtacagcactttgatccctcatctctagacgatgtttatacaaggagatggggaaagaaaggggcaccttaaggctaaagtgcacaaacttaaaggaaattgtgacaaccccacagccttgagtgaggggtgtgtgtagagcatggtcaggacctgccccccacaacacacacacaacccacaggcgggagcaccttcatttgttttatgtagaaagacgaagtgcaaaatctgtccaagagatagatctgctccactcacacagaatacggccaccatcccctccacctccaaggtggtggatgaagtagtgaggctgacagagacctggcttctcgtcctacagccactgctgcctgatggaagagttcgaagtcagaaacaccgaaattcccctcttgctgccgcctggccttgcagatataaagcgttgctctaacacacagtattgccagtctttctgagtaaaagtcagcctggagagaaaggtgaactatcccaggcctctgatggtcaaggacaaatttgttttccacatcactatcttccccaatacaaatgttctaagtcagtagaaagaactggaaagaatagacaaaggaaaggagaaagtaaacgccataaactttctagttcgtggtatatttcatattatcatcgacggcgctcaaatgaaaataccttatcctcagatcacaaacactaatgaacctacggaactctttcttaaacactcacatttcctccttccatttccccagcaaatccctcctagcttccattccctgctgcccagagccccaaacagaaaaagttaggatttgccagaaacaggtgtagtcaaaccctcaaataccaaaccacagagagtggaagccatatcaggctgaccaaagcagtatggtcccgtggccccgggtgagggcctaagcttggctccatgcctgcagtttccagagaaggctggaggcaagtgtgtcatctgattgtccatacaagctgtactgtgagtatcaggatgtttacagttaacccaaggaccttgctggaccagaaggattacgctttgatagattagcatgggaagaaagtgacaggtggaaactgatgttctggagagagatttgtttagggggaagtgggggtggggagaaacagatacaggcactcagcaccaagctgctcacagccacctggcagcttcggtgccaccgtggatgtgtggctgcagaagagacccccagcaccccagcacccacctgaaacaatagcatcaaggtcttactttttctggagcgggagaaaaacctgatgcccccgggcgaggtagcagggttggagttgggggaagactctttggaggaggagcggaagatcccactgaagctcatgcgtcgaggggagcgtggcggggactcctggtaggagaacgggaacacggttttgggagagccggggctggtcttgggcctcacaggtgcagacatggggctggagggccggggctgggggcctctggagaagaaccctttggaggggctgcccgggccgaaggggctgtccacctgcagaaaaacagacgaatggatgcagtcactccacgctctggacacgctgcctcctgccctgtatgaaacttatcattgtcctctctcacatgcgggccccccatagtaccctcccagagaaacagccctaagctcttccacagaggtagccactgaatggtctgcaggtagcacctgccccaaggatggcccctcacaggctggcagcaccacgtcctggaggtccactgaccatcctgtcccactccttagaaggggcttccaggaggtagaggggaggaagggaagcggagctcaaaatgagcgtctccctcctttattatgggcctgcctgccttcacctctcaagacctcacgtccatccaagttctgaccacacaggactgcagtcctcttgcctgcctataagatccctatgttccagaacagagcgggcctggagctccatcctgagacctcagtcctaggtgatgatgaatttttcacctccaagctgcttcagcatttgaaagactgaggttgccaacagaagtcaggagaaaagttcacaaagccagccgggtacggtgactcacgcctgtaatcccagcattttggaaggccgaggcgggtggatcaactgaggtcaggagtttgaaaccagcctggccaacatggtgaaaccccatctctactaaaaataaaaaaataaaaaaaaaattagctgggcatggtggcgggcgcctgtaatcccagctactcaggaggctgaggcaggagaatctcttgaaccccgaaggcggaggttgcagtgagccgagatggcgccattgcactccagcctgggcaacaaaacgagactccatttcaagagaaaggaaagaaaggaaggaaggaaggaaggaaggaaggaaggaaggaaggaaggagggagggagggagggagggagggagggagggaaggaaagaaggaaggaaggaaggaaggaaggaaggaaggaaggaaggaaggaaagaaagaaggaaagaaggaagttaacaaagccccaaacctctgagactcacttcaccaatgatttaaaattctagtcatggcttaaaaaattatcagaccccataactttaagccaaggcacagagctcatagcagactttgagaaatatctcacgtgcccgcagccgtgttcctgctggatgcgtggaggagctcctgccctgcctctgggtgccggtatttggcccctgctctgccacctgctgagccaacctgggcatgttacttggtctcaccgagcctcagctccctcatctgtaaaatgaggatggccgtgccctcacctcaagggctgcttgaacgtcagatgaagccgcgtgaggccaggaagcacacggtgcgtggtaaacagctcttgtcctaccacttgggaaacttgcaagcaacactgagtggaaaggacctcagagatgacccagttcagaagcaagaagggcgagtaactcgtccgcagcgctcgcggggagccaggaccagggcagacgcgggaaatactgccctcgggcggccgcgctgtgctgaaaagggaacacaggacaccccacaggcagcctcggtgccacttcggggtctctctgtcccaccacggggtgcgctgtccggaccgcggcctggggacgttcttccgccactagagggcggcccaagccccgagcccgcggccccgggaggataggatgcccgtggcgtggacccgcgcagcacagcctccccgcgcggcctctccagccgaaagagccggcgccgccacgtggaggtgtaggtccggcctggcgcggacaccttcgtgagtgggcccggcaggaagaagagtgtggtgctataggaccttgtaactcaagctaagttttgagtttttctttttttgtgtagttctgttttttgtttttgagacagggtctccctctgtcgctcaaggctgcagtgcactggcgcaatctcagctcattgcaacctccacctcccgggctcaagcaatcctcctacctcagcctcctgagtagctgggattacagttgtccatgcccagctgattttttttttttgaccatttaatatgaaaagcatttagattctctgtttatagaatatcccagttagccactattccacctaactatgggaatcaggacaaatcctgagaataaatttacaaacaagagagtcttcaggcagggggtggtgtctcacacctgtaatcccagcactttgggaggccgaggtgggtggatcacctgagctcgaccagcctgggcaacatggcaaaaccctgtctctacaaaaaatacagaaattagccaggtgtggtggcctgtagtcccagctactcaagcagctgaggtgggaggatcacttgagccccagagatggaggtggaggttgcagtgagcaaggtgacactactgtactccagccagcttgggtacagagcaagaccctgtctcaaaaaaaaaaaaaaaaaaaaaaaaaaagaggttcttcttcaagtggtgggtgctgtgtgtgcaggtctagggtgggatgggggctgagagaagccagtaggaacaacacacacaggcaccagggtggtcctatcacaaggtgacataagctggtcctgggtggaggcccgggtttggtcacagctcagtttcccgcaatgtggacaacgacttggttgtccaagcctcgttcccagggctgagacaatcacgacagcagcctcgagggtgtgaaccggaagaggagccgaggccacatgggaggaccggagggaggggtgggattttggagctgctggaaaggtgagcccggacctggtgcatggacgtgctctgtttacagcatagggagcttgctggggagccgggggagagggccgagccaatgcaaatgtccagtcctacagggaaacagagacacataggggagcggggccccaggagagcttgcagagtgcccacaaggccgaagcaccataagcaccatgcagatggataaatggcccggagctgaaacctgccccttaacagaggccctgacccagaggaggccctgacagctggctaggcttcagagacgcagtgacagggccggggaggtgtccagtgcccagagacagaggagaaggggtttgaagcacagagacagagggccggccattcacttgggccaccatgagggtgggggtcacgggggaagttgagccatgagcccctggagaaccagtcatgaaaggccagtttaaccatatttgatgagcaagggggaccccaggattatcctgaatggggttccattctgtattctgaatccaggccagtggagtcgggcatccagggatcaggcctgaggagggagccctaggaagcagccctgccagtcctgtctctggaaaatggccgaagcatgctggatgctgggccctgtctgacccctctcaccgggaaccttgggggccagatcacactcccagacggtgggaaagccaggcggagggacaggcctgctggggtgggctgcgtggcggtgcagataacaggcgccagctgaagccaccagggacagggcctcaggccttgctcttgggcaagctatagccaaatgatatgttggtgaatgcaaccggatgattccccgggtattgacaagactcccaagtgtgtgcctggctccgcagagctaatggagagcaggcattcagccgtctgcggagcagagctctgcctatggggccatttgtcatgcagctgccagagaggaagctggggccagggcctggctgtggcccctgtgtctctcccacactctcagatcttccgtgcaaggttttcactggaaagaagggttttgcagagtcaaacaggaggaagacgacccagtgcccgcggggctggtcccacagccttgcacggggttggtggccccttcctgccactccactctctgctggcccagaagctcaaggccattccctggcagtctttgctggatgggccacgagagctgctaataaggttgcttgttcagggcagggtggggagggcactggcaccagtggagccccacaggccgacaccaatttgattcagttgtgtgtaattcaaatgcttaaagaggagatttgctttttccagcatgggaactcctgccttcatcccaggctagccggcacccagaacccatcccagaccctgtacgtagcccccagatcactagctctgtctgctgtcacctgccggaggggtctgtgggtggcagaatgccaggaagcacgtcccctaccaggcctccacccacccttacttcctggctgcaggagaaacctgcaagcagcctggacctctgcgccctgccacggccacctcgaccctcacctgatgctgtggctccctctccagagccccccaccccaccccacactctttctggccacctgaccctacacagtcaacaacctcctcgagacactagtttcctaatgggagggaaattcaccagtgcaggagggacggcgaggagctaaagagaggaaaggaaaagtggaaagagagaaaaaggcgtgtggagagggtgcaacacgaggtggaaggagagagcccagcgctgggggtgggcgctggtgggcagcagggcaaagtcctgccagtcgaactcagcccaaagaccacagatggtcggcagtgaccgataccttccaccgggcttagctcactgctcatcttcctccactgcctctgcccatgttaggggggtctagtgggccacagtcagtgccacgtgaggagaagaaaaaggggtgaagcccaggaggctctctagtgggatagcccggccgatacgccaggcttggccatgcgaggtgagctgtcgcaggatgggctcggttacggccaggtgtgcaagcggacatgcgggtgggcgtgagggtgaacacacaggtggaagtgggctcaggctctgcctgcctccgtggcacctcaagtgagctgtgagaaacttctggaaaggaggtcttacctttcgagaggaatgctttccggaaccctccaggtctccgtccaggagcggcatggcgaaggagctcaggtcctagggtggacagagagcacgtggtcagtgacagtggccctcgggcccaggggctgcatggaactctacgtgggtgtcacctcccccttcctgagaccttatccttcaaatccaccatgaagaagggatgtggacgtgtttgctacacccagcccccaaagcccctgaccaccatgcacatccgcttccagaacgtgcagtcaaacttccaggagcagccatgacctcccaacaccccagggaaggaggaaagaagaaatggctgggactaaaggagtcaggaaggcaggcagaaagggtggagggaggagagcccgtctcaggctattctgctgatggacatgattttaccccacagcacggaacatgggtccagggacatgtgtctgcctaggaagatgatgggacagggatggggagggtgacactggggtggcggctgaggcaaaactattagcagagtctaatgacatcgtggccaaaacagagtctaaaatagatttggggaaagtagctcaccacacacttactgtgtctgaaacagccctgccccttcttcctcttgaatcttgcctccacaccaggcagaatcctgcccagtcatcctcaaatcgggcacagctgcatccctaacctttctttttcattttaaagtttttagttgtggtaaaatacacataacataaaatttgccatctcaaccattttaagtgtgcggtttggtggcatgaagcacattgacactgctgtgtagccgtcaccactgtcatctctagaacctttccatcttctcaaaccaaaacgctgttcccatcaaacactaactccccctccccctccccctagtgcttggcaaccaccctcctatctctttgaatctgaccactctaggtacctcatataagtagcatcaggcagtatttgtgactgtctgactccacttagcataatgtcttcaaggctcctccaggtggtagtgtgtgccacagttcccttccttttgaaggctgaataatattccattgtatgagtagaccacattccgcttacgcattcatcagttgatggacatttgggttgcttctaccttctgactattgtgaataacgctgctatgagtgttatggtatgaattgtgtctcccttcccaccaaaaaaaatctatatgttgaagtcctgccccccaggacctcagaatgtgactgtatttggagatagggtctttaagcaggcaattaatttaaaatgaggtcattaaggtgggccctagtccaatatgactggtgtccttcaaggaagagattaggacacaggcacctacaagacagagaccacacatagagacacagggagaagacagctaccaacccaaagagaggggccccagaaaaaccaaccctgctgatattttgatcttagacttctagcctccagaatcatgagaaaacatatttctgttgtttaagccaccccacttaatctgtagtgctttgctatggcagcctagcaaaccaatataataggtgtacgaatatctcttcaggaccctgctttcaattctttccagttatccccagaagtggaactgctggacatcaggtcatcctactgtcaattttttgaggagccactaaactgttttctgcagcagccaccccattttactttcccacccacagtacacagggtttcaatttctccacatcctcatcaacacttgttatctttggtctttgttttctgtgacagccatcttaagtgggcgtgagctggtatctcattgtggttttgatttgcatttcttggataattagtgatgttgaatatcttttcatctgcttatcggccacttgtctatcatctttggagaaatgtctattcaggccatttgtctgacttgtttggagaaatgtccattcaggccatttgtctatcttgtttggagaaatgtctattcaactcctttgcccattttttaattgggttgattgtggttgaattgtttatatattctggttattaaccccttatcagatacatgacttgcaaatattttcctccattctgtgggttgcctttttactctgctgtgtcctttgatgtacagaagtctttgatttatctaatttgccttttgttgcctgtgcttttggtgttgtattcaagaaatcactgccaaattcagtgtcatgaagcttttcccgtatgttttcttctaagagttttatattttatggttttagctcttatatttaggtctttgacctatgtaaatttttgtatatggtataaacgtaagggtgcaatttcattcttttacatgtagatagccagttttcccagcactatttgttgaaaagatggtcctttcccagttgaatagtcttggcatgactgtggaacgtcatttgactttatctctgagagtttatttctgggctctccattccattccattggtctatatgtctgtattttatggtagtattacactgttttgattattgtggccttatagtaagtttaaaattgggaaatgtgagacctccaactttgttcttctttttttcaagactattttccctatttagggtcccttaagattccacatgaattttaggatagactaattgttctgtttttggaaaaaaatgccactgggattttgatagggattgcactgaatctatagaccactttgggtagtcctgacctcttaacaatatcgcctcccaatccataaacataggatgtgttttcatttatttgcgtgtcttctttcatttccacctttcatttccttctgtagtgttctgtgcacttaacctttctttaacccattcccttctctccacgtccttgccctgggggtccaggcctacacccactctcacccagttccctcttgggccacctaattattgtccaaattgttcagccttccctgtttggatctgtgctccaagtctctgcttaaagagcaacccctgaaagggtgagcctcatcacgtcagccccctgctaaggccccagccactcgtaccgtcacctcagcaatggcttccaggcctggctgactgagacacgccagtgagatctcagatgtgcagattccagactcagcctttctggtggtgtttatctccaaagttctcagccctggctgcacactgacatcacctggggagcatgggtagagtgcactggcctgcggtacagcgagggcatttggaaattccaccacagaccagatggagagctgcgtgcctcccaaggaggagtctcaggagtctcagacacagtcaggagctcccagccggccctgcaggctgcaacccaagccccatagatgaactgacctccgcagccttatttctgatgttctctgttccggtctcctcctttcagcaacagcccaggcagagggtttgtcattttccaaacacagctatgcatccatggacatcccacctggaatgctgtcttaactcctcagacacttctgttcatggctaccatccacccctcctgtgaactgctctcattttgcttcagccactcagggacagctccagggtcccatccccagcccccagcatgaagcccggcccatagcaatgcaggaatcaccctggtgccattcaccaaacaccccaagccctttccttcctctgagctctctttccttcctcttgctcttcctgctccgtgtccccaaatcctggctcacagagtaaactcctatgtgtcctgcaaagcccaagtcaaacacactctctggctgagagtcaccctcagacagaattaattatctcttattaattatcctagactgtgtcccacagtactttagatacacctttattaccagactgataatcccgtattatactcatctatcagtttatttctctaactagactttgaatccatccctggcaagaggaaagctacccacctctctattcttggcctcatactgtacccggcaggcagcaggttccagatgtgtttgaattaactccccgaccaagcaccctcttgcgcctgcagcaagcatggggccgcagagtctgtgccgctgggccagtgaaccatcaggccacacgcagttgcaattcactaggaagtgacgagggaccagggtgggtctcttatcgcccattttaatgagcacattcctctctggtttcaaattctcattaccctctaacatttgttcagcaccagcagtttccacatgcagaagctttttcacaaatcctcacttgctcctcatgcaaccctaagcagcatcctgctctaacaactgaggccgaggaggttcaaagggactcacgtcaagatggtgtaaaagagctgagggccggatgtgaggcctgctgctagctcaggctgcccgtggaccccaggcggctgcccggagtggtggaggcaggtcccacgcaggtgtctcgggctggagtgagtatgaaagcatcaagtcaagcccaacatcgtggcctgctgcgtggctgctggactcaggtgtgtgtgcctgcctggtcatgcagcccaacagggaagtcccctggcacagatggcaggctttgctggaaggctccccacccccaatcccacctcccagcaagtcccagtattctaatcttggctctcatctccagagctcaccaggaaacatcacgcatcttggggccggtgtgggaaaatctctaactgcaactatggcaactagagtcttggcttgtagaatacttaggacctggtgtctcgggtgacatgccagaaggcccaggctcctggatgtgccccattcccgtgatttctaaatttaaaactcctgccagagctttgggccttccccaccactggtctctactcccagtccagtccctcacttcctcttcccgtctgccggccactcaggccctcacaggactgggaggacatttagggggcaacgctgaggcaccaagagatgctgaagccctgatttccgccaagagacagctttagcactctgattttcatccgctgcacaaaatgtaagtcagaccttgaccacatgtgttggagataaaaaggtgaattttcaggatttggactgataaagtcacctgtcagaaaagcatcaggaccaaagagaaaagccctaaatctgagagaattcctgagatgtaagctgaccttaaaagcaactcattcatccatctcgctgccttagaaatccaggcaaaagccaaaagtctatcacaaaaaaagtgaagtattaacgacagagccaacattaatctgacattagtatgtccttctgaaatctcccaactgttgcctcatttggtccttacagcaacccacacaagtaggaaagacaagtggtatcatccccgactatagatgaagatactgagggtcagagaggttaagtcatttgcccaatgccagagaatcagacagtagcaagcatgtcctgtaaccaggtccacctgctcctagctcagaactctttctatgaaactttaccacctccttggagtggttcagttccagtaatagaaaaacaatttggtatcagaggctataaaaagagagcttttcttcctaaaacaagtatccttggcacagtgtgacctcaggggaaggaaggaaggatacataaggatttgtatagtcctgtgattcattccccaggcaacttaccatactaactttctcttcaagttcttcttaactaaaagtaactcaagctggtgttgcaaggaacaggaaagtctaaaaaatcccaccaccaaatgcaatcacttcacattcttgcactatccacatttggagtcacatacagctcctcctgcccccggcccgctacttatcccaatatttccccataggataatagactttctaatgtttgcaatcaactaatttgtgtattcttgaaggatgggggcagttttactcacatcttagccctgacagcaggtgctaagtgtatatcgatcagatgcagttccgaccttccagcgtttctgatgttttgtcttacagagctcctttgttgatgcagctgggataccccagaaagaagacagacaagagtgcaaatacaggacaaatagaaaggctgccagtagcaggggcccacgatggcccccacctcagggcaaactcgaggtttacaatatcagggtcacgatacaacattcctgtttgattccaaccgaggaagcaacacatcgagaatgatttgcattctccgctcctgctgagcggaccccagcacagagagcaccatctggagctgctgggccttgcgtccgccgaggccagggcccctcccggccatattcaagcccccgtgtccctcaggcccacaagaacacagcctgcagcagggagggagccgggggctgagccggagccccagctctgtgatctgcgatctggggaatcttggacatatccggacttcagtttttcatctgtcaaatgagagggttgaactagagaacctgtgaagatgccttgtagctcgcacgttctctgtttttacccactgaagcggacaacaataggcgagatcaggaacattgtaaaggactcccattagactcagaataagatgcatgttctcatctcctatcttcatcatcaaaataatttcctcctactctcaaacgaccaaagactctccactgctctcagagccacagggtgtttggacggagtctcggggcgtgcaccgccggggaaggaaggagcttcctctgccttcacaacgctatctaggtgagacggccaggacccagcagcatttctgcctttccatcttaacctgtgtcttgatacgcttcttaggttctaacccttaaggtttctcaactgattgttcagctccctcaatcctaagggcctgggctgtgggatccagcaccaggcgggttctatcagacgcccagtgaccccgggaaagctgcgtgtggcatctccagctacaggcccgaggcccgcggttcccacctggaccccgtcctgcccaccttgcctgccctcagtcactgcccggggagtggctcataggttctgaccacggctgagtggtgactgtggcctggatctcgccccaagtggtgacggccttggcaggcccctctgctgggaggcacgggggaggtgcctctggacaggccggccttgcgcaatccccaaaaccaccaaacgggcaattcttggtactgatgggcggcaggaggtgaccagagccaggtcaattggagcctttgaaaaacattcatgttatataaccactctcagaaaaataaggaacaaatattgaatcactggaaccaggcagcaggggagggccagtggccaaatccgggaaggcctaagctccactctcagagaagttccagagccatttactttccacagaggacaccgtagtttctcactacagcctaagcaacttcctgatgtcaaaagaaacatccaactgtttttcactcctatggccacccttcctccctggctccctcacctggtggtcctggttcccacaaccgcctcggggctccccttccccgccccccaaggccaaggaccctggcctggcagcctgagcctcccctggctttgaggaagtcccctgctccaccgtattcccagttcctcgtctggcccgaggccacccggggcttccctagctccatatcagcaccagacatgaaactctttttgctcaaaaccaagtagctgcagaatccctggcccggagtgcccaggagacctcgaccctccccgcagttctgcattcacgtcttatgtggagcacgccctttaaaatccaggaacctccactttccagtgtgtaaaaggaggccatcatccttcttatcacgggctggtgggaaacgagaccagaggacgtcatcaaaggcccttcccgcggtgtgagcccccgtggcactgggcatggcgagggccgctggccgagggcacactggggcctgatgatgaaggctgtggggagcaacaaaggcatcatcaccagggcagccaggcccctcatgcggctcccgcggaagccagggcagttgctcacactcaaccaaggcctgagatcgggtttcagaggcttctgcaaagacactggctgtcccccttataattagagagctgtctttatcccgttcccaaggtgaaagccaagatgattcatgacttgtgcacggcagttctaaagaggatcacagcatggccgctgccagagtctccggctctgtcctcgtgcaaagggcagccgagcctttccttgcccactccgggcagcctttacttgaccagagctccatggaagcttggagggaccccactggcctcctcacgttgtggtggaggatgctctgcaggggccaacagtgcctcttctgaccagctgggggtggccatcctgaccgtcctgacctcaggggcttgtgctgtgggattcctgagagccccttcctagttcagggccccagggcagcctcttacaggcagctgctcccaggccaggttgagtccagcctctgctcatcacacatgcttgtcttcttccagcctgtctgagatcccccagaaggagggagagtggggggcaggggcagcacctagagggacaggttgggtggaggctacaggagtctgggtcagctcccagttcatgaggaaggaggcaagtacctgggaggccccgggacatgcaggttggggggcgcatttgcatggtctgtgcagccgtctcctcgaggaccagcagcaggcagcctcccagctcccttccaagggtgtggcctgggctgcaggttgccgcctccatccggagtagctgcggtcttcacaggtggcactgcgggccccagccagggggcaggggaggggatgttatgggacagggagcgctgggctccactgaccacatcccatcgtggagtcagtaacggttaatttgatgtgtcagcctggcgaggccatagcacccactgattcaatcaaataccaagcaggtggctgccgtgggcgtatttgcagacgtggatgacatctacagtcagtgacttgaagtgaagcagatcatgctgaatgatgtgggtgggcctcccccaatccgcagcaggcctgaagagggaaaacagagggttctggaaggggaaattctgcttcatgattgcagcatcgactgcctgagcttctagtccgtctgcccagtggattcgggactttccagttccgaccaacgcatgagtcaattctttcaaacaaatctcatatatatatatatatatatatatatatatatatatatatatatcacgataatatgtatatgtaatcatgttatatacattatatagagttaatatattatgtgattatatctcaatatacatattaagaaaaatatgtatattaaggagatataatcacataatatattaacttaatatattttcttagtatacatatattaagaaaaataggagatctatatgcttggatctctagtcttggttctccttctctgcagacccctcctaacacagagccctaggccccctcacccgagctggtggggacagacatggggagagtccagggtaaaagcaggccgctgtttggaagctctcagccttcgctgcatagacggatgggtctgctcagtcatcgggtgggctctccgcccacactgtggctctctgtccacactatggaaccctcactttgcccagggcccagtgagacacccacaggccccagctggacgagaggacaaagacggatgtgaagggccgttgtcctggcagtgcttagagaacaacaggaaatggccaaatgtcctcctttgactgtcagggaacattcacagtacgtgaagggcaatcacaggtttagaaaagcaccacgatcacctcctagcctcgtctctgagccttggcagcagagtggggcaatcctcttgccttcgcacgctgggtaacagtcgtgcaagtgtctgtcatggcatcttgtcaccctgtcctgtcactgagggcctgtctcctgccacacccagttggagctcggcaaggaccgcgtctttttcacccctgagtcaccggctcctcccagggctggattccatgagcctctgtccttccccttcgcagagctgacacggggagagtggtcataagctggggcgtaaatgactgaggacggcccgggggccagtaaacaccaagacctcgggataagggaatgacatcctgatgcgccacctccagcccctgtacggagggaacagcccttcatttctaggactgtcttcagctctgacattatgattctaccaagacagggtgtgaaaaggccagctctggggttctggggaggttttattggctcgcaaataaaatgccaaaccaccagccaataccagcatagagccctccgtgggcactaccgactcaagggaaaggccccgaggccccacacccggcccggccagccagctgcagacacaccctccagtcatcggccacccagacttcagagaggaaaaaaccagccacgaggtgaaagtgagatggccccggcctgacctctgctgcagaggcccaaatggccctggtcagatctgacgcttcccccacagtcagcttcttgccaccccccccaccccccaccgccgcctggtgctccccaccgggtacacacccagcggttttggttagtgcttgaagacaaactgcaggagggacaccatgaactacaataaaattgggcaccctggggacatttttgtaaggtcaccgagttgctggctggctctgagacacaccctcctctacgtagaggaccttgtgtgagagaggacacctctgaacgagggctcagagacctcatttctgctcccaaacagctacccaagatgtggctttgggctttggcccagagctgaggcctgcaaaggctgccacctcagtgcttccagaatctcaactgtccatatttacagagccatacatcaaaagattcttccccaacactttctacgggtacccaaggactccttctactccatcttgtttcacccacctgctctgtgccaggcacattatagatcaaaaggtacagggagttcagaggaaggaggaaataccatggacttaaaaagcaagccagggcttcccaagccaagcatagtgaatagaggagctttcatttgtctcctcacttccatcccggggtgagccggccactcccgcagcatctggccacggctcttcacactgacagtcccaacttgtcagtggattatgaaatcaatttagtggattgcacaaccaccaaaaactgaattacaataagaatgtatctcatggttgcatgaagcctgtgtctcaatgattcacacacacatagaataaaatgtactttgtttgtttgtttgttttttcccctgagacagagtcttgctctgtcatccaggctggaatgcaatggcacaatctcggctcactgcaacctccgcctcctgggttcaagtgattctcctgcctcagcctctgagtagctgagattacaggcgcccgccaccacgcctggctaatttttgtatatttagtagagatggggtttcaccatgttggccaggctggtctcaaactcctgacctcatgatccacctactttggcctcccaaagtgttgtgattagaggtgtgagctaccgtgtccggcctgtttttttgtttgttcgttttttgttttttgagatggagtctcactctgtcgcccaggctggagtgtagtagcgcaatcttggctcacttcaacctccgcctcccgggttcaagcgattctcatgcctcagtctcccaagtagctgggattacaggtgtgagccaccacgcccggctaatttttctatttttagtagagatggcgttttcccatgttgtccaggctggtcttgaactcctgggctcaagggatatacctgccttggcctcccagagtgttgagattacaggcatgagccgctgtacccagcctgaataaaatgtacttcctattgtgttgtgggtgaaaaagtctgaaaaattctgcattagataagctttgaaatcatgcaggtagatttcagggaacagagaagagctgaccttctgtccccgaggtgtcaccagaagtgtggagcaaggggtaccatctgtcctcctctcctggctgaagccctctgacccctctccgtactttatgcccagaaatacacatggagttaagaacacagaacatcacatctctttattaccacaagggtgtggtgattccctccctcctcacctctcaccaccacccccatctgctcctcccctggccctttgacatgcagggtagcttggcctcatccccaggccaccgctagacccagaacagcaattacacctttggggacaaccaccagccccagccccctgccgagcggtgcctgtcagcttctgttcccaactggcccgggcctgctgcgggtgccctcacctctagcgcctaaacccagagaactgggcagtcacagggtgttaggatggaaatggcctcagaaattctccaaggcccttctgttacaggtggggtaacagatgtccagagattcaagcaagttgctcagagccacatggtagagccgtgactcagccagaaccaaatcctggtcttgcaacttctaaccaaggtcccttttgatcatgtcatgctcttatagctgcttctgactttctagcttgtgtttccactacataagctggtaacagtaactcttacaggattgcaacgggctggccatccctcgcacgggcctggctatactgggcacatagcaaatgttctaattctatgaagccacttgggttctgcgggcacctttgcatcttgtctccagcgacagcacaaagcccgtgctccaactccctttctggtgtcatttattgtacatgaatctgtgacttccccagagcccttcagtctgtgatcccagccacgcaggcggcagccgctccaggaacttcccaggaaccatggaacctgtcgtgtcctccagactgacgggcgcggacactctgcatggaggggctccagatgccaccggccagcatctagcatctagccagcagcgatgcataaagaccagccaggtcaggagaaggtgtctgctactccccattccaggccacaccgccagggccacgctgcaggcagctaccagataggacatgaaggtgcctgggaggtatgccgccccctccagaacctcacaccggccaaaatccctcacgggtgggctaacaacactcacaacaaccacactgctagctcttttaaaattttactttttagtctttttataagtttaattcttgtttaaaaagataaattgaacctctaccccctcagtgaggcaggcctggatctagatttctgcctaaccagctgtgtcatttgaaagtcgcctcacgggccgggtgcggtggctcatgcctgtaatcccagcactttgggaggccgaggtgggcggatcatgaggtcaggagatcgagaccatcctggctaacatggtgaaaccctgtctctactaaaaaatacaaaaaattagccaggtgtggtggcgggcacctgtagtccaagctactcgggaggctgaggcaggagaatggcgtgaacccgggaggcggagcttgcagtgagctgagatcacgccactgcactccagcctgggcgacagagcgagactctgtctcaaaaaaaaaaaaaaaaagaaagtcgcctcccatctctggtcgtcagtttcctcctctgagacaggaggtgtctagactcaacccctccagctcctccaaggccttcccaaaacaaattctgttccaggccatcccacctcccagcaccgcaatgacactcctccttcgaacacatccaggtgggccccagggccacgctggtcactgccacctggtgggtacagcctgtgttcaggccccaaggcatgagcagttccaggacagaggcaggacaaccaccaaaggatgtgatggcagccagggcttgggtgagggagggagggaagggcaggtggtgcacaggggatttctagggcggtggaaccgctctgcatgagagtgtaatagtggacacacaacatcacacacacgacatcacacatttgtcaaaacccacagaatgtacaccaccaagagtgagccctaatgtcagctatggacttcggttaacaataaggtatcaacagaagctcaatggtaacagaggtgccacagtaatgccagacgcagacaacaggggagattggcatgggggctgcagggtcagggaggggcagatgggcaccctctgaactttccgcttcaggttctgtaaacctaaaactgctcacaagtaaaatccactaaatttttaaaaagcaatagcagcaaatggccagagatggcctcaatttcatctgccaaacaactgcccatcacgccaggcctggaccacccacccagctcctcagagatgctggaggtcataggttccccaggaaatgggaactggagaggtcaattcttcctgtatccacggctccaggtccttctagaacacagagaaaggtgcatgccatgctcccaggctcagggtcagaagattagtgggatccagtctgaggctcagcgctcagaccaagaagataaatgagaccagagacactcagagattaaataccttgctggggctgggcagcaaggaagctgggagaagggtctgagaacccaggtccccatctctcaggcccaggcccttggcccccaggctggggcaatgaggaccaagtacagagggctccagatggaggccagggaccagctgcaggcaccaggcagcctcagaatgtctggagctgggggacccctcacagggctcgctgggcagctggttcatcggggagactacgtggtgcagaaaagcttgagtttcttggttggggactcaaggctgcaaaccacggcgctaatgaacctaaacaagggaatttgctaggttttcttatttttggtgttttgttgccaacaaactcattctgttctagaggggcttgttatataaggaggagagggaagaaaactgctgagatgtgaggccaaagtcaccagaggaggagagacttccagatcagctgctgcgccagctgggagtcaggtacaaaaaacagggggttgtttgcgtctttgttttttcaaacaagaaaaagcaaaaagcctgcatcgcatgtcctaggaatggggttaaaagtcgtcgtctcttgggacagagtttggacgcctctgtgagcagggcctggtcactgaggtgtccctgactcgtgtcctgtgtgcaggatggagtctccatgcagcccaagcctctctgcagggcctggtggctgctgagaggcagaaggaaacccctccctgagtgtggcctctgcgtgtgtcacctacacctgtcagaagggtttgggatctttctttctcatggagaaagtgcagaagattctgggtcaggccctgtgggacatccctagagccagaggaccgtcccctttgtgtagtttgtccctggcattgccagtgcttctggtttcactcttggttctcagcagtggatcctagaagccccctggatcatgaacttctgccctttgcactcatgaggcccagggacacctccctctgcttgtgcaacacgaggctgccacgtctcaggtcttcgtgcccaaagtgagtggactctgaccttccaggatggccgagggtgccaacgtttcccaaagatctgttttcagactaatctgggagacagcctttggagaggtccgtgaagaagaaaggggaactccacaggtggaggggaaaccgaagctacctgagggatactccccacggcccacctggccccctcttagtctgcactgccctattttcatggcttaaagggcagaatcaaaagatcacagtaggtcagttctccccaggctatctgtgtgcccagcctagagaaaggaatgaacattgaacagggacctgctggctgaaaccttcagtggttgcttcctgcctgcagaaggtgtcggactctgcctggcattcagtgcaccccaggacacagccctggcctcagcctctcctttctcccacaccgctcttctgcagcagccacctgacctacacgctgtcctgggacaccctctactcctctttaatccccccgtgccagcattcctcaaaaaagggggctcaggactcccacaaggttaaagttatcatagacatatatatgatatatatataagcaatatgatatatatatatatttttttttttttgagacagggtctcgctctgttgctcaggctggagcgcagtggtgtgatctcagctcactgcaaccttcacctcctgggttcaagtgattctcctgcctcagcctccagagtagctgggattacaggtatgtaccaccatgcccagctaatttttgtatttttagtagagatggggtttcaccatgttggccaggttggtctcgaactcctgacctcaagggatctgcctgcctcagccttccaaagttctgggattatggatgtgagccactgtgcctgacctagataagtgattttaaaggtaatagctggggagccggaattccttgattctgatgatttgcgattaaaacactttgtataggaatttaaggcgatctttatcatattggggttcaaggacagccatcagtaagaaattttctcccttcaaagggaggcttgttacaaaatttgagcagcagtggctcacaccattccttcctacctcgagtgtcctgaccctttttctctcacccatttatatcctactcattcttcaaaaactagctgattcccacaaatttacaccaacttttctgagcagtccagttgaaaatgatatcctactccattgcattttaatgcctaagaatttaaaatcagtcacgtattacccatttgctatttacatataaattgtatctctgtatagattgtgaggactctgagagcaacggctatattatccagcttgtttttttttttttaagaagtaaattcatccagcttggccaacatggtgaaatcccatctctactaaatatacaaaaattagctgggcatggtggtgggcgcctatagtcccagcaactcaggaggctgaggcaggagaatcatttgaacctgggaggcagaggttgcagtgagttgagatcgcgccactgcactccagactgggcagcagtgcgagactatgtctcaaaaaaaaaaaaaaaaaaagtaaattaataggattcaaaagtcaaaacataacaacctgtaattgaagagtcatacccttggcccagccatgccatgtccccagaggaaccacttttagttgcgtagacagctagggttgctttatgcaaatgcaaatatgaaggctgttccctgtctcttatctgttttgctcgtgtcttactgcctcgcctatctgggagatctttcaatatcagcacgtagggatttgggggtatccacgtcatatgcttttgtctggaatgctctagtttaaccagtcccctgtaggtgacgcaggctgctttcaatctttggcaattacagagaattaatacaataaaaacttggtccatacttcatatttccagcataagttcccagaagtgtggctgctgcttgcaggtcagtgcatttattatttctgccacgtgcagacagggggaagggccccttataaaaccaacagatctcgtgagaactcactatcacagaacagcatgggggaaaccacccccatgattgaattacctccacctgctctctcccttgacatgtgggaattacaattcaagaggagatttgggtggggacacggatgtcaccacgagccctcctcagcattggacagtttgctctcctaactatgatgtaggagagtctatttcccgcactgactcaccaacaggctattttgttcaacacctggacttttgctgggttggtaagacgtggcatctgtgtaacccaaattgacatttgttttctttattccgtggtgttccatcgcggcacagagtcggcacttgaggtggcatcctgtggaactgcttctcaaactgcacgtaggacataggtcataaaatccactcaggacacacaggttttgttgcggctgctgttcatagaacaaaaccagagctccaggagttttctgggatgtctatatccaataggtcatgatgtgaagttcctcgccgtggctcactgtcaaagtctgaaagccgctgcggaagtggctcaacgcatggcaggcacaggggctccatggggtaagtagcccacaggacagccactaggaatgtggtccctccctgcatacatgtgctgtctcctgttgagtgggcgaatctgttcctccatccttgagttggggcagctgtgctcaacagaaatgcagcagaaaccacaccacctgacttctgggttaggtgagaaggaacctcgcagttcctcctggatctcttgtaatgtctgccgcgggtgaaaccagctgccacgttaggaatctgcaccaagaccaccatgttatgaggaagctcaagccagccacgtggagaggctgcacggatggagaaacagctgcacggccagccccagggagtgatgtgagagtgaaggagcctctaggatgtgccaggctcagctgccacctgacttttcaaataggaggaacccccagtgagaactcagctgagccagatgactcctaaatccatgaaagatgatttcaaatcatatttttaagttttggggtggtttgttatgtagcaataggtgatcttgtgactatgtaaccctgggaaagttacttcatttctctgttttttaatctaaaaactgggaatcatgggagttcctactggaaaatgagttaacatatagaagtatagaaccacatatgagttaacaaagacatggctgtgatgcctgggactcatttggaaaacatgagttatcactttaaaatgcttcactgagtttagaggcaatatactatgattactgaacccagggacactacagattcttccttctcagagctttgatgagaggaaagaggcagattccaccttaccttcaggtttgccaagatccttccccaacgtacaagtgaaagggagctcaggaaggcagaatgaagggacacatcaaatccttggtgacaaagtttaggacaggctgggcacagtggctcacgcctatagtccaagcattttgggaggccaaggcaggctgatcacctgaggtcaggagttctagaccagcctggccaaacctgtctctactaaaaatacaaaaattagctgggcgtggtggtggccgcctgtagtcccagctactcaggaggctgaagcaggagaatcgcttgaacccgggaagcggaggttgcagtgagccaggatcccaccactgcaccccagcttgggcgacagagcgagactccgtctcaacaactatgacaacaacaaacagtttgggacagagaaaaatccctgtaaacttcaagccttttggggtgctcttgggtgaactcctaaattgctcaagggctaacttcctcatttattattaaaagaaaaaagaaaaaggcagaggccagtggtgaaggctggcgatttctggtctagggtgagagataacagaaagtaacaatggaggctctcgcagtgctcgcaggcactcaaggaacggaaaggaaattgcacatttcacccgtgactgcataggcaaacgagaacagcaagtctctgctttcagctggaatgttatcaacttcggtcacgctgattatctcaggctgatcaggaaggctggtaccaggagtgagtgactaaatgaagaaattactaattaacaaatgcttgggtggacaatccttcaaaatttaggatcaatgggaggagacagaaggagtcttgggaggatttttaaaatatgccagagctggctgggtacagtggctcacacctgtaacctgaggactttgaggtggagacgggcagaccacctgagctcaggagctcaagaccagcctgggcaacatggcaaaaccctgtctctactaacactataaaaagttagctgggcgtgttggtgcatgctgtagtcccagctactcaggaggctgagccacgagaatcgcttgaacctgggagatggaggttgaagtgagccaagatcgcaccattgcactccagcctggggaaaaaaaaaagccaggcctcctaatgtactcatttaaacatcacttgtgtccacctgggttcagaattgcgctggacatgggatacacaaaggtaagacatggacccaccctcaagtctgaaggtggaggtggggaagggcagaggctgtaaagggtcagagggaccttgtggagtggtggaaatgttccagatcacactgtggcggtggtcacatgactgtgcacacttacgacaacccatctaattgtatactgtcagtcaaagggcattatatgtaaatcacacctcaataaagctgaccaaaaagtggccagtcagccaccagcagacccatgggataggggaagaaaaacaagcaatctacagaacgtgggaaaatgcctatattaagaatcctggaatactccatgtgctttttcatgcagcgggagtggaattttcaggaagcagctgtgctgtgggtgacggtcatactttattctctaaaactctccagtttcaattggcctcttggtgccaaagcaccatggcgtgttacacctatcagatcgggcacactgccccttcttcccaacctacgagctgaaatggccagcactgcgccttccagaacccagcgtagatgcacagctgccacggaggtaggaagaatgattcgtttgccaccaaaagcccagtttctccaacaggtaagtcccagcagggtgcgatgtcccaaacctacacaaccgtttccactgcctattcccgggcccctcacttgggtcaaggcagcatttcagaggaagccaggagcgagaactcgtgcatccgaacccttctctgacttggcgggttattggattagctactctcagaagacccaaaaggcataggggagagaagagataaatctggatgcggtggagacaacggccaaacagaaaaaccgcttggagaataaaagtcgggggaagcctgtagtggggacgctagactcaagggaaggctctggaggaaggaagaggctaaaggcatagtttcgtaacccctccctacaaactaccccctttccctctgcccaagtgagcacagggaccgccccgcagcaagacgacggcagatatttaaaatgtgaggaaccccggccacagcgggcggggctccccacccatcacctagtgtcctcactcactgcactccagactttgtcaaagtggtggcagctgagtccagcaccagagattggtgatgctcgggttgatttcattgtcaagtgcatctggcaggactctagtttgtcgacagtattccagacaaggtgtagctggctgaaccgcagtgcctcggcatttgggaccattgaaaaatactctggattctttttttttcttttgcaattgcacaaggatttacttatctctcttcatgggtgaaactgatttggggggaaactgctagactcaatgaccagttggactgtaggcaagaaggcccatgattttgttcctcagataaaagagcagcagggaaacaggaggcctctctcctgcaaagctggtccaaagtgcacacaaggcatggctgagcgcctggtgatgcacagtcagcagacgggcgagacccaggaacgtgtactgtaacaagagagtctagtgcaggttgttgggggggcttgaggctatccgctgacatcttttctccccagtcaggagacagtaggggagatggttctcatagatcaagtcgggctttgagaaggaaggtgaacaggagaaaaaaaaaaatagaggcctcagaaagcccctccctcccaagtctctcctcacaggcgaaccacgacagatggctgcgcggcctgagggccggcctccaggcagccagggaggagcagctgcaagtcctgcagtctgtgagacccccgaagggtctgggccagcatccaaggctaaagccttggctatcctaacgccgcagtggggcacttaaagctcctcacgcccaagcccaggcctggtgggagcacggttctctcccgcgctccccctcctccccactccacggccacccttccttccaatcgtccccctggagttcgtgttggaagatgccagtgagcacgtctcagggctctacgccttgcacggatgagtatggggtgactcagagggaaggggtggtggcagatgcctgcagctggctcccagccaggtttggccatcctgcgtaaatgcctgccttgggtcttggcctaatactaagggcaaatcccaagaggggtgagtgggcttctggaatctgagcaattctgctttcaaaacaggtgaatccctaggccagcccggccccttcccacacacccctaccccgagacgggtgcagaatcagcagcggggatcatccagagactctcgcagtccacggcaggtgtcggagtgggcctcattccagagttgtggtggccgctccacctggcgagcttcgaggggactccggcaggcgctcgctgtggggtcctcccaccagtcttctcagcacaggaacggtgccttcacattggtcttccggggcttaaaagcatatcattcctgcttgctcttcagatgcaaactccccctccaaggatacctccaggttccctgccagctcacttgactcacatggcaatggtcaccgggctgcctgagcccaaatcaagcaccgtttattagggggaagctccgttatccagaaagctcatctttgaagagctacccatttcctgccaaagttgtggcgggaaggccttaggtactagaaaaccttggggaatggcaattaaaggattatcattcttacttatttgtttggataagcagcaatcacccttcggatgcttattggtgagaatatttctaaaagtgtcctgcacatttccctgctttgatgaatggaacggcagggcaggatttaactgtctgatggctacggttttgggaaagtgccagaacctccacgtcagccaccccagagccacaggcagggtatgagccacagcaatgggccccaagaaagagccccacacccaccatggtccacggaagacgctgcttactggccccgggttacctggagtcatgtgcattctccttacatcaagtgaagataatattttgtttccttcccactttttctctaacacaagccaccccagttctcccttctgacaacaggcaagtggaccctagtagaccttccagaaaagccttagagagcacccccaaatgctcacatttgtcagctgtaattccaccctcagttaaaacctgattctcaatgtgacttggccaacgcagcttgcaaagcaagaacgtcttcatctaaggttgaaaacatcagttgtttgggttgtgagaaaagaaaagcccacaaggtttccgaggcttggtgctgtttctcactgtcctcagctcctgattctgcagctggttctctctccaagcactagcaaaaccctgccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacctaagtctggctttgcttttcttctgctctctccctacctcccctgggtcagagcacagggggagaggtgcacggggcaccgagaaggaaatttacgatcgaggaagaccatacggacatgcccagtgaccttcagaaggtggcagtagcagaaccaccatgggaccccaggtggcggagagggcagaccctgtccatgtgtgacaggtggggcagaaccaccagctaggacaggtgggattggaagaacaaaggaacgacagggaccctgcagaacccacagccctctcgcctcagtcgcctgatgaatagtcaaagtgctaagacctggagaattccatcaaaaactcagttgctcccactgctttggaaggtgttctgctgggctctgccaggacaggccacggctgacggctcacctgaagagagggacctgctatttatgaagcatctattatgtgctggcagctgccccttactcctgcaaggcaggtactgtctccattcttagaagaaaaatcaggctcaggagaaggaaataatttgcccgtggtagccagggggtgaacagcagaatgctctgccaggcccaggccacgaggcctctggggtgaagaaggaacaccccccagttcttgggcatcaggtgcttgtgattccattctatttttctcttaactcataattcagtaattgaggctagagctttgccatctcacattaaacccttttaggactccagggccttaactcacacttgtgggaaggatgtttggttcaggccaatgaaaggcttggctggaaagcccacaaagctgacaggtgtgcagggctgatgacaggtcagtgcactgtcccactggtgccgggctgctgaggcttcaggacaagcctgcccactaggaagggagggaaggtattgagccttgaacgagccacttacctgtaggtccaacctaggtttcctgctacgtcaccagcccccaacaagagctaaaggtaggttttcactaccggacattcaccatgtggctcataagtacagttggagggacaactttggagttgtccgagggcccgagtttgagctctagtttgccatttactggttatgcaatctcagtaaattattcaaattcatggagcctcaatttccttgtgtaaaagggaaatctcccaggatcatcatgaaaattataataattaacattcatgaaactgccacacatggtgccagatgcctaataatcaatcaatcaatatttaccaaaatatgcaatacagacagctaacagcagtgtaagaggtaacgtagagacagatccttctaagaaattaagacccctacctgactgcattaggagtcatcaattgaatctaccgacaagaattgaacacaatttaatacaaagtaatgcataaaacaaaagtacaggcattcaccttcattaggcctgggctgagtctgagaggaggtaagggggtttgttagaagggggtgtggtgagactggtctgtggggcatctctggggaggagagacctgaatacttttaaaggaagaaaaagatctatagtttgaaagagcgctgtgaaggagttggataaatccaagatggattccattagttaacagctgagctgaaagaagaacacaaaattagaagccgcagttccagggacccctggttatccaacactatgaagtgaggaggtcaagaccaagcatcttcctcttgttggaaaggccaatgcctgggacacaggactcaagagtttgttttgctaaagtgctgatgtttaatttcaccctgggacaggacctgaagagaagccagagctgggtaacaaacacgaagaccaggcttagggactgggtccacccaacctcagtccaccagcctccgttcccctccaccacccaccccactcccagcttcaaaagaacaggctggaccgcaggacacctggcttctctttccagctgaatccctttgtgactttaggcaaagaagattaaatattttagattttcaattatgttcactgaatttaaccactgaaccctcagtttcctcattataagcgtgtgtctctcaaggcctactactgctgggctgaaaaaaaaaaaaccacacacacacacctgagatttatctagtccttggaagtttccatgcaagttggggaagcagctggaaggtgagaaacccccagacctaagaggcccacagtgaggcccctcgggtgagtcggagcctgcccagggtgtgtggagccccagggtgccggctcactctgactgcgtcccagggagcttccccctctcacttactctcaactattcacacctagcagtccccgaattctcgatttatgttttggggcctcctgcctgcatcctggttgtatccctaggcctctccccatcttccaacacctacaatccgtaacgccatcaacgctggattccctgctagcccagccttcttcaattgtttactatcacctttgctctccacctgggttgaaaattcagatgcacagaatcaagcctccccccaggaggggggtcaagcgacccccaggtcactcctaatcaccagcactcaaggaccccgaatcacagacttgaagcagacagacagcctctggcttacggaaggcgattgtaaggaaaaaaaaaaaaaaggacatggcttactcaaagtgccatgcatcaatgtcacagaagggcgacaagagggatgctgggtgagctccgaatctagtactttccagcctgcagctctacttgttgctgcaaattcactcaacagtcagggcttctggttctcagcctccccctcctcctctccaccagacagcggtgacagcccacggttcagccactgaggaggccatctacgatcttctcttccttcccttcctctctcccccactcccctcccatctgctgcttctttggattccccacaacttcagcaagcaagtaagcgttgggctccacgctccgcaggaggccaagatacccttcaatgtatatggggtcaagagagtccccagaaaactgtgggccatccccaaagcccccacatcatccccagtcttttctgtttgggccaaaggtaataagtgatgactcaggaagggcaaggccaggcaaagaatgacaacttcgctaagatttcagctccagtaagggaagttcaagccagggtgggaaggcagggaggagaccctgtacccaggacccagtgtgtgaggcagctctgctcagcctggcaggggaggagagacagactcagagaggaatggagctgaacacgcccacacacataccaccttcactagtgatgctctttaaatcaccaagaaaaagttatgtaaggagaaaacatacagcttccgtggagagaaggaacattttgctcagccttggggtatctgatttaataagaggctcttggagaacaaagccacaattcagcatcagtcttacacaccaaggagacaaagcatcgtgagggggaaaaccgcacacccagggacgcacaatcactatgcatttagaaagccagctcccgcaggtctgcttactcagccccaaggggtcctggaggtcttctcttccagatgctaataagcagtgcaggcttgtaagctgctggatggcaggatgcgagtgacggggacgggcggcactcccagctctgacaaatcctgctgcctcactcgaaaggtccatcagagaaggggtttcccagccccttcagcacaggcaatttctagggttcggctgtgctccgagctgctgccactgcatgtctgcaacagatggggaccggggctgggtgtgttcccagtccccaaggcagcgcaacaagcggctggcagacagcatgggctggcctaagacagcgcaggcaacggtcttggtggctggagctgctttgctgctcaaaatgcaggcagagctcgggcagattcccccattgacgggactgcagcaaactgtcattcccacctgtgtcaggcgctgctggggaggaaact

SEQ ID NO: 491 - DNA, 321116 bp, Homo sapiens
ttaacaaaatggtagatagtaggatctattttaatttttcaatctgaaaaaaaaaaacccaaaacaaaaaaaaaacaaactatcctcatatatatatatacagtgtcaacattttcagagcacttacattaggaaacattgtttctcttcaactgtatgacaatactgtatatgccacaataaaatttacaaaaacaatcgcatcagcagtcataacaaacatcatgattttacatttcaatacacaagaaaaaaaatagacatcttcccggcacttggctcccgcctgacggcaacgtctcctccacactttgagagacctcagcttttaaaacccagcagcggctatttcagaagtcatgtcctttccagatccaaacttaaataatgagaaatttgccatttcaaaataactgagagtttattcatggatgtggtgaagtttactccaccaaaagatgtgtaaaaaaattgcatgaaagtaaaaataaataaagctgttgtaaagcagcctcgttgacacggtagcccagaacaaaacacttacgtgtaaaagtgtcattacaattttaaagtaattatttatattcaaattacaactttttgacaaatctaaagaaaacaaactgatttggtaaaaggttcaaagacttccacattcaagctcggtgttgtttcacacgcgtgcgccccggctgcggcggtgacatattgctgtattcggacataaggcactgtgatctgaacataccgtgcactcaccttatgccacatcacctgttccataccagtgaattctttgaaatgaaaaataatgaaaacttcaggacacagtgcactttaatgacatacagcatttaaaatccttcagacaaaggtctgaaaacagtcttttaatgcaagcctgaatcttcaagcacataaaatctttcttttttaagcttaatttcaacatcactggaagaaatacctattgttaaaccctgatatacattcttaaccacttgcagccagtgttcatgaggcaaaacgtgacccagagactttgttcaagttctcctcctagggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaggaggatgatccagaggcttcggaggagggcgatgtgggaaggagcaggtggcccaagctcccatctcccacccaatcgttcgggcagcttggatccacgtaacatcttgtcattctaaatatgtcagatttaacttggaaaacaaaaaaaaagaattccactcttaaaaaattttactaagaaatatgtaggtatgttttagtgaaggtgtgaagtatttcagttgtgcactcttacaaatatgtattaaaaaaaggtttaggccgggcgcggtggctcacatctgtaatcccagcactttgggaggccgaggcgggcggatcacctgagatcaggagttcaagaccagcctggccaacatggtgaaaccctgtctctactaaaaatacaaaaattagctgggcgtagtggcgggcgcctgtaatcccagctacttgggagactgaggcaggagaatcgcttgaatccgggaggtggaggttgcagtgagccgagagatcatgccattgcactccagcctggttgacaagagtgaaactccgtctcaaataaaaaaaaaaaaaacaaaaaaacaaaaaaaaaacctttataaatattctgaaggataattgcacctaacaagtatctggctaggacattccacagtggattggcagggagagctactatttttctcatcacaggagcttctctcctaatttttcaccagacgctagacccctgaaagagatcggcaatctattagagcgtgtggctgaaacaccgtagctcctggcatcagactgcccacacactggatgcacgcacacatgggttcatttggacagtctaagtttgacaatgaactgttgctaaaaacttttttgagaaagagaaagtgttattgtgttgaaccagtacccctctggggaacggtggccattgcccgatgaaaagaatcaccactagtaccttctaatcgagtaacagcagacacttcatcaaactgcctcttactgactattccatggacaaccacctaacagtgcaggtcccgggcactgcgcctcattgcacacacatggcttttgtgcacggctttcagctcttttcatagcaacataggagggagacgggcctgtatcagccggctccttctctactgaagaaattggggctgaaggaggtgaagcgacttgcttacattcagacagcgctcgggtgggacagctgggacttggcctcacggtgggggcctcctcacttgcgattgttgatcagatgcaggcgctccctgagttccactccaaaagttcacttgtaatccagttattagtaacacggaatgttttcctcaacaaatcgtgttgtatacactgtatcataaggaattccaacccagctacccccatcttcacggcacaatttctatggtaacatacattccaaattccagctggaaatagattcctctctgcaccagcagtgatgggaggggcattgcaatgacttagaatttttgaaataccaaatctggatggaaatttgaactcatccagcacaaccgttcattcttatggtttgagatatcaagaaacagagaggatgaatcgcttgacttgtttactctttttgtaatgcccaaagagacagacaagagctgacattcagcctgacccgctgggcagactgtgtcccgtggtccagggctggaaacggggcatctttttctgaaggtgccaagctatatacctgtggggataaatctgcccagagaagaggccttttctagttagcacaaatgtgctgtgcagttatgcctgcctggaaatttatatgaatttaatgatggtctggatgagcctggctccctctgttcaatgttgcctgtgagattcctccactgttgaatgcagctgtactgttcgttttcaatcctgtatcgtattccatcgaatgaatgtgacacaatttatccattcttcttttcaaagatatttggattattcccagttttatggcattaacattcgtttagttcttaatgtttcatgattatagagactattgtgagattcaggtcttttaaacacttgaagtttgcaagtgactgcaccaggccccatttctagagtttctgattcagtggatatgggacggggccccaacatgaacatttcattttctagtaaattccaggtggtggtgatgatgcctggcctgaggaccacctcggaaaaatcactgctgtactggaatttctcttggtgttctcatttagcgaataagacatgtttcttgcaggtggtgaagattcctttagggtaggtatttttgggttacagacttaattgtaaaaactagtcttaactgaaatttctgaactaaagagaaatcaatactgtagcacacacaccgtttaatattggattctgagagttcaaagggcatgctgtttgctcccacatcgggtccatgtggccctgacaaaggctgggttgttcatatttgactggggctggggaggtggagggatgggaagaggaggagggaagggagggctggcagttttaagaactctcaagcccacctcttactactgagtgtgtgaaatgagaggaaggccagctcctcttgtctaaagccctctcccgttctctctgctcctcactgtctgagactctgaaggcttgctcaaagtgaatctgtcaaaaaatgagtttaaccacactctatctgaaagtgaatgtgatttctgtacaatattaatgaataaaagtttgtgtttaggtattctgttttatctactcaaaatataagttttttttctctttaaggaaagatgaaggtatcaaatagaagccagtgacgttccctctatgtttctggtcactagttctctcacaaagcacaattgaagaggtcttttcagtggaaaaggttatgatgaacatggcaatggctcccaagtcatttagggggccactggaccttgataggatgctcttaacttcgaatacgttctatacactttcctcactcacgcagaacacttaaacttcccaactgaagagaaaacgaaaatggtttcaaagtaatatactcaaagccttgatctgtaggtgggtggagaaatgatggtttaaatgctgcacttcctgttctacctcccacccttcctagacgccgatggcaaaggtcagaaaccagcattttacctgctggtgtgaggatcagggcttgcagaatgtccgacagggaaataatacccacaatactatctgcttcatttaccaccaccagccgatggacctgcaaagagaaaagcaggacacgtgaaaattaacatttaaaaaaggtttaaaatggacatgagaaataatgtcctgtcatgtttttatatgatcaacacatccctccagcctggggaatagcagtgagacatcatctctacaaaaacattagacagtggctgggtgtgctggtgtgcacctgtggtcccagttacttggtgggaggattgcttgagcctgggaagtggaggttgcagtgggccaagatcgcaccagtgcactctagcttgggtgacagagtgagatcctgtctcagaaaaagaaaaaagcaacacacacacacacatcccataaatgaataaatgagggaaagtagccacagacagacccatacgatgaccttaggctctaatgttcaatgtgttactgtctgattacctggaagacctactccgtattaaaaagtcacagccctggtgaaaaacagggacacaggcatgagaaggaaagaggggaaagctatctatctcctgtctctaatgatactgatttgtctctaattcaagctgatttgcttgcttacttttaagaaaaatgagctagctatgccctgctgagttttcaattttcaaaatattaatatagaaaagatacaactcaaacacgaaacacaacgtagctatcatacattgttaaacataactgttttaatttctaaaagttgtatatcagtttctaataactatcaggtacttgtcttattaatacatgggagagaagtccagatgatgacagaaacgaagaaacaaggtcgcagctcttacaagggttttattttctgcagtgtcttttctctgtgaagttcatatattaagaatcgcatccaagaggataaatgagctataatgaagtgggatagactacgtccatctctagttttctactctgaaatctctgatgagtgacggcagagcgttttgaggtgtttctgtaacaggcctttcacccgcaggaagggagcggcgttgctattctcttaaaagcttcatgatggccgggcgcgatggctcacgcctgtaatcccagcactttgggaggccgaggcgggcggatcacctgaggtcaggagttcaagaccagcctgaccaatatggtgaaaccctgtctctactaaaaatacaaaaattagccagaagtgctggtgggcacctgtagtcccagctactcaggaggctgagacaggagaattgcttgaacctgggaggtggaggttgcagtgagctgagatcgtgccactgcactccagcctgggcgacagagcgagactgtgtcttaaaaaaaaaaaaaaaaaggctttggaacctggagccgggtgcggtggctcacgcctgtaatcccagcactttgggaggctgaggtgggcggatcacaagatcaagtgctcgagaccagcctgaccaacatggtgaaaccccgtctctaccaaaaccacaaaaattagctgggcgtggtggtgcattcctgtaatcccagctactcaggaggctgaagcaggagaatcgcttgaacctgggaggcggaggttgtagtgagctgagattgcgccactgcactccagcctgggcgacagagtgagactttgtctcaaaaaaaaaaaaaaaaaaaaaaaaaaaaaggcttcagaacctgggccacggcagctctgtgccggctgcgccctgggagaccctctctgtattgaacagtgatacccctgatagaaaacagggacataggaaggagataggaagagggggaaatccagtttttgtattttgtctcaaataatactgtttgggtgatgtttctgtcataggttgctttaggttaataataataataataataatggcttggtcatctttcccgtggcagtcaacataaatttcttttaaatgtttctctaaaaaagctttcaggttcatcagtaatcctgtgatataacacagcacaattatttgctaactataatcacacattaaaatgatagttcacatttgtcttctacactgaagacattttattggttacattcaatagtggatattagccgggtgcggtggctcatgcctgtaatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacagagcaagactccgtctcaaaaaaaaaaaaaaaaaatagtggatattaaacagatatcttttgaactctgaaggctaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtccttctgtgaggagtcatcttgtgaaggaattttctttttaggcggagtcttttatttagggtgttacacaaagtacatttgaaaatcttataagcagtaaagtctaaggaaattggactgctgaggtgcaggaaactgggagttactagattatttgctatttatctaattgaggaaagagagatactggtgggaagagagaaaaaagttttactgacttatcattcactttgttaaaatatatattacgcactttaaattttgaattcataaatattcaaatggaacttaaagcttctgggatttttgttttctcaaaacaaaatgtatccatagatacagatacatcgatctatttagagacagggtcttgctctgctgtcgagactggagtgcagtggcaccgccacagctcactgaaatatcaagctcttggattcaagggatcctccttcctcagcttccctattagctatgactacaggtccaagccaccatgcccagctaatttatttttatttttagtagagacaaggtcttattatgtcgtccacactgtcaaacatatatagtttaaactatgaatgtatcttaccagtttattggattcacctatgataccaggacttttccattcaattcaattcaacaaacttttagagatcgcctatatgccaagtagtgtgccaggttctgggacaggagggaatcccatcgactgaacctggaggctgcctcgctgggcccttcctgagattcaggcttccagaggcatcattcactactggggacttgttgcagtggacgtcgggggagcaggactgggaaagccgtctcacctcagctcttactattctgtccacgatggtctccagtatttccagcttattgcacttcacaacaccttcaaaatactgtgaacggtgctgaagggcctgggtcaccgtgatatctaggttattgtatgttttctcagcagcaagattctgtaatgaagcaagagaataaattatatcctttcatttcagttcacttcaatgaccaaaattagtgagcttaagagagcctgatttctaaaaactttaatgcttatctgaatttagtacctgcatacatcagacgttctttctggcttacgacatgccattgctactgttattttgtcaacatatcaatcacaattaaagataaccatgttacaaggtctaccttccttacgaagcaacattgttaaactttgacagtatatcctgccaaagactgccccccaatttttaccctctaatgctctctaccatgcatggatgaaatctctggcaaggtgggctgacatctgtaaagggtggtgagtgccacagggctagaaatgctgcagcaacggaccttctcaacaagctccctggggaacaaggtttctgctgggaaggctttgggggacccatggggatcaagcaaccagaggaagaacaggcttgaggagccccatggatccaaatggcttcatggggctctcattcattttagcgggtcccactcaaccaaaatgccgatcagcatatttctcggtgactgttatgtttaacataatagtgtgaagcaaagggtttgaggcagctgcagaagaatgtttaatgtggggtcagtattgtggcaaaaaatggcgtgcacatttggggctataaagtgtcagtccccttttcttctttagaacagtggctcccaatcactaagcaatgggatgcgcccgacaaaggagccatgagtccacgtgtgcactgcgcacgcgtctagaggcgaataaatcaggcctcctacgtggaaacaagaacatttaaaatatatacacatgctgtggcagtgcataaaatatgcatgtattgtaaagatgaaaaattataaaatgctactaatatataattggttgctaaaccaatgcagattaaaagtacaattactatagaaggtctataaaattctgataatatcctcacaccccaaaaggttagaaattattaaattaagaaacaagataaaaacataaaaacacattacatgaatgtttaaaatgcattctaggtgacagattgaacaaaattaaaatacttacaattacatcaaatttggaataaatatctacaacttttcctaaaaatgaaaaatatatgttagaaaaatgtcttaagggacaaaaagaaattcatttaaaatcagttttaatgacataattactaaaagttaaacactgataaataaccttgtctattttaaatgaaaacttagatatgaaatcatattttaatggacatatgaaaataaaccaattaaactttttttacgatcctgcgtgccccttggtgctgaatttattcaccatacccaagttttcattttccccacgtatctcctgtgccaggtcatcttacaataattgcaccctgagataaacaattatttctgcctgtcagcgccaaacacacaaacctgactcatccacaacaggcagagctgatattcgtctttccacaaatatgttcaaggctttgatgatgggagtgtctggatgtatgaaggcaatgttgtggtacgttcctattccaagctcatccaggttctgcttcatgaaggcaggctttggcatatcagacatctaaacggaagataaacgcaaacgttctagacccagaacacactcttgtcatgttcaaaggtccagatttgaatgaaaaagtatgtccaacaaattaaagttagttttttctaacagtctacctggatgcctgaattaacatgagaaaattacaaaggactgtatcttttgtttgaaccagtttgtaggtctatgcttctatttaactattcacaaactattgcagagcattgatactgtaatctttttccatctcctcttcactcactaagaacgcgtatagaaccagggaagaacaggtctatttgggatattaagacctgtaagccacgaagaattgaatcctttattcttaattgttcatgttaaattcctggtcctgctgtcaggattaagtaatatttattaagaacctatacatttccaaacccaaagcatttgacggcagctgtctgagccactgctaagctagtcctcacgccacccgcctctacatcctgaattctccttggagagctccaatttttgtctactaggaacaaagaagccagctgaacagaattaaaagaatctttaaaaattaacttttcatgggctgttttaaaggaggagggatatggcaggagagaaaagtctaggatcatgtttgagtataacaaaataaggtctacggtttcaaaaatccaccttttataaagggtatagttgattccatcctcctggtgtaccttataattatcaggaaaagatgaacaattagaagaaacaaaatgttcaagtcaaagagttcatcaatattcaaatcatgagactcctagaaatttagagaaaaaaaaaaagaaagccctattaggtcatctagtccatctcaacatagcgaattccctgttgcacactataggcttaggctaattttcaaacgtcttgaagggtaatgctccttttttctcagaaaatgatctcataattcagtaaaaatcaggctctgaaatgtctttaagttctatatttttaactgaaaacctttagttagctgaatattctggtagcatgattctaattaccatattggcccaaatatgaggcagtactgggcagaggcaacttcctctcctttttatagaagataaaaatctgaagcagctctgcaaaagaatgatctcacgcttttactccctcttgtgcaacagcacactagcagaaatagtttgggcttgggagtcagagagactcccgggtttgcaatctaccacttagtatccacatgactgggggcacgtttcccagccaggtgtcctgtgtatgcaaggtatgcaaacgcctccctcccaaggcccctgcgtggagaaaagcatggggagtgaggaacgcttgaaagggatcctggctctaccgcttcccagccacgcaaccttggcaaagctacttaacctttcttagctgcatccctataaaataggattaataaaaatacctacctgatagggtagcagcgaggatgagattatgtcaagtgcttagaacagtgccggacatacagtaatcagctctcatgattaatattatttaaaaatgatgactctaaggattaagtgagctgcaggcctggcacgtgggggccctgaatacatccttcccaccccatgctccctctgttcctattaaacttcaactactaaagcggctgcattcccagatgtccagtctgataaacaatgcggatgcatccctaatccctttttcctagattatcgcctttattaaacttcagacttgagtttttttgtaaattactcttccctaccttctttcttagcacagcatggttaaataaatgttatttatatatgtaaatgattaaaatacaagactgggttgattgacaaggtatttctctccatcactaagccctctgtgcttctgtcagcaaaaggggtccctcaagctgcctccagggcaggagcttcagctccttcacactgcaccggaacgctatgttaggtccttaggtgaagccatggggaggaaaatgggaaagctaatttgaagtacatttttaatatctgttacagtcttggaaaaacaactcttcaaagtacctcttcagaacgattaagaccttctactggttctatttgactgattacttacaacctcaaattccatgcatgtaattaaaagacaaacataaaaagcctcttataaactctctgttcttcctgagtctcttttaatgtttccaaccaaacaggctcaaagttctggatgactacggagccaggtcatttcaagtagctgagaaaacctacaggttaatacaggccttatttggaccaacatggtattctcttgccaaaattttatttgcttcgggtttttctatcactgctgcagtttataagataatcttgaggaaagcattttttggaacatgtttctaaaaccatgacaccagtaaaagcaacataaagcaatttttgctctagatattagttcagtttatcttgtacaacagtcctcaattagacttgcagattgccttatttcccctcatatgctggtgacaaatgttttaatttaaagagagaatgccgagttttgttgttaaaattgttttgatacttgcactaaaaggtgattcttttaaattggaatcaactttaagaatgtacaattcagagagtagtaagttgagaaactgaagtttagaaagggagacctcaaaactaacaatttcttctactgagggtaacaggagccaatttacttgaagtacattatttaataagtaaatgcaattatgtctttagaaacgctaaaaactacttacaaaaagctggaggaacttgaggattcttttgtgggtaagtatataaagtgcattcccactgatagggtcaataacgggcaatctgtggattttatttttgatcaaggagtatacagcatcgaagaggctgtgggagaagtcattaaagttgttaggaggctttcgagaaaaatcagaacactttggactacccctgccttaaagcacttccagtgtttttattattgcaataataacagtgttttggaagagttttaaattagagatctcagcaaatttttcatttttcacaatctatgttaacatatctcaaatacaagtgcaagctacaaatctctagaagaggagattttttttggtttgtttttttgagacagggtcttgctctgttgcctgccgtcatggctcactgcagccttgacctcccgggctcaggtgatcctcccacctcagcctatttgagtagctgggactacaggcatgcgccacctttcttttttgtagacatggggttttgccacgttgcccaggctgctctcgaactcctgagcttaagcgatccacccaccatggcctcccatagtgctgggattacgggcatgagcccttgcgcccagccaggaagaggagtttttttaaagagtgtatttagtgattttatttgaaagacgatgaaacctaaatccttagaaaagcaaacagatacatcgtattggcaagagagcaaaggctgtagcagcaagctctctgcattggtgagtgggcaaactggctctaccccgggccggcccggctaggagatattgcagggccaacatttctgttctacttggtccctctcctgggactgccagtaagaaggttgttatacctttttgttaggacttggaaataaaatgaaaataaatattttaatctttctctgtactggatttgagtttgaaagatgcttttacaccaatatggaaatgtatcacagccaaaccagaaggcttggataaaaaaggacgggccagacgactacacagaaggcagcccatgctctcaccacatctgaaccgacatctaacacacactgatgtttaaacgctagtgtggagcagaattgccaagggagttgtttaaatgtgtattcctgggccctatcctgatttagcaggtcaggggtaaaagcccaggaatctgcaatttcaacacgccccccagattggccgagatcttcgtgatggtttagtatgaccctattactagaccattatccatccttagcaccagcaacggctgtgatttttgtagtgttcctagatttactgaatgcgtacagtgtagctggaattaaggaggcaggccctgtttggaatgaagaacatgtttatttgtgtctttctttctatcatggtgataaaacacatacatctgaatgaatgttttcaaagaaaaaaaaaacaagtttaccttgcatctggagatatattcactaaaggcttaaatgtttcttgtaaataaagctctgtatttatagaaagaaaatatgcagttagtaacacatttgctgtttgcagttataacacaaattcaaatacccttcagtttacggttaatagttagaaggattaaaaactcaaataaaaagaaatttaatttgcctaaaactcctgtgttaatcatagttatggctattttaaacaacttccaaactgttttcaggatgttgcatttgaagaaaaattaaatattaaaaaacaatgtgacagtaagtgtttataaaatcaggaaaaacaaagaaatctgataaaagagcaataccagcagaggtcactagaatgctaccaggttcaccttactctcaagaaatgaagcaattatgaaatttaaaaaatcaatttccataagttataagataaaatcagttatgacaaactttgttctttaaatatttttaagtattattttaccaaattgatgctcaaaacctactgcattgtgggcatctttccagcacataaaaactgtttttttctgaagatatcaactgcaattaatttgcttttccaaggtttctttttttttctgagacagtctcactctgtcactcaggctggagtgcagtggcatgatctgggttcactgcaatctctgcctcccaggtacaagcaattctcccacctcagcctcccaaatagctgggactaaaggtgcacgtcaccacaccctgctaattttttttgtatttttagtagagatggggtttcatgatgttggccaggctggtctcgcactcctgacctcaagtgatccacctacttcagcctcccaaagtgctgggattacaggcatgaggtcctgtgcccagcctaattttttttttttttttgagaaggagttttgctctgttgcccaggctggagtacagcagcatcatcttggctcactgcaacctctgcctcccaggcccaggcgagtctcctgcctcagcctcccgagtagctgggagtacaggtgcgcaccaccacgcctggctacttttttgtatttttagtagagacagggtttcaccatgttggctaggctggtctcgaactcctgacctcaggtgatccacccgcctcggcttcccaaagtgctgggattataggcgtgagctactgcgcctggctctaattttgtatttttagtagagagagggtttcaccatgttggtcaggctggtcttgaactcctgatctcaagtgatccacctgctttggcctcccaaagtgctgggattacaggtgtgagccaccgcacctggccttgctttaccaaagtttctatacagaaggcgtttaagaatattttggcattattattactacaaaatatcatgtaatgtcaaaacgtaaacatacttaaaccttggtctatcagtacttgtacagtagaactggacaagaagctggtgttacacaatcactgcacaacagactgtacagatcccatgccaaatttgtttagcttggtttgacaaagccgtaataaaccaaacccatcactcagtgaaacttctaaatcgtatggatttgaaagggcccctgggggtgtaagagaactccaagatgtattctgatttcacagccagctacaaaggttgcttctcctatcaagcatattatgggaaacacagaaccaaactcttcaattttgaattcaaaattttccttcagttggtccctccatttctaccagtgtttccttgagcaccctccaaaggctccgctgttgcagacagactgggtctgccgtgattcccacccccggtcctctccaccaacccaccatgacaagtgtcagtgagaccaccaccttacaatcatgaaatgcgaatttaagaaatggttctatggcagaaaagagtatcatgattttacagggtgaatgtcaatgtgacaatgaagagaatatggtcttcaaattacttccatgctatttgctccaaaccatctagtttgaggttcatttgtcctaagtttctccacaatttgtaaagaaacaattactaggtttaaataagaacagatgcttgctttggttcaagttaggcatgcctctgatgcatttcttaataccaaggcaaatctctgagggcttagacttagtagtgagcggtggccccattgtgggcagcgaggtggggcttggttagctcattcatcttcacattcctggccctaggataaggccttgcctgctgaaggtgtcctatacatgtctataaacagaagggacaatacttatattgttcagctttagtacagtagcatactatcaaaattaacagaaataaagagaatgttttatataacattttatggagcagagagaaaaggatctgcaaaatgaaaacatacttttcatactaaacatagctttcccgatactaaaagattttaaacatccaatagtgcttacccctccatgtttcaattttatgttcctctaattcataaatctgtacctgcaaataaaaaaattcttatttataaatatacatatacaacatagaaaaaatatttggaaaatgaaacaaaacatagcttggataatagcattttctattcgcaattagaaaatgaggcggccaggtgcggttgctcatgcctgtaatctcagcactttgggagatcaaggtgggcagatcacctgaggtcaggagtttgagaccagcctggccaacatggtgagacctcatctgtactaaaaatacaaaaattagccaggcatattggtgggtgcctgtagtcccagctactcaggaggctgaggcaggagaattgcttgaacccaggaagcagaggttgcagtgagccgagatggtaccactgcattccagcctgggcaacagagtgagactctgtctcaaaaaaaagaaagtgaggtgagatatagagaaaaaaatgtatctcaagtttttttttttttttgagacaaggtctcattctgtcatccgggctggagtgcacaagtgcgatcatgactcactgcagcctcaacctcccaggcttaagtaatcctctcaactcagcctctgagtaacttggactacagatgtacaccaccatgcctggctaatttttgtgggttttttttttttttttttttttttttttgtagagatggggtttcaccatgttgccccactggtctcaaactcctgggctcaagtgatccacccttctcagcttcccaaagtgctgggactacaggcgtgagccactgtgcctggcctgtatctacagatattaagaaaaactttgggctgcatatttagacataactgcttttttgcaattttgatttcatattctactgctaagatttcttatatgggatttgctgcatttcacagaaatctatctattcaaaaatcacactcatgctgattttgctagttcaaaagcagagatatgaccactataaggaaagcccgtgttcacttgcattggtaatattgaagaaataatacacttcatgggaaataaatacaggatatttacaaaatctttggtaaaacttcctaagagtatggttgtgtttgtttttcggagacagagtctccctctgtcgcccaggctggagtgcaatggcgcgatctcggctcactgcaacctccgcctcctgggttcaagcgattcttgtgcctcagcctcctgagtagctgggattacagatgcccgctgccacacccagctaatttttgtatttttagtagagacagggtttcactatgttggccaggctggtctccaactcctgacctcaagtgatccacttacttcggcttcccaaagtgctgggattacaggcgtgagccactgtgcccggcaagagcatgttttatgaagaaactcatttttgtatttgatgtaagaattattggataatactgagcattacgcataaagcagtattaattgaattaacctacaccttttaagtaccccaaataggactagttaaataagagtatgcaatcctgtccttccccccaccctcatgaacaaacaaacagaaactaaaaacacaaaaccaagcaggttgaatctcagatatcacaaagttagatgaaggacaaaagtggtttttaagctacgctctttccagaaccattgtactagggaccagagagttctgctactaaaatcagccaggagctgtctcttcctaattagcaggaacatgtcaaaacggaatttatttcactttaatgactcatttttttctgctttaaaatcacaaagtacatataattcttgttctgcaattgctggggtaactgaattaagctctaccacctcaacaggcccgcagagataagcaaaacttacagaacgtctagctaataaatatgtagaattctgctaagccaaggaattccgaaagctgaataaagaatctatttccttttatttttcctgagaattccttctttgagtttcatacatataacttacagtaaagagagttttgtactgaagttccctgcatgttatatagatttggaaaatcaccatcagcacaccataccaaaaaagaaaaaactgaaaacattaaaaatcttaaaatacacacatatacctacacacatacatagatacgtacagctccaactactgacataggaactggtgccacttaccataggtgatttatagtatctatgtagtatatttatgaaatctgtaattgttagcattcctggaacaaagaattacatgttacaaataaaaccatgaaaacatttttaaaaatttcaaatgacaagtgagcctagaatatatgctagaagagcttataaaatatacttcgaagatatcaagcagagtttaatatattatttaaaactattgatgtgttaattgtgtataccaaactggatatacaaatttagctgaaattaaacctgacagtaagtactacggaactaaccagagaatttggcaaatcaatgagagaaaactcattaattgatacaaatttgaaaaaagaattgcagttacaggtaaataattttaagtactttaagataaagtattccgtaagctttagaaacgtgacaattctgggcacttggattgtttcccaagaagcattctaaacacaatggttttaacagttgccatttattgagtgcttttgacgtgctagacaccaggatgatacggatgaaaaagacatgaacttcttccctgatgaaattaaaacctagaagcagacataacgatcatttcaaaataacgtgaagaatactaagagagacaatggcattgtctgctgtgattcataagataagtaacgatggcatttagatagctgtaagttacacaacagttttaacagtataacaatggtctggcagagacatcagtcatgtttacagcatctaatttgccctgtcaaaaaggtgtgcactagcgagatgagtgcggggcccagggatgccatatgccatgtgtggcccaaagtggggcagctggctcacatctgactgtggtgtcctacgtggggtttgttcattgggctggtaaagacacataagctcttcagagagccaaaaagttgctaaattaaaagaaattcaacaacaacaacaacaaaagctccataaaagttacaacagtgtgtagagttctcaatgaggcggcaaaaaaaaaaaaaaaaagaaaaaaaggacaacagtgtttggaccttactagcacgtccaccttcttacccagtatgtaaaagcaaggaattttttttttttttttgacagggtctcgctctgtcacccaggctggagtacagtgcagcgatcatggccttgacctcctgggctcaagtgatcctcccacctcagcctcctgagtagctaatttttgcatgtttttgtagagatgaggtcttgctatgttgcccaggctggcctcgaactgctgggctcaagcgatctccctgccttggcctcccaaagtgctgagattacgggcatgggccactgcaccctgccagcaagaatgttctttaacttggaaacatgtttactaggttgaattccaaaccggcatctattaaaatactttaggctttctgctttcaaggtttccattttcgattttcctcaggcccacactgcttacctacaaaactttgttttttactctcccacagtggcgctgctcggacaccgttggctaccaaagcaaagaaggcctttttaacctgaagaaaaagaggagaaacaaaacatactttcaaagtccaggaagaaaaataccttttttttttgagacaaggtttcactctgttgcccaggctggagtgcagtggcaccatcttggctcacagcaacctctgcttcctgggctcaattgattctctcacctcagcctcccgagtagctgggatgacaggcatgtgccaccatgcccggctaatttttgtatttttggtagaaacagggtttcaccatgttggctaagctcgtctcgaactcctgacctcaagtgatccatccacctcggcctcccaaagtgttgggattacaggcgtgagccaccgcacctggccagaaaaatacccttaacatatttgaccaagtcttatcagttatcttccataataagtttcgtaagtttgataagctaaaaataatggaatttattaacattagcaaaaatctttttgaattacacctaaaggcatacagggattagaaattattttttgaaattgaaataatgcaattaacttcttttttttttcttattgtatctgaagactcttgtctacatacatactttatgtaattaaaaccatacaaaagaattaaacttcagggtctaatatctcctacatgtggttattaattcatctgaaaacactgaagttgtatcaaattacctgaaataaaaatttatttttagtattttcaatgagaaaacaagcatactttctcagttcccaaggttgaggaaaaaaaaaggtatgaaagatacaatatatttttgcattttataccttccagacacaaatgggtcaggcactaacatatcatatctcacttaacactcataacaaatatcttttgggataccataaggtatcatacttgaagatttattaataaccaaaagttcagtgctgaaaatgatcctctaaattcagacagcaaataagtacagggaaaatgtccaaccttattaataacccaagaaatgcaaattaaaacaaagtgtcatttgtagatgctaaataagccgatattttaaagttgcagctcctaatacaagggctattataaaaccactggtggcaccaaacactgagaaaatattttttctaacacagctagtgtcaagaatcacaaagtattcatattgcttgtgcaacagctttttctctttgaattattttaggagtgggattcctgaatcaacaatgttccatgtgacattacttctaatcttgaaaactgaaaaaaaaatccacctctcaaacaaaacttatcaaatactagcataccaatgagaaaaaaaatcaaataataattaacataattatgatgttttcataactatatcaagaaaggtctatgacaataaaaatgtaactgtaaaattatacattatgatacttagaaaaatatgtgtttaaatggaaacaatgagaaacaagcaaaaaaagattaaactgatacattaagaagctgggatagtaaaatgtttctttaaaaaaagtgttacattatggtatggttatgtttttttttttttaactaaaagtaaattattctcttctcactcactactcaaaaaaaaaccttgttggctgggcacagtggcccacgcctgtaatcctagcactctgggaggccccccgagatgggcagatcacctgaggccaggaattcgagaccagcctggctaacatggtaaaacctcgtctccactaaaaatacaaaaattagctgggcatggtggcgcacacctgtaatcccagctactcaggaggctgaggcacaagaatcgcttgaacctgggaagtggaggctgtagtgagccgagaacacgccactgtactccagcctgagtgaagagtgagactctgtctcaaacaagcaaacaaacaaatgaacaaacaaaacaaacaaaatccttgttaacttactaatgaaaacaactgcaggaacctagagcagatgactttaggactaataacttagtacctatttcttcctttattgtgatatattttgccttatgtggaactgctcatgcatgtacctagttcacctacacaagaatatagggactactggtgcgttgagggagctcatcaattatttcacgcatttattttaacccgtccagcgctgagtcctgaatatagcagggattctagacattagtcaaatgactacaagagaatgacgatgaggaaatgagtagagccaacccagtgatgtgggagagcaacagtaactgagcagcatccagaaactcatgaactgtttctgaaacacacctttatcaaaaaggcaccaaaatacactgcttttgtaactaaatggcatccaggaaaggtgtgcccatttgaatggtttgctatttgtaccctgggcatctctgattgtggtcctagaatatattatagaagaatatagtggaaaagtcgcatgtaaatagattttaaaacacactgaatatctggtaagtttgcttttctaaactggttggaatagaatgggaatgggggcaccttttatgttttatttgtatttatttattttttttggagacagggtctcactttttcacccaggctgaagtatagtggtaccttggctcattgtttcctcactgcacccctccccgctgcccctgccgggctcaagtgattctcccacctcagccttccaagtagctgggaccacaggcacatgccaccatgtccagataattttttttcttgtagaggcaggatcttgctatgttgcccagactggtctcaaactcctgggcttaagtgatcctcctgtcttggcctcccaaagtgttaggattacaggcatgagccactgcacctggccaggggcatcttttaaaagcacaaattgcttactgttttcttcaaaatgacagatttagcagagaaaataaatgttaaaaacattcatgaggatcattcatgaaaccctaagtagccatagctattgaaaacctatgccagaaagttctgagtttggcataatgaaacagttgaaaacaactatccaagttgtacaaaagacaggaaacactatttgagggccctggagtgcatcaacacggggtggattctgggagctacaattcttgaaagaaaagaaggctatgcattgagcatcacattcattctggaatttttctgagggcatttcccacatcatctgcacataggtcaatttcaacaagaagctgaaatttatcaagaagaatcaaacaaatcccaggtaagataaacacaaagaaaaccacacctaagcacgtcatagacaagatgctaaaaaccaaaggtaaagggaaaatcagctagagggggaaaagacacattggctttcaaaagggtaacaagcaggctgacggctgactttccagcagaaactatgaaagtcagaagacaagagaaagaaaactttaagatgctaaaataaaaaacctgccaatctaggttagagcatatatccagtgaagatatccttcaaaaaggattggcaaagtaaggttttttggattaaaaaagcagagaaaattgtcaccaaccaaccagcattaagaaatacttaagggaggccaggtgcactggctcatgcctgtaatcccagcactttgggaggccaaggtggggggatcacttgaggtcaggagttcaagaccagcctggccaacgtgatgaaaaaaccccatctctaccaaaaatacaaaaattagtcgggtgtggtggtgcgcacctgtgatcccagctacttgggaggctgaggcaggagaatcacttgaacccaggaggtggaggttgcaatgagctgagaccatgccactgtactccagcctgggtgacagagtgagactccatctcaaaaaaaataaaaaatacttaaggagtcctctgcactgaaggaaagattctagacctgcacagaaccgtaggagggaacaaagagcacaggagagggcagagatgtaggtgaacataaatcaatactgcataaagccagagtaatgatatcctgtgggattcataacttatatagaagcaaaatatataacaatagcacatagggtaggagacggtttaacttttgtatacattttttgcattgtttgggacttggtaaaattattattaaaagatggaaagtagtaagtcaaagatgctatgtaatctgtaagacagcctctgaaagatcaacaaaagaatgtataactaagttcacatgttctcatccatttgtgggagctaaaaatgaaaacaactgaactcatggaaatagagagtagaatgatggttaccagaggctgggaagggagggtagtgggggtgggtgcggggaggaagtaggggcagttcatggataaaaaaatgtagttagatagaatgaatacggtctagtatttgatggcacagcagggtgactacagtcaacaataatttattgtacatttaaaaataaccaataattgggatgtatgtaatgtaaagaaatcataaatgcttgaggttatggacaccccatttatcctgatgtgattatacaatgtatgcctgtatcaaaatatttcatgcaccctataagtatatacacatactatgtacccataaaaatgaaaaaagaatgtataactaaaaagctagcagaggagaaaaatgggttaaacatagtttgttaaatcgagtgaagaaggaataaaagaacaaatcaatagaaaaagtgaaaaacgcatagcaaaatggtagacaaacctaactatagcagtaactgcatgaaatgaaaatggactaaacggtaattaaatgctattctaggcatttattgcatggtttaattgcaattgtcaatacagaaagtaaacgaaccttgtctatgacctaagtcctaggatcctatcaaggactgcctttctctaataagggccaatgagtccaatggatctaaaccatagatgagaccacgtgagagccaaacaagagggcttccttcagtggacacatttctagaagcttctggcagagactattgtatccagcttcaagacataaatgactgagcacagtggacatctacacacaaaaatctctggtcaaatagtgtaataatttaaaaaaacccaagaataaatattgctattagcttagtttgtgaatattttgatattttgatatttaatgtttacaccttgtacaaatgatcacatatagatccaacagatttaatggacatttttacactacagtgagcctcatcacacctcaggcttaaaagaatgataccaacaaaagcaggggtttaagtttaacactcaaatatgatgattattacttcagactcagaaaaaaacatcctgcttccccataataaattctcagactaatctgctacaaaagcgttcagcccccaaaatgctgcagatactgtttacggtgaggccactgtgaacaacacaaacaggaaataactgcctaacaccaattcttaaggtggcaaatacatgtatgggaaagtatacggggtaataatacagacgttagaaactgatcacgcgtgctgaatcaagttaattctgagatgaaagacactgatgctgcgtggtcaatggcagggagggatggagggaggaattaattaatttcagacagtatcggtccaacagagggatcgatgtatgtatgtacgtatgaatgacagggtctcgctctgttgcccaggctggagtgcagtggcaggaacatggctcactgcagtctcaacctcctgggttcaagtgattctcccacctcagcctcctgagtagctgggaccacaggtgcacaccaccacagctagctttttattttgttattttttgtagagacagggtccggttatgttgcccatgctggtttgaactcctgaactcaagtgatcctcctgcctctgcctcccaaagtgctgggattccaggggtaagccacctcccccagcccaatggcaaggtttatagagagaaaagccccagtgaagcagcagttcaatggcaaagagaacgttaagaatttaacgtgcaaagtggtatctcttctgcaacagaagataaaacaaccaaggctcacggaagcacgtggagtgaattaagaggccatcccacttcttgtcaacgagctaaggtgctacacctactggacttcaacttctcgttttccacataaaatgtgtatctctacagaacagggacactgcttcatttctcaaactgaaatcataagcacagcagctcacttcgtttttctgatggcctcaagcaccaaggctttctcgcgggctccttggcccgtgccagctgtgtggtggctgctcagtcacttaaccctctgtgagcctcaacatgctgttataaaatggggctaatggatatttcctcacaggtgtagggtgtggattgaataggctagtatttgaagatgttcagtatggtgctcagcactaacagccaagaagaacaaatgcttaaaatttccagtctatactgaccaaaccagaagccaacagaaatttcttctttttttcactttggagacagggtcttactctgttgcccaggctcaagtatagtggtatgatcacggctcactgcagcctcaacctcgtaggctcaagtgatccttatgcctcagcctcctgagtagctgggatcacaggcatatgccaccatgctcagctaatttttaaatctttttgtagagatggggttttgccatgttgcccgggctggtctcaaactctaggcctcaagtgatcctcctgcttcagcctcccaaagtgctgggatgaaagatttattcttttaatttcatccacatacactgttgacctgtccgcaggtcactgaggaagtctcaattccatccttcagagatctcatataatattccaaacggacatgatactcgtacaatgcattaaagagcagtgtcctgggtgagctcgggaggggcctgacgcttctgtggttttgccgaccttctttgcaataacgaggccttctaaaacttggctttcttaagaacacgtgcatggagctgtttataaagcaatttaaaatcatacttggaaaattctccataattatagacggcacagggtgttccaattaaccaataaacaggatacaaagaggactaacacaatctagttctaatttgcaggaagaaaccgctcagggatcttgagtacctttgaaaatttctttccttttaactgatacgcaatttgctcaaactatgattaattttaaagtttacattttaataggattttcaacacatttcaaagcaaatgtgataattagataagaaaagatgggaaataaaatgttcataggtaagtttttagaatagtgagcaggcccgagctgctctaagagactctggcagtctataccaaggagaacatctgtgttccccagaatgggaagctggttcctctgatgcctcactgctttctacacagcttcactctgattttcagtaattaagttgactgtgaagcttttaaaattaacgctgatatctactgcgtcaagaagggtccagcttctgaaatacggtcgtcgagactcttctccgtccaggcccaggcctcccttgccagctgcatgactccctcctccctgaactcatcttccatgcccctccaagccccagtactccttcgacttcagaagaacagttgcccaccattgccatggaaggactgttttctggaggaaatgcactgctccagaaataaaacagacataggaacatggggcctccaatgaaaaagatggctggcttactgctcttcagtgaagcccaccaagcaagaagcccacctgtgaacttggtatgtccatgccaactgttagcagtcactcttaattatgaatgaatgggcagccatctgacagggccttgaacgctgaagtcacacaagtcccagttttacacagatctcactagaagggttaggaaaaaaaaaatcttccaaaaagtggaatgaaaagaaaaattgaaaaaacaatgggaaaagaatattaaagatcaactcgggggtctcagagctgctcactgaagttccggagaaaagcaagcactgggaagaaaatgattgaggaaagaatgcaaggaaggctaggcacagtggcttcgggaggccgcagcgctgaggatcgcttgagcctcggggttcaagacccagctgggcaacatagcaaaaccctgcctctacaaaaaataaaataattaactgaatgtggtggtgcacgcctgtagtctcagctacttggaaggctgtggcaggaggatcgcttgagcccaggaactgggggctgcagtgggctgtgactgcactaccatactccagcctgggtaacacagtgaaaccctatctctaaaataaataaataaataaaaattctaaaaaagaaacaacgcaaggaccagagaactggatactaggagtgtcaggttctagcgggacgtcacctgcccggcaccatgaactgaccacaagacacatgatgatggaattttagggtaccaggtagaaagcgagagccacaaaagcttcagaggggaaaaataaaatcatatataaaggctggggattttaaaaaagcatcaaatttctctcgatcagcactggtagctagaagaaatggaatgatattagtaccttcacaattcttaataaaaatgatttctgttatagaattctagacatagcagtctacaggttgaacgtaagtgatatataaaatttcaagtaatacattcccacgcatcttttcttgggaggttttatggactcagtgtgtttggttcaacggctcaacaggttgtttctgtggaatatgacaagagtaaggcacaggagcaagagactatgtctttattgtcagtttttttggtaccacttgacagaaattgttaatatgtgctttgaaaaactctcagccactagtctgctctgctccagcacattcccgagcacgagcccatgtgtggcagggcttgccattctccctccctgttctcagcccgttttcatctttttagaatattcacatgctctcatctcttctgtccttgatgccatatcaagtgatcctatgtataaattttgcctactgaggaatctttctgcgtttcgattattatcagctatcccacctggtttcaagtcatctgtaaattagatgatgccatcaatgaaatcaatattcaagtcattgttccaaagctgaagagcgtggggcacaagaatgctctggcgtacccccagtttctcagctggggctccccagaaggcagagtgtatttgggaatgtgatgccagggagcagaagtacaggaagggaggaaggagacgggtgggcgggtgagtcagcgcaggacgcgttcctgagctgccgccgcagagcccactgatgctgatgccagtgggatcttcctaggactgcatgtagctgctagcttctatcctcccctggcggaggaagctggggtacatgggatggtcctgggctgagggccgtcccactgcccctgcacagagtgaggagtgctggactatgagttgatgtgaatggatttggaaatggcccacgagaggcatccaacacaattagaaaccttgctccaggtgttgactgagatttaaatattaattgatctgcttggctgccaagctgcagctctgcatctcatcctctgggacctcgtgccaggctctgccagcctactctagctggaatccagacgtgcctgtcatggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgattcatctggatcagaaatgagatgtggttcatgctgacaggtgctctccgcaactattgtgggctttagtttcctcgaatcactattactttacctcttccactttgaagatcattttccttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttactttacttttgatcatgtgctctgcattctgtattctctactcattcttcaaggtgggtggatcacttgaggtcaggagttcgagaccagactggccaacacggtgaaaccaagcctttactaaaaatacaaaagttagctaggcgtgttgttgcccgcctgtaatcctagcttctcgggaggctgaggtgggagaatcgcttcaagtgagccgagattgcgccactgaactccagcctgggcgacagagcgagactctgcctcaaaagaaaaaatagtgcttggcaaacagccacttatttggatacttgcttgtttttttgttggcattattcaaaatcacattgcctggaataatgtaaagaacaaaatgaagttgttctggattataacccaaaaataaatatccataaatccatactgaaatagatgactgaataaacaaacagatggagaagggacaaatctcccttgcagaaaaatcccaactaactcacgtagctgctcagccctcacggaggtgaagcgtcactccccatggctaagtgtgggctgtacgtggtgacttccttcttgggactatggcatggaaaggaggaagaagaatcatctcatggtggaaaaacctggcacacctcagccaggtaatggagagtggtaagtcacacaggcagtaagcaccctggagacggtatgatgaaaagggcactttacctctctctggtctttctcctccaaagccacatgcccagtctaatcatgataaatcatcatgcaaatctcagtagagggcattctggaaaatacctgaccaacactcctcaaaaccgtcaaggtgtcaaacacagggagtacctgtctgagaagctgtcccacctaaggaggcatgatgacgagacgtgatggggtaacctagatgggatcctccaacagaaaacggcattatgcaaaaactaaggaaatctgaagaaagcatggactttagcaaataaccatgtatcaatattggttcattaactgggacaaatatagaccacactaacgcaagatgtcaaaattcaactgggtgtggggtatatgtaaattctctgcactagctttgccatgtttctgtacatctaaaactcttataaaacacttgttaaaaaaaaaagctatcatttgtagagtattgctaaaagaagttacattgccactgtgaggaaaagcctggatcattcctaatgcttccccccaccaatcctagggtgtgaggattccattatgaagttttatttatttttgggcctctcataattctcgaggtgtcatcttttggaatcactaactgatgtggtttggctgtgtccccacccaaatctcatcttgaattgaagctcccataattcccacgtgtcatgggagggacccagtgggaggtaactgaatcatgggggggagtctttcccatgctgttctcatgatagtgaataagtctcacaagatctgattttttttttttttaagacagattcttgctctgtcgcccaggctggtgtgcaagtggtgcaatcttggctcactgtaacctctgccttctgtgttcaagcgattctcctgcttcagcctcccaaatagctgggaccacaggtacccaacaccaagcccagctaattttcgtaattttaggaggacggtttcgccatgttggccaggctggtctcaaaatccaggcctcaagtgatccacctgcctcggcctcccaaagtgctgggattacaggcgtgagacaccgcacccagcgatctgatggttttataaagaggagttcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtctttattggcagcatgaaaacaggctaatacactaactgatacctatctttctctgaattcctgggcttatctggaagggaaggggatgtcccccctctctactgtgccagtcatgaagttactgtctctctgctccatgcccatccctctaacttggcttggtgatgctgggactttgcagaccctgtttcggtgttgccaactggctctatttcaggttctgacaatacaggagtctagggagggactcaaagccagagcaggaagaagggcttgctcctcccgtcagcggctagcagggctcctgtctgcctgcagctcccgtgagctccacccaggcactgccttacctgggcaccgaggcacctcctgtagcagcggctgaatacagtttgttgttttcccattttgtgcaaaatgagcttcctcaagccccaactcccacccagagacataagcaccagctagaaggcacgcgccaggaccccctctcctccacgacactgtggagtacaccagactcacacagcatcatggtgaaacatgggtcactgagcctcatccccccgttttggattcgggtctcagattgggtctgatgagctgcgtttttaaaagttccagctgatgctgaagctgctagtctgggaatcagactttgagaacactgccttagaggtctttatttgtcctttcagttaccagttaatttagatccagttaacatttgcttatgttctttttctgttcaaataactggtgtggcttctgtctcctgactgaaccttgactgatcaagaaactggcaccacggccgggcacggtggctcacacctgtagtcccagcactttgggaggctgaggcgggcaggtcaagaggccaggagtttcaggccagcctggccaacaaagtgaaaccccatctctactaaaaatacaaaaaattagccaggtgtggtagtgggtgcctgtaatcccagctactcaggtgggtgaggcacaagaattgcttgaacctgggaggcagaggttgcagtgagccaagatcgtaccactgcacttcagcctgggtgacagaatgagaccctgtctttaaaaaaaagaagaagaagaagaaaaaagaaactgccaagactggttcccaggaacagaggacttggaattggtttcccatccatgggtttaacacagtgttgagctctttgtcagtgggaaatcagattcctgtaatccagggcaggccatggcattgtgactaaaaaagccatcatctgtgcctgtgatgacatttgtgtgccagggcccacatggccactgcactggccactgaggcagaagccaggaccaaaggactcagtatgacagcattctgtgagtgcgctggggcctctgagaaaacctcaagcccaggtctgggacctgcacccacagacagagaacccaacaagcctctatggcagtccccagagagtctatttcttgtagctacagggctgtttccaaaatcaaacacaaagcataactctgcggggtgtggatgcacaggcggaattggtggcatcaccaggtttgatgggaaagctgggcatggatctggaaggagtgggaccctggcaccggacagagggacatctgactggactcagatgaagctgagattccagattcgggagttcctccgagcctcccatggcagtgggaacagctggctccccagtgtctgagaatcacctttctttactcgaaagcccagtgacaggctttcctagggcagacgcctagcgtgggcctctcaccctcccacccttgccaccccttgacctgtaactggggacaggtttccgcatgctgcaggggaggaaaccacttatatgcaaaacaaactgtgagatcttgccatttcacagctgcagaaaccgaagaagtatgtatgggaataggtgctagtaacgttaggacaaagacgagaaatttaacactagtttggtgggactgattgctatgagtggtcttatgagaaattgttcattaacattttgtgcacgcagccggcagtggctctaaccgctcacttggttgactgcctgaagtgcagggcactgctgagtccgtgtttaatgaggctgagatgccaggcttctgtggcacagtgaactatacaggaggaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggctgcggcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacaccccagaacggcctgaaacactggagacacccctccaatgggagcttcaagttgtcactccacactccacctgccactgcaaccaccaggcaggtgttttggaggcaacatgcaccacatgtgtacgtgctactctgacaccggtactgagtgacactaaaagctgttttcagagaggcccagggcacgatcaggcatgtggcaagtccaggctgctcttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccaaacaagctagccacgagatgcggagaccatgcaacctgagctccccatcacgaacagggaactactaggccccccaagccgaatgctgagcatgcacagcgaccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggctggcccctgctggcactgcacagtgtggctcttgaggacagtggggattacatcccccagcaggcagacctcccagttggacatttgatttccactttatcaggactgagatggccaggacatatctacatggatccccagggtgattccagtattaaaccgaggggaatctcatggaacccaactgcagggagtccagtcggcctctcaagagaccgaagatggaagcagaaaagccaagcccgagactgctcttccccctcattctggtggcacaccctcgcattctgctctcctctcattggctctgttctactcctgtctgcgcacactctttcagcttccctgcaagtggctcgccttggtccctagagcagttacggctctgatgacgtcgtatcctcagagtaacgtggtcattttgagtactgttctgcagcttactttttcttttcctaatcaatgaatcaatgaatatactcttgacaaacattttctccattatgcagtattctattatatgcctatgcgaggatttatttaactggtctcttaggttgttttgggtacgcggctattttgtttgctttcttagctcttgagggtgtgtcaatggctattactgcagcctgtgtctagaaaatactcaaatcaccccttttcaaatacatctttttaccttgacttaaccaatgccaaacaactctctccccctatttccatggtaatgcatctcagctcctctcaacttagaggctcacaggataaacggcttcccggagatgatgctcacagctcctcttaattacggaagtgatatttactggatcagtcaccttggacatccataaggcattgcatttttcatgtattactcacttgactttctctagggtttagccaaaatgagtaatacatggaaagctgggtaaaagtcaaatcagctgttacttgttattattattttttgagagtcttgctttgttggagtcttgctctgtcatccaggctggagtgcagtggcacaatctcggctcactgcagcctccgcctcctgggttgaagcgaccctcccgcctcagcctcccgagtagctgggactacaggtgacttctaccacactcggctaattttaatttttgtattcttaacagagacggggtttcaccatgttggccagggtggtcttgaactcctaacctcaagtgatctgcccgccttggcctcccaaagcgctggaattacaggtttgagccactgtgcccggcctactgtcgcttatttttaagttggtagaaatgccggtggtcagaaaatctggtattttaaaaagtaaaccttctgggggatgggcgtgaggctgaaataggttgagccagtagttcctttattttgggaattcagaacttctcattattttgttattgaaacatgtagtcacagttctcgagaccgcatctcttaaaacaactgcctactgttttccctactataagattgtatttggatgcttccttctttgtgtcaaataatcaagaatcttagggttttaaaagtgactctgaaggttacctggtccaaagtgaactcagcaaagaacataaagccaatttgcaaaaatcaattgtatttccatacgttaacaagaaacaattggaaaatgaaattaaacaaaagcaaagtcatttttggtcatcctgtaagtcctgggtggcaggcacagaatacaggtaaggggctccaagagcccggggagccctctgaggacgcacggcaggtgtggggcatgggaacagaagcaggccacacctgggggtccctggggaggtctaaagggcctggtggagcaggaagagcctggaaggatcatctaaggcagggctatgggagggggtggatacactccagggcacctttcagctggtgctcccgaaggctcaggctgaggcagcccttccagggcccttgctgggtgtcttcccctgccctgctcttcctctgatcccttcatgcttcctcctgggagtgcatccttcataaacccatgaattcttggtttagcatttacttctgaggaactcgactgaggacaatcctacttggaaaatatttatgtagaaacaatacactaaatgtatacgcacagatatgtgtgtagacacccatttgattacactgaatgtagtttgatcacggtattgagtatattatttaggactttttgtatgtgattataagttacattgatataaagtaagttgcaatacgcataattttaataccaaaatgttaagattcaaattttctgggaaaagagatcggtaaggttcttctttcaaaagattgcccatttttgtgattttcttcttttttaccaatattatttcaaatttatcatatgttctactaaataactaagaaagaccatgaggatatactgagcgaggccatacagtttaataatgaacagcttaggttctaacacacattagacaggcctgtgttcaaaaccccatcttgtactagctctgtggattaggtccttaaattccacaacaacttgtggactaagctttctttttcttttttttttgagatggagtctcactctgttgccaagctggagtgcagtggcacaagctcggctcactgcaacctctgcctcctgggttcaagcgactctcctgtctcagggtcctgagtagctgggactacaggcatgcaccaccacacccggttaattttgtatttttagtacagatggtgtttcatcacgttggccaggctggtctccaactcccaacctcaggtaatctgccagcctcggcctcccaaagtgctgggattacagacgtgagccactgcacctggccaaagctttctgacttaagttcttaaactctataatttgagcttccctgtctttaggaagaagacagtaatagcacatttcttataaggttgccaagatgttgagaattcagataaaacctcagcacagtgcccgatagtgcaaaggactcaataaacgtttgctggcattgctggttttaaattactgtataaagtagtagccatccaaaaaataccaaaaaattcatgaaaatggagtacacttacttgtaatgtagtatcaaagacaacaagctttgaactggttggaacgatgtcataacacttgtgtgacctcatgaatcgcatgtaaacaccactttctgagtcttctactgctaaaagaaaaaaaggcaaaacatcagtaataataaagaattccctcaatcggatgaagagcatatacgtaaacctatcactaacagacttaatggtaaaatacgaaatgttttcccagtatgatcaagggccaggcaaggatgctcactctcactaattctatgaacactatattggaggtcccagatggtgaaataaggcaagagaaaaaaatgaaaggcatacatgttgaaaaggaaaaagcaaaactgtctttatgtgcacactgtatgattttctacataggaaataccaaagaatctagaaaaagttcctagatctaaaaagaatgagtttagcagggtcatagaattaaatcagggttaataaaacaaagacaaagctaatcgaatggggaaaagttggaagctttcccttcaagatctggaacaaggccaggtgcattggctcacacctgtaatcccagaactctgggaggctgaggtggaagggtcacttgagcccaggagttcgagaccagcctgggtggcatagcaagacccagtttctacaaaactaataaaataaaataaaaataaaaataaaggggaaaaaaaagaccaggaacaagacaagaatgcctgctgttgctactctgttcaaggtagtactggaagtccttgtcagagcagtcaggcaagacaaagaaataaaaggcatccaaatatggaaacaaggaagttaaattgtccctgtttgcagatgacataatcttatatatggaaaaccctaatgactccatcaagaaactgtcaaaactaataaattcagtaaagttacaagatataaactcaacataaaaaatcagtagcatttctatacactaatagacaactatccgaaatagaaataataaaagaatcccatttacaatagctacaaaaaaacaaaatactcaggaattaatttaactcaggaggtgaaagacctctagagtgaaaactataaaacactgatgaaagaattgaagcagaccaggtgtggtagcacgcgcctgtaatcctagcactttgggaggctgaggcaggcagatcacctgaggtcaggagtttgagaccagcctggccaatatggagaaaccccgtctctactaaaaatacaaaaattagctgggcatggtggcacaggcctgtaatcccagcttctcaggaggctgaggcacgagaattgcttgaacctgggaggcggaggttgtagtgggctgagattgcggcactgcactccagctttggttacaaagtgagactgtcaaaaaaataaataaaaataaaaaaaaagaggaagaattgaagaagatacaaataaaagggaagatatcttgtgttcatggattggaagaatattgttaaaatgaccacactatccactgtgatctacagattcaatgcaatgcctatcaaaataccaattcttcgcaggacaagaaaaaaaaaatcctaacatttgtatagaaccacaaaggaccccaaatagccaaaagaattttgagcaaaaagaacaaagctgaagatatcacactacctgacttcaaaatgtactacaaagctataataaccaaaacagcatgaagctggcataaaaacagacacacagacaaagagaattagaaagcccagaaataaatccacacattacagccaaatgatttttgacaaaggttccaagaatacacaccgggcaaagggtggtctcttccataaatggtgctggaaaacctagatatccacatgcagaaaaatgaagctggactcctatctctcatcagatacaaaaatcaatggaaaatagattagagactgaaaatctacgacccaaactacgaaactactagaagaaaacataggggaaatgcttcatgactttggtctgggcaaatattttatggataaagcctcaaaagcacatggaacaaaagcaaaaatggacaaatgggattatatcaaactaaaaagcttctatcctgcaaaggaaataatcaacagagtgaagagacaacctacagaatgagagaaaatatttgcaaactatacatctgataaagggttaatatccaaaacagattaggaactcaaacaactcaacagcaggaaaaaaaccccaaataatctgattaaaaaatgggcaaaagaactgaatacacatttctcaaagaagacatacaaatggccaacaggtatatgaaaaaatgtccaccatcgctagtcactggagaaatgcaaatcaaaaccacaatgagatatcacctcactccagttagaatggctattataaacaaaacaaaacaaaacaaaagatgagtgttgctgaggatgtggacaaaagggagcccccccccccgctcttttattgaactattggtgggaatgaaatataaattagtagagccattatagaaaacagtacagaggttcctcaaaaaattaaaaatagaattaccctatgatccagcaatcccactaccgggtatatacccaaaggaaatgaaatcagagtgttcatgacacatgtgcactgccatgttgagtgcagcactattcacaacagccaagacatggaatccacctaagtgtcgccaaaagatgaatggataaagaaacgtggtacctataaacaatggagtactattcaaccataaaaaagaatgaaatcctgacatctgtgagcacaggatgaacctagaggacactgtgttacatgaaataagccaggcgtggaaagacaaataccatcccattcatctgtggaatctaaacaagctgatctcacaggagtagaaagtagagagtggttaccagaggctggggagggaatggggtgggggtatgaggagaggttggtcagttacagtcagacaggaggaatgcattctggtgttctattgcacagtggggtgactatagttaacaataacgtattgtatagttcaaaatagctagaagggaggattttgaatgttcctgccataaagaaatgatacgtgttttaggtgacagatatactaattatcctgattttatcagtacacaatatatacatgtactaaaacatcaaactgtatcccataaatatgtacaattatgtgtcaaccaaaaataaaacttaaaaaaaggaaaaaagtacaataaagcaaatgcaaatagaaaaaaaaggctactatatttgtatctactaactcattgttagcagacagaaatttaaaaaaattttaaaggtactatttacataaatgctgtatggaaatacggacttacacagggaacagagagcactgaaaatggtaacaatgtggacaaatatacaaatgctttcaaaaattatttaaatctctctaaaagctaattgacaatttatttttttatgtattttttttttttgagacagagtttagctcttgttgcccaggctggagtgcagtggctagatcttggctcactgcaacctctgcctccaaggttcaagagattctcctgcctcagcctcccgagtagctgggattacaggtgcacaccatcacacctggctaatatttgtatttttagtagagacggggtttcaccatgttggccaggctggtcttgaactcctgacctcaggtgatcttgcatggctcggcctcccaaagtgctgggattacaggtgtgagccactgtgcccagccctaactgacaatttaaacaaaaataatgacaatgtattgtggggttgatagcacactgataaggaaaaggcaacaccgtccaaccaatcatggaaatctaggagtcacccttgccaatgtcctcttgtcaccctaaccaatttatcacaatgccttgattttgcaccccagaaccctcaaatccactcatttctctgcctccatggccaccccctacatatcctaacttcctcaccaatccttctgccccctgcatcttccacagctgtccacactgcatccaggaagattttgccagatgcaaatataatctaatccagatgctttagaataaaggcaaaacccttgaagtcacctagaacagcagtccctaggactggttttgtggaagacaatttttccactgggggtggtagtgggtggtttcaggatgaaactgttccacctcagatcatcaggcaccagattctcatcaggagcacacaacctagatccctcgtgggcacagttcaccatcgggtttggactcctatgagacactaaagctgtccctaatctgagaggatgcacagctcaggccataatgctggctcacccgccccttgcctcctgctgtgcagcccatttcctaacaggccagggaactgtactggttcatggccccaggattggggacccctgacctataagacctgggaggcctggcccccgcctacctccctgcctcttgtattaaacactcctgctccgtattttctccaaccccctatttttttccagtcctccatcagtgctctgctgtctcttccatggggcctgacactactgcttcctctgcctgaaatactttctccgtctgtttgtggcccagtgaactccttcattagaccttggctcaaggatatgactggtgagtcatggaacctgaatttgaacttgaagcctctggattccaaagctgtgttctcagccaagctgatccccctccttccctcggcccgccacaactgctttccccgttctgccgaaatccttccctattttcatgggtcagtccaaattatgccatctgcaagagacatccttgacagctccattcagcccacaccgatctgtgcattttaggaagatctggactacttgggaaatatctgagaagaaaaacatgtagtgtataagctaattagcaaaacaagtgttaaacaagtgatactaaccaagctctttggctgtggaaaggagccccacaattttgtatatttcctactgtggacatccatgcagctggtttgccaatttcatgacaaatgatgtggaccactctcaagtctattttcattctgacctctctttgggatattacaatttataatgcagagttttgtcactgcaactgcctcctggatatttctctctcaaatgtctccctcctgatgtggaataaattccagacgtctcctgtctcattcatgcatctccacatctggcttctccgcagccttatttcccagctcctggtttcatgtctaagcaaacggtctccctgtcagtctcctgtagcctttgacctctcccttcttgcccttgttcactcacttgccttaaacgtcctcctccttgacttttccttgttcaatttcaatccaacctcaacggacatcttttcccacaaaagaagtgaacgtctgagtgctcattacggaccaggtactgcaataaatcacctcacttaactgatgtgacaacctcgaggaatacagcttcattttttcattttacctctgaggaaaccgaggctaggagaagctgcgtcacttgccccaaatcagacggtgaagtagtgacccaagcgggatttgaagctctgtcccaggctccagtagctccttattaaactcacttccctcactcaacggtgcgctcatctgagcgcacctggggaggacccctgtgtcctgggccctgtcctggggttacccacagggggacacaatgaccggttatccaccctcaaagcttatgcatcagcccagggtgagcactggatcacctgagaacacacaggtgggtcaccaaccctgacctggaaagggtaaggaaatctaaaatgacttcttcccctgaacgccaacagcattttacttctgtctcatcagttattaccttctatctcgttaacagtgactgtgtatttctaatatttttttccttcctgggtgataatttatttgaatgatcagtatcttactcaagtaatccatacattaattcagtctataaatatttattgcatattgtctagtgtgcattcctcccaaagctgatcctgagaccatggaaagttaggggaggaaaaattcaaaagaaagggtgcccagtaagcaggttataccttcgtgaccctggagtgaagctatgagggaggatgctctgaggctgtacagacctcagaactgtctcgtgggaggaccactcctgccctgcctgggttccaggtaattcctgggacatcacccccgtcatttctacccacaagcccagttgccaaagaatgtcctggggcagagatgttgaaatatgagaacttggatgagacaggattctggtgaggcacccgcagcatccactgtgcgagaggcggggatgccgcagggaagacaacaaacacaacccttgtccttacagacactgcaaaccaatggaggggacagtgactgtcatcacactgccaccagcactaccaaggacaagctcggggttcgtgaatgaatagcagcggctgtcagggagggaacggatggacagatgaagtttcagttggtgtgctcccatgtttctcaaaacactgatagactagacagtgagggccctgcttaagaaaggcctgaaacagcaagctctcatgagagcggcacagagagatctggtccgtgtccgccatcgctgctaaggatgacgctcctcgcgcagccgcatgcgcagtctcctcatgcctactgagtgtggaattggcgcaaaacaaaagccaaagatcagggcagtcaagcatacattcagccagtatttaagttacaaattgcctgccaaatctaacatcctaaaattcaaaagcaagaaatcaagagggaggctaagtatagtaaaatgtaacaaaccatctcccagaaaggaaatctcagaagataattttgttcattcattaaatcaagaattttcataaaagaggtacacatattatagacatattatacatgttagtattactatatgaatatgtgaaataattgaaaataatatagggcaggaatgttcaaacttacagaatttttgaaaatctgtaagtttggtgttagattatatttttaatataccattttaatgtgttgatttctaaattatttcaatgaacattgtattttgaataaatatatgttccagatttacaaaaaagttgcaaagctggaacagttcctatatactccatatcaggttcccccaagtttatcatcttacgttattgatatggtttggcttcgtgtccccacccaaatctcatcttgaattgtagttcccataatccccacgtgccaagggcaggacctgctgggaggtgattggatcatgggggcagtttcctccatgctgttcttgtgatagtgcctgagttttcaggagatctgagagttttataaggcagttttctctgccctcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggagggacacgctccatcctcaccgcacacggagggacacgctccgtcctcaccgcacacggaggcacccgctccgtcctcaccgcacacggagggacacgctccgtcctcaccgcacacggaggcacccgctccgtcctcaccgcacacggagggacacgctccgtcctcaccgcacacggagggacacgctccgtcctcaccgcacacggagggacccgctccgtcctcatcatcatactgagggtacacatgccttctcatcccatcctatccagggtgcctaaaatcaacgtgactcatcaccttaatcacctgagtgaagtcatatttgtcaggtttctccaagtagaggtactctttccctcctcctttatgtactgtaatctttttaagaaggtcactaggacccctcacttaatggcaaggagttatgccctacctccttgtttaaaataattatgtacaggagagttatttatttatctgatcatttattcatatcagtgtagactcatggatatttacttcaacctaggtataatccaatcctaggttaggagcggtcagaggctgtgccccagccagtcaggcacccacctgtggctgatggactggtgggtggcttgtggagccctctcctagttaagacagtttccaagcctgccatggcttagactttctggcaggtcctccagcactgccttcacacacaggcagccccctagttggctggggagctgtgggagtgtggcttggtgctccctgcgtgggcttcctccgtcatccagggaggtgtgcagagctgggctctcctgcctctgtcctgcatgcacacagcctccagggcagctggaaatgtgtttccccatcatcaacatcttgcattagcatggtgcagcggttatagttaagcagccaagaaaatcataatgaatgtgtctaggtacagtggctcccacctgtaattccagcactttgggaggccgaggcaggaggagccctggaggctaggagtttgagaccagcctgggcaacatagtgagatcccgtttctacaaaacataaaaaaaattagccaggtgtggtggtgcacacctatggccccagcctactcaggaggctgaggtgggagggtctcttgagccaggaggttgaggctgcagtgagctgtgattgtgctactgccctccagcctgggtgacagagcaagactctgtcacacacacatacacacacacatacacacacaccccaacaatgtattaacaaaagtctccacattattcagatttccttattttttccttaatgccctgtgtctgtctcacgatcccgtccaggattccacatgatggtcgggagcatctcctcgggctcctcctggctgcgacagtttctcagaccctccttgttgtgatggccttggaagctttgaagttctgatgaggcactttggaggatgcccattggctggaagaggtctcatgcttttctcaagattagaacctctgtaactgggttccaggtttgggggaggatctacgacattttttaaaaatataaagcactcgaccaaacaaagtaacatgttaaatatttacttatttatttattttggagacagggtctcgctctgtcacccaggctggagtgcagtggcacaatctcaactcatcgcaacctccacctccagggttcaagcaattcttgttcctcagcctcctgagtagcttggattataggtgtgggaaaacaagcctggctaatccttgtatttttagtagagacggggtttcaccatgttggccaggctggtctcaaactcctgacctcaagtgatctgcctgcctgagcctcccaaagtgctgggattacaggtgtgagccatcacacccagccgtaaaaggttaaatatttaaaataaattataataaaccctctttgaatgtgtaaaaccagttaaaaataattttaaaaacaaaaataaaatttataataaaatttctttaaaaaatttttttaaattaaattttatggctgggtgcagtggctcacgcctgtaatcccagcactttgggaggccaaggcgggtggattgcttgagaggccaggagtttgagactatcctgggcaacatggcgaaaccccgtctctactaaaaatacaaaaattagctgtgcatagtggtgcatgcctgtaatcccagctacttggcaggctgaggcacaagaattgcttcaggccaggtgcagtggctcacacctgtaatcccagcactttgggaggccgaggtgggtggatcacaaggtcatgagatcgagaccatcctagccaacatggtgaaaccctgtctctactaaaaatagaaaaattagcctggcatgatagcacgcacctgtaatcccagccacacaggaggctgaggcagaagaatcgcttgaaccctggaggcggaggttgcagtgaactgagattgtgccactgcactccagcctggcgacagagcgagactccgtctcaaaaaaaaaaaaaaaaaaaagaattgcttcaacccaggacatggaggttgcagtgagctgagattgtgctactacactccagcctggggaacagaatggtactctgcctcaaaaaaagaaaaataataattaattttaaatagagatgaggtcttactatgttgcccaagctggtctcaaactcccaggctcaagtgatccacctgccttggcttcccaaacttctgggattacaggcgtgagccacctacaaattataataaaatttctgttgagtgggaataaggacagattattactgatgtaataaaacaacatcaatcacaacaaaagtataagctttttaagctaggaaaatacagtaaaatataaaacgttcctttttaatgtcgcttttctacttttagtataaactttacgattataggtggcaccatctgtgttagttacattatggtgaagtctcacattgtacttggaggaagaaataaattgaaacagagtgaaaatgagtgtaatttggagttatacaacaacaacaacaaaacccacccaaattgttcaacaacaggctgtttaaaatatattatcaaaattccttggccgcgtgcggtggctcacgcctgtaatcccagcattttgggaggctgagctgggtggatcacctgaggtcaggaattcgagaccagcctgggcaacatggtgaatccccatctctatgaaaaatacaaaaatcagccgggcgtggtgacatgtgcctgtaatcccagctacctgggaggctgaggtagaggaacggctggaacccgggaggtggaggctgcagtgagccgagatcctaccactgcactccagtctgtgcaacagagcaagactccgtctcaaaaaaataaataaaataaaataaattatcaaaattcctgagagggcaagaagttccaactccatattcaaaagctaactgaggttaagatattaacacaatgctcccttcttgcttttgatattttcagtgttataggatagaagcataattacagagtatcacactgggacttgagttactgctctacaaaaggaagaaacctgtttgcagactgatgttaaatctcactactctttaaacagatgccaacccaacattattatgcaagggagttgctaaagaagaatatgagtaagtagcaagtttatattaaagtgtttaattcataaaggttaataacaaacttttacaaatgcaacatctaagtttaaatgcaagcaattataaacactaaattgaaatattggaagtatttctcctattaaaaacaaatctgattacataatatgcttgtttggtacctttgtttgtttttttgagacagggtctcactctgccacccaggatggactgcagtggtgcgatcatggctcactgcagccttgaactctcaggctcaagcaatcctagcagctgagactacagatgcctgccattacatctggctaacttttttattctgtatttttttttttgtagtgatggggtctcactatgttgaccaggctggtcttgcacttttggcctcaagcctcagccttccaaagcactgtggttataagcatgagtcactgtgcctggctgctcgtgtcctccctacctacacaatataccctgtatcattcaaggttctagaactcgaactctaacctacctttccagcctcatctcctatcacatcccctaggaatctcatctctaggatcatttcaacatatccttttcaaaggaagggtttgaactttgggaaatccagttttgagaatgcgttcctcatgcttctgttctgtgcctctgcacacactattctttcttcctcaacagtgccttccctgttctcctatggtcacctgacatcctgcttgcctttctgcagtgggctgaacagtggcctccgcaaaaagacaggtccactggaaacatcagaatgagaccttatttgcaataagggtctctgcagatgtaactaaggtgaggatctggagatgaggttatcccggattagggtgggccctaaatccaatgacaagtgtccttataagagagagagagaagatgcagcgcggcacggaggggagggccacgtgaagacaggtggaggctggggcgacgcagcgacaagccaaggatgccaaggactgccggcaacagcaggagctgagggcagcgtggggcggattctccctcagcctccagaaggaaccacccctgctgaggacttaggaaccaaccctgctgatgacttactccagacttctggcctccagaactacaaggaaataaacttctgttgtctaagccaccaagttgtggcatcctgggaaactaataggccttcaaagttcagttcaaaggctacttcctcccataaaaccttccctttgagcccctcaggtcggaattaactgctccagttttgacatgcctgttaatgcttcgtgagtcacacacaccttgtactgaagttacaggtctgttcttcccttagacatgcgcaccggggggcagcagtggacgtcccttgctcttctctataatccaggcccctggaaggttcattgtagatatcaggcatgagttaatgcctggtatcttgcaagtcactgaagaagcacagatcaaatttgagaggggcaagtacggatctgagatgactatattgtgttcctgacctcagagaggaaatgtcagcaaatgaagcacgcaggtttaaaagaacactggtgaatctagatttaataaccagtataaaaaaacaaaacaaaacaaaaacctttatatacctttataagattaaaggattacctttatattcctttataagattaaaggattagacatggatttttttttttgtaagagaaataatgcacctatgaaagtgcctcatgtgatttttttctctttctttctttcttttttgttcaagatggggtcgcacactatgttgcccagcctggcctcaaactccttggttcaagggattctcccacctcagcctcccacatagctgggactataggcatacaccactgcaatttttgtttttttaagtgaaacagcattgatctaaataaagctttaacatgtttacaagtatattttatattgaagctattttctaattctattagacaaaaaaatgcagttgaattgaataagattgcagaagaccttcaaatgttcattctaccatacacattttaaaaacacctgcaaatacagcaaacaactggacaagtatgtttcagagataagcactacagtcatcaattactttttctgaaacccatttacacagaattttaatttagaaagaatttatataaaaaaaatgtgttgtaagacggtgtaattctttggtcttcttggccttaattctatgaaaatgaacaagacagactatcactaatcatttattagtcaggcaaaaatactaaaggataatttaacagacacataccagtatgaaattcattttacttatacaccttaatcaaactaagagcaggatagtgactcaaaatggatttcaacgtgtcctatttataaaaataacaactgctaaaataatccactactaaccagacagttaccatcaatctgcccgtcccaggttctctccccactgatactggcaacacccacacagtgagggaatagacgccccgagaagcagagcgtgaggactcacttcccaccctcaagttccacacttcttttggtccagtcctggaactcttgtttagtctagaaggaggattgtcccatcactcctgggaatggttactccaatttcagaaggggttggcctcaactagaaaaggaagcttctaacgtgagaagaaaagaagaccttctgagaaaacagtccaggcttagcggttccgtgcccaccatttggggctccctcaccacacgatctgggtgactgactgcagacacacctctcctgccatgagcagcacgaacttgctgacctagtcctatcacctgtgtagctggctctaccccggaggctgccaacaccacctttatctcatgctccacattttaatatgtcaacatacacagggactgctgcttactttccagactataagaaccttagtgtggctcacatctgtaatcccagcactttcggaggccgaggtgggcggaacacgaggtcaggagatcgagaccatcctggctaacacggtgaaaccccgtctctactaaaaatacaaaaccaaaattatccgggcatggtggcgggtgcctgtagtcccagctacttgggagactgagacgggagaatggcgtcaacctgggaggcggagcttgcagcaagccgagattgcgccactgcactccagcctgggcgacagagcgagtcttcatttcaaaacaaacaaacaaacattttagtgtgggctgggcgcggtggcttacggctgtaatcccagcactttgggagaccgaggcaggcggatcacgaggtcaaaagattgagaccatcctgaccaacatggtgaaaccctgtgtcaactgaaaatacaaaaattagctgggcgtggtggtgcgcacctgtagtctcagctactctggaggctgaggcaggagaattgcttgaacccaggaggcagaagttgcagtgaactgatatcgcgccactgcactccagcctgggggacagagcgagactccatctcaaaaacaaaaaacaaaaaacaaagccttagtgtgttagcatattataaatattttttcttttctttttttttttttttttttgagatggagtcttgctctgtcacccaggctgcagtgcagtggtgcaattttgccttctcctgggagtggtgcaacctccatctcctgggtttaagtgattctcctgccttagcttcctgagtagctgggatttcaggcgcccacccccatgcctaactaatttttgtactttttttggtagagatggggtttcaccatgttggccaggctggttttgaacctctgaccgcaggtgatccgtccaccttggcctcccaaagtgctgggattacaggcgtgagccaccacacccagccaatattttcaattcaaagttgagaaaatggccacagggagctctaaataagtcattttttatattctctgcttttaagtcaaaagaaggaacagagaagagatgcgtgcagggtgggagcagagcacactggggtcagaatgccaaggaggacttccccatctggaacccacacacagagagcagcggagtgctgatcgatggttacacccctcggcatcttcctctctgtattctatacccattatgcgaagattttgtccacagaaccaccttcgtttactaagcaatgcttgctgcggtttcaaaggtgctcagatccagggcggtgcagcgcttgccagaggccgccctgttccaggatccgttcctcagcttcatgcttaattttgtaaccatcagtcttctagggacttggtgattcaagtgaaataaatcagtaagtgatgaggaaactgaaatatcaattaagtggtaaagagatggaggccaggttagtgagcacagactgagaaaggaatgatctgatccatgagtgaggcgtggatccagcagagccgagcccaccccatcccaccaggacaagtggcaggaaccgcagggaaagctggaaacacaacagctttcttagaaaagacgttggcgcacttacgtggggtggtccagatctcacactcatcatctcagacaacattaagatggtaaaaaagcagtctcgggccgggcacggtggcccatacctgtaatcccagcactttgggaggacgaggcgggcagattacttgaggtcaggagttcgagaccagtcaggccaacatgaaacctcagctaagatacaaaaattagctggacgtggtggtgcacacctgtggtcccagctactcgagagactgaggcttgagaatgtcttgaacctgggaggcggaggatgcagtgagctgagattgtgtcaccgcactccagcctggacgacacagtgagactccgtcagcaccaatgtgttactcccttcagcactttctgtgctcccttttgtgggaggacagcgacaccagcatcactaaaggagctgaattaaatgcagtgcttttgactttggacttacatgcagagagaaagaggagagttgagtaacatgctcagcctgtctctccccaggatgcccatcctctgctgaacctgcccgcaggtttgggagccgctgagtgcactgcagagtgagcgtcagctaccacagtcccttcttgcagggtgttcctagtttaatccttatctgtacttgtgaaatggaaggtttatgccttgctagagagcttttaggtataaggcttgtcaactctaaaatcacactgcagagacctgcagtgtgcctctcccctactgacccacacaggtaggggacagagttggaggccccaagcacagagccctgcctaggcaagacactgccactgctgctcactgtgaagcaacctggggaaccccctgcttccacctgttctgtcccatcagcaggcgtaggggctgctgccatggtctggttctgccccccatcactccaactctgtgcactgcctggcggttgtcaccagtccaggggtctgaccagcgtacccacctctgcctgctcaccttcatagtgcacagccccatttctaagatgatgctcagcgagtgaccgtctatgggaccattcccaaaggcacaggtgcatggggaaccccaagaaatagtgcaataacctgaagctgttaccagccctagacctggggtgaggaacagttacaaaacctggaaggagagagtttcaggtagagccagtccccttgggtggggcagcgaccttcattcgagcagtccagccaggtagcggcagcctcccaggatgagggagctacaggagtaaccacctgcctcctctgggggctcctcactggctaagctcaacaggaccccagaatacgggagcccagccgatgtgtcccacactcagcctccctggtgagaaagacaggtgaggcagggtgaaaatgggacctgggggcaaacaggagctacctgcggcactctaagactgggcagatggaagaaagacagttggggttgacgcagtatcttctacaataacgcctgaaataacttaaactttgttttcagaaattattatttgtaatagcaataaaaggcatgaacatgttttccaaaaataacaacagtgatatacacaggttgagcatcccaaatctgaaaacctgaaatctgaaatgctccaaaatccaaatttttttgagcatccatactacactcaagggaaaagctcatcagagcatttcagattttggatttttgaattaggaatgctcaactggtatgtatgatgcaaatactcaaaaatctgaaaaaatactaaatctgaaacattcccagtcccgagcattttggtttttattttatatatgtttgagatggagtctcgttctgtcacccaggctggagtgcagtggtaggatctaggctcactgcaacctctggcttctgggttcaagtgattctcctgactcagcctcccaagcagctgggattacaggcacccaccaccacgcctggctaatttttgtatttttagtagtgatggggtttcgccacgttggtcaggctggtcttgaactcctgacctcaggtgatctgcccagcttggcctcccaaagtgcttacaggtgtgagccactgtgcccggcagcagtcccaagcattttttttttttttttgagatggagtctcgctctgttgcccaggctggagtgcagtggacgatctcggctcactgcaacctctatctcccgggttcaagcgattctcctgcctcagcctcccaagtagctgggattacaggcgcacaccaccacccctggctaagtttcatatttttggtagagacaggctttcgctatgttggtcaggctggtctcgaacttctgacctcaggtgatccaccttacctccaactcagacacccccgctccagtgaccaactctctggtctcactggagccgaccaggaggtgccccgttcccacggctatgctgagcgccccagccagcactccaacacggcctgtcaggggaggtgacgctgtctccagctgtgtcttgaaggcaggaaaagggattccaggcagaggcctgagcccctcagatctgagggtatcctcaggagctcgcaggggacatggggcaggggctggcaccccatggcgatgggggagcagcagcagggtggcagggaggccatggggtcggttacgttgggcgcttggcatgtgctctgtactactttatcctggaggtgaccagaagccacacaggggctcacacaggaggctgaaaaaatcagggctgcgtggacgctcagtcagaggagaaaagaggcagagcagtcagtggacgtctctgagaccctgctccctccatcgtgactctccgtcccatccctgcgtgctctccttcacctccgcccctcaccagcttgcttcccgctctctctccccatctccacttgaccttgtggtggttcactccactccactgcctttctttcagagcaaacagctcgcagtgatgatctgtggccctaagcccactttgccaggaccgctccagttcagcaccatggaatgggactccacctgggccttctgagtccccatcaccagcaaccacctggcactaatcacaatggcttttctgcaaactccttgccgaccactgatcacttggcactgggctctcagccccagtctcctcacctttacactggaacaaaagagcctcaaaggggccatgtggatccagagggaacctcgagagaggagccgtgtggatctagagggaacctcgagagaggagccgtatggatccagagggaacctcgagagaggagccgtgtggatccagagggaaccccgagacagaagccgtgtggatccagagggaacctcgagacagaagccgtgtggatccagagggaacccccagagaggagctgtgcagatccagagagaaccccgagaaaggagctgttttttgttcctgcattagtttgctaaagacaatggcttccagctccacccatgttcctggaaagggcatgatctcattcttttttatgcctatatagtattccatggtgtatatgtaccacattttctttatccaatccaccactgatgggcatttagtttgattccatgtctttgctattgtgaatagtgctgcaatggacatacacatgcatgtgcctttatggtagaacaatttatattcctttgggtatccacccggtaatgggattgctaggtcaaatggcaggattaaagacttaaatgtaaaattgaaaattataataacctggaagatgacctaggaaataccattctggacatacaaatgggcacagatttcgtgatgaagatgccaaaagcaattgcaacaaaggcaaaaattgacaagtgggatctaagtaaacttaagagcttctgcacggcaaaataaactatcaacagagtgaagagacaacctacagaatgggagaaaatatttacaaaggatgcatccaacaaaggtccaatatccaggatcaataaggaacttaaacaaattgacaagaaaaaatcaaacaacccaattaaaaagtgggcaaaggacatgaatggacatttttcaaaagaagacatacacatggctaacaagaatatgaaaaaaagctcaacactactgctcattagagaaatgcaaatcaaaacccttgattctctaatgatgttgctgcaccttcaacaccactgggaactctgcctgctgcaagccaaatgccctggtctaccatttgcacaccggcagtataaacacaaagcatgattagagcctctgtgtacagaagagagtaactgctcacccacaccagctcctgtagttgtggggccctgacttagtcaattactgacgtcctccttggcaagcaaattttgccactggtcagagggttcattttaacagtgctgtgggtggtgggggcgtgaagcaaaggcggaatgcatgtgtgccttggagggtgcagtggcttctcctcagggtgggcttttggagctgctgtccagctaccaccagagagaggctctgcttggccaggcaggcaacgagggcgggaggaagcaggtgcacatgcatgcacacatgcacatatgcacacaggcacacacacacatgcacacacactcatacacctgataccaagttaaacccctctctcttttatcacgaccactgactattatattttaaaacacatattcaagggaaaatagtggataggaagcaggactggaatgcagctcccactcagacggacagagcagcgtgtggcaacttgcatcatgaacctgtcttccagaactactgcaggaataggccaggaaagctgagagaatccacagacccttgaagaaggcagattgcttctgcaggacccaggagacacaccaaacactgccccgtggcaggctggtccccgccctgcaggagtgtttggactgtgcagtgtgataagcactgtgggtgaagtactgcaaagtgctaaaggaacatacacaggaggagccagaggagccttcacggccaaggggatgtgagctggatcctgaaagaagaagtgtttgagagagaagagaagaagaaacattctaggaagacgtaatagcatatacaaagacagaggtcccaaagaacatggcatgtttgaaaaatgatgtagccgtatcttagcctgaaacagctggagtctagcactcatgggatatggctggagatgcgacaggaaagttactcaggaccagatcgccaagggcctttagaaacgcacactactaggccgggcgcgggggctcacgcctcaaatcccagcactttgggaggccgaggttggcagatcgcctgaggtcaagagtacaagaccagcctgaccaacgtggagaaaccctgtctctactaaaagaatacaaaattagccgggcttggtggtgggtgcctgtaatccaagctatttggggaggctgaggtaggagaatcacttgaacctggaggcggaggttgcagtgagccaagatcacgctgttgcactccagtctggcaacaagagcaagggaaggagcgagggaaggagggagggagggaaagagggagggggggagggagggagggagagagggagggcacattgcttcgtgtagcaccaaggcgtcactagacccgggattcacctgcaaataatccgagtgtggggaagtgggtgagggtgttgatgaaacaaggctgtctcaggaattgatgcattgaaggtggatggtggctatttggaatgcattgaaccattctctctaccatttcatatgtttggaaattttcataatacaattttgaaacaaaaaatatcatcatcttatgcaaggacattctttgttgttacataatattagaatacttttattattgttgttaatagcattgttgagtttttttaaaataatcatgttaacagaaaaaaacccccatattcattaatcacaggtcatagtaacatattcaaaacttgtcttaaagactaagtgtataagaatgaaatgcattttaaaacaaaatttacactgtcccaaacttcacttaaaaactccccaaaccgaaaaaaaccctgactccttattcacaattttaacttaatatgctgaatttcattataattccacaaaaaattatcagtgttaaaatgtatcttttatactttattctgcatttagaaatacaagtttactatatttatatagtgttttctctttttagaaaactgttaaaaaatatctgagtaagaaataagcaaagaagaggaatgtgacagtcaaaagtatatggaagagaaaaaattaaactcataagttggctgggtgcggtggctcatggctgtaatcctagtactttgagaggcaaagatgggagaatcgcttgagctcaggagttcaagaccagcctaggcaacacagtaaaacctcatctctatttaaaaaaataaggtcgggcgtggtggctcatgcctgtaattccaacactttgggaggccgaggcaggcagatcacttgaggtcaggagttcgagatcagcctggccaacatggcgaaaccccatctctactaaaagtacaaaaattagccgggcatggtggtgggtgcctgtaatcccagctactcaggagcctgaggcaggagaatcgcttgaaccgaggaggcggaggctgcagtcagccgagatcatgccactgcactctagcctgggcaataagagcaagactccgtctcaaaataaaataaaataaaataaaataggccgggtgtggtggtggctcatgcctgtaatcccagcactttgggaggccgaagcaggtgggtcatttgaggtcgggagtttgaaaccagcctggtcaacatggtgaaaccccgtctctactaaaaatacaaaaatcagccaggcatggtggtgggcacctgtaatcccagctacttgggaggctgaggcaggagaattgcttgaacctaggaggcggggtttgcagtgagctgagatcgcaccattgcactctagcctggacgacagagagagattccgtctcaaaaaataaaataaaataaaaacccctaagtttttctaaagtgcctagaaacatgaacagaaacaaaggcaaatcttaaacataattttacaggatttacaattataaggtggcagaataaatgaagtctgttactttttttcccctttccatgctttttgcatttggttttgtgtgtgggggcaaatgtgtacacgggcgagaaaatgcacacactcttctaaataagggggcagtaaaagagttattaggaaagaagaaaaagcacaggcaggatcaaggcagagtttgcccaattagttcaaagtgagttgcaatcgatgcctaaggaaagtcacggacaaagcaatgaccttgaaattgtatgtggctcctgtcagaattttaaaatggttttgcatagaattctaggaactattaatacataattaaagcatctaccacagccaatgattcctttctcagggaagaaaacccagtgatgaagctggagaacggtgatggccaaggagagctcacagggatgaagcagcaagcaccagccaggccagaagagtgagacccaccttggcaggtacagtggagcatccataatccaaaaacgtaaaatcccaaatgctccaaaatgcaaaactttccgagtgccaacacaatgccataagttaccctgaacacatcggtttttcactgtatttatcagtagcatagaaatacagagtcaggaacgatggtgatgccagactgtccacaagggtggctgagacagtggcacctttgctttctgatggttcaatctgtacaaactttgtttcatgcacaaagttattaaaaaattgtataaaataacttcagactatgtatataaggtatatatgaaacatgaatttcgtgtttaaaattgagtcctcatccccaagatatctcattatgtatatgcaaatattccaaaatctgaaaaaaatcagaaaaccggctagacgcggtggctcatgcctgtgaaatcctagcactttggaggggccgaggtgggaggatcacctgaggtcaggagttcaagaccagcctggccaacatggcgaaaccccatctctactaaaaatacaaaaattagctgggcatggtggcgcatgcctgtaatcccagctactcgggaggctgaggcaggagaatcacttgaatccaggaggcagaggttgcagtgagccgagatcgcgccactgtactctagcctgggtgacagagcgagactccgtctcaaaaataaaaaataaaaataaaaataaaaataaataaataaatcagaaaacctaaacatttccagttccacgcatttgggagactcaacctgcaccaggaattatacagctgctgcccccgctggctgtcatgaggtatacttttagctacttaaagaagtttcctcatatccctggtttattaacgatttttaaaaaggaacatatgttgaattttattaattgctatttcagtatctactgagatgactaccagtttctctcctttatcaacaacattaattccttaggcaatttcttctttttctttctctctctcattctttctttctttctttagagataggatcacattatgttgcccagactggcctcaaactcctgggctcaagagatcctcctaccatggcctcccaagaagctgggactagatttctcaatagatggctttgtttttttgttttgttttttttttgagataaggtctcactctgttgcccaggctagagtgcagtggcatgatcactgctcactgcaacctcaaatggccaggctcaagcaatcctcctgtctcagcctcctgagtggctgggactacaggcatccgctaccatacctggctaattttttttattgtttgtagagatgggagtctcgctatgttgtccaggctggtcttgaactcctggcttcaagtgatccttccaccttggcctcccaaagtgttgggattacaggtgttagccaccacatccagctccttaatagattaaaaaaatttttttttaattaaaaaaattaaagatggggttttgtcatgttgcccaggttggtctcgaactcctgggctcaagtgattcacccaccttggcttcccaaaggcctgggattacccgatccacccatcttgacttcccaaagggctgggattacctgagccgcccaccttggcctcccaaaggcctgggattaccggcaagagctaccttgcccagcctagatttcttaatcaacagaagaatacttgcatttctaagataaaccttacttgaccacaatatattcggcttttaatcctgcatagctagtgtttgtttaggagctttggccacattttaaatgtaagactgatcgcttgttttcttctttgtgtgctatcttcctctggctttgatttcaagatcaagctagccttacggaaggagctgggaagtgctccatattttcctatgttctaaaataatttaaataaggcattaactgttcctgaaaagttttacagaattcatccataaacaggctgaatagaatggtatgctcttctgtagcagaagaggaataagacctttcattatcttatttaaaaaatagctttgttggggctgggtgcaatagctcacgcctgtaatctcagcacttcgggaggctgatgtggaaggatggcttgagcctaggagttgcagaccaacctgggtgacagagtgagaccctgtcacaaaacaaaacaaaacaaaacaaaaaaccaacaaaaatagtttgagatataattcacattcacaggttcgccaatttaaagtgtaccatctctgttgcccaggctggagtgcagtggtgtgatcctggctctctgccacctccacctcccaggctcaagcaatcctcctatctcagcctcccaagtagttgggaccacaggcgtgcaccaccacacccggatagtttttgtattttttttgttgagatggggtttcgccatggtgcccaggctggtcttgaactgctgggctcaagggatcctcccacttcagtctcccgaagtgctgggattacaggcgtgaaccaccatgcccggccggtgtgctttgatcaacgttacttttaaagatctctgcatttatagttaagaagcttctcttctttctaaagctttgcattttctcccattttttcctgaacagacttgacaaaggtttatccactttactgacttatccaagaactaagtttttgtttttattaagcatgactacctttgtagttgatttcactgatctatgtcatttcagtagactttaggagggaagagaggtaagtgaatatattcagcaaaccgctgagtcacaagagtggcagagcaatttggtgaattcattctgatgaattcaagatgggcacttcatccaagtccccgcaagtgtcctgaagtttgagactctgacaaaaggctatcctaactcacaatgaaacactggagtttcgcagagattacacatacgtccataaatgtgtgcacctctttggggttttgcaatataatggatctttctgttgtgcgtcctctgacagtttctactatggcgtgccattgtttttacactgtgtgacagcactgacaagaattactactgcaaatcaaaacacaaaaaaaccattggcagagccattacaataagtcaccaatagaagatgtcaggtagcaagccagtgttcaccaatggggactactcaaggtactcccagttcaaatgggaggcaatggagaagacagaagcatctagaccaaccctaggtcagaattgttactgcctttcttgtgagcttgaacaaattgatacccttgagcctgaatttcttcatttgtaaaatggtgacacaccatctttcctgagagcatttctcaggaacagggataagcacaaacatccaatcgcaaaagctgccaactatatgtggcatacatacctgtgtccacatggggcaaagtctgacagtgcagaagaacagaatcgctggaatcactttaaatttttgctcggtttcttcttgtcttcctagtcatcatcgcagttactgctgatggagactgtactacatcccaggccctctaatgcagcggtccccatactacatcccaggccctctaatgcagtggtccccaacctttttgggagggaccagtttcatggaagacaatttttccatggatgggggagcagggggatggtttcagcatgaaattgttccacctcagatcatttggcatgagttagagtctcataaggaaggctgggcacggtggctcacgcctgtaatcccagcactttgggaggctgaggcaggcagatcacgaggtcaggagtttgagaccagcctggccaacatggtaaaaccccgtctctacaaaaatacaaaaattggttgggcatggtggcaagtgtctgtaatcccagttacttgagaggctgaggcaggagaatcgctggaacctgggaggtggagcttgcagtgagccgagattgcgccactgcactccagcctgggcaacagagcaagactctgtctcaaaaaaaaaaaaaaaaaaaaaaaaaaaagctcataaagagtgtgcaacctagatcccttgcttgtgcagttcacaatagggttcgcgctcctatgagaatctaatgctgctgttgatctgataggaggcggagctcgggaggtaatgctcgctcgcctgctgctcacctgccgtgtgggccgattcctaacagtagtggtctgtggctagggggttggggacccctgctctagtggatatcatgcccatgttatttaatccacatataatcctcctggctaggtactattattatttccaagttacatatgaagaaaccaaagctttaagaaacttactaaagttctcacagttattaagtagaagaaatgagactctaaggtgaatctgactcatgctcttaattgctatggctctaattacacatgcattaaaaaaaggggggttacatcgtatgtatgtataagcttcaaagctagagaagtcaacgtgaagactgagagccaaggaaagagggtaaataagcgtcttacaatgcgcatgtgtgtactggggaggaggtcttgacggaacaatgaaacattccacttccaagaaaatgtggaaaatgattcataaaataacaacttattgctagcaacttcctgtcagttacaaatgaccaaagtacaacctaaaataaaatgaatcagttagcatgatgttcagaaacctcattgatgttatataaattcagatacatgggaaacagctccaagtgggacagaaggcagcgtgtgtgtgtgtgtgtgtgtgtgtgtgtgtacatatatatatattttttttttcagataaggtcttgctctgttgccccagctagaatgcagtgatgccctcatggttcagcacagcctcaacctcctggactcaggaggcatgggactcacctcccatgtctggctaattttctgtattatttatttatttttatagagagagggtttcgccatgttgcccaggccgatctcgaactcctggactcaaatgatccatccaccttggcctcccaaagtgctgggattacggggtgagccacagcacccggccgtggcagcatattaaacagattaaaaagtgactaaaatttagccaaaaggttcccagactagttcccttcccccaaaatcgctcttcccttttcatatcagagatgaacctggctctgttccccctaaccttagcacaagtgtaatcacggccatgaaaggaaggtgtcaaggcgatttcctcggatgccagattccgcaggcgagccatcccactctacccacttgctactgccttcagttattcaactgcaaacgtcacaagccctgatgtcacccaccgtcgggtggagaagcctttcacacctccagggttcactcagtcatttcacttcctccgttgctccgccctcactgctctttgattagcgcaccatcaacatggcaaatgcaattcctctcatttctccaatgcctcaaatagaaatgccttatgtctttgtaagaaataacattgaccacctgaagtatggcaagcctaggtgccacagtaaaagcataagctccaaaatacatacgttcatttgtgtgacaaatgtttactgaaaaccaagtttcactcatcccagtggcctcaagacctggcaaatattaagatttcagtctccatcctcacagagcttacaatgtaatggcaaataaatgggaggggctactgggaaacacaaagaagtgcgtccccctaacagcacctatcaattgtgagggatcatgagatagcatgggaagtcttcatcggggcttctgggaaggcttccctgaggaagcgacatctaacctgagacttggagaaaacgagcaggtggccaaaggagaggaaggaatgattcaaggagcaggagctgtctgtgtaaagtctggcaggcctggaggagcaaggcagtttgaggaagctgatgaaggccagagtagctggagggaaatgcagggaggaaagaggcaccaggtgaggctggggagggaggagaagggggcaaggagggcgtgccgggaagtgcggactcctacaggcaaaggaaaagtaccggaggctttagaaatgaaagcgatgggattagaaatatgtttgaaggaaatatctccaacagcagcatggcaaattaattggagggggcagagcaggtgctgggagagcttggctgctggaacggtccataggaagatgacactggccgggagtgagggagagaggtgaacaagccggaagcagcagcaaggagctgttctcttggacctggagtcaagcagctttcctgttaaaacagctgggaggatgcgggcatttatggaatcaggctggttaaaaagaaagaaaacaaaccgaagaaggaaggggaaggaaggagatgggcacagagagatcagtgtcaggggaatctgagccgtggaggagggcacgacctccaggctgaaggcacaggatgagatgtaggcctcagacagggcagcgagaagcccatatccagtgctccaggagggaggggaatcgtatgggatgtgagttatatcacaggggtccgaagcatgggtaaggactcagcacagctggctgtggggttggagctgaacagctgtagggccaagaggccattcttcaacacatccaccaggaagcagagaaagttctgagatgggaggtcacatggccctagagcaatggccagaggtgctcaatgccctgggccctgatgactttccagctggttccagttacttgcgaagactggtgacgagtcccacttaccaatacccccgaatcctcccagcattgtcctctgcttaaactagtcagggatcttccggtgacaaaacctctatctactccaagacaacaaccctacctcaccaagtcggagacaccaccaaatgtgaagtcacgtcctgacttcagagatactgaaatgtgtacctagaccctacagaatagggcaatatgttacatatggcgccagctccagaggaacaactttaattacagggatttcatacaattgtaactactcataatccagaaacaataagtctcttatctacgaggagtgtgtgaactcagcagggaagggtagagtttggaaagcagataatcacccgagccttctcgtgccctaagtaatgatcgacaagtaccagactgtgcccacacacctgccactttgatatctccaccagcagaggtcagtgccccgcagtagagtcaagaaacctgcaagttgacgcttggctgtgagagtcaagggacaagggaataattcaatagatgaccacaaatacacagggaggcaattctcccttaagcaagttccagcagcttctaagccttgttttcattatactcccctccctgagtcttttttatacattctcccccaactgtcctacccccacgacattttaatagcacagatatactgtgtatttgttcatgtgccgtggccctttgggtggccaaaatccactgtaacagctgcaatttttttgtctcccaacaagaaccgatcttcacttactcagggtgttactcactccagttgagaatgaatgagttttgagtgaacacacatttttgttttgtttatttgtaaagagtgattattggttgctttggggtctgatttttaagcgagagagaaaaagcaaaagatcaccaagtgccggccccctggttttatagagaaaactcttaacgacagcaataacaacaaaacaaagcccggagaggcctcacgggttgtccaaggaaatacaggcccttcatcacagatctgggcctgaatcccgagatgcctcactgaaagacaatgctttctttccctcctacgaaaagtggcccctacttttacctattttgatcactgtaggtgaggctgaccagttttgctagaaacaagcaagattggctgggtgcagtggctcacacctataatcccagcactttgggaggccgaggcaggcagatcgcttgaggccaggagttcgagaccagcctgggcaccatggtgaaaccccatctctactaaaaatacaaaaattagccaggcatgctggtgcatgcctgtaatcctagctactcaggaggctgaggcatgagaattacttgagcctgggaggcagaggttgccgtgaaccgagattgtaccactgcactccagcctgggcaacagagcgagacaaaaataaaaagagagaaaaataaagcaagattgaggcacgttctggaaagaagattctatttcgttgttgtcattttgtttttgttttttggagacatgaaattactccaggctgaagtacagtggtgcaaccacatgcgctcgggtgatcctcccacctcagcctcccaagtagccggaaccacaggcgtgcaccaccatgcctagctaatttttaaaattttttataaagacggggtctcaccatgtttcccaggctggtcttgaactcctggccttaagcaatcttcctgcctctgcctcccaaagtgctgggattacaatggtgagccgccacgcccggcctggattctactttggaaaatctttgcaagtgaagaagaataggacagaatggctgaactgggatgaaataagcggcaaatgaggaggaagaggagagacagtcagtctggcaagacactctctgctaagaagcgggtaaaatcaccacagcaagttatcaaaaacttgaaagagcccagctcctccggcagctgggagagaatgcggaccgctctaaagaggctgcagacttcatgaagtggtaccagagtagagcaggtttattaatcacggataaaactgctgaataattacctacttcaaaaagcattcatgagttgtgtttaggtgcttacaaagtactttgtgcttggtcctggccagtaagttagttcaaggcagttaatatagataaacacaaacacagcaaagacgtggtcggtgtaacaattacaaatgtaaaaagcaaacacagaaagggattgctggctgggcaccgtggttcatgcctgtaggtcccagtagttagggagactgcagccggcagatcacttgagcccaggagtttgagaccagcttggccatcatagtgaaaccccatctctactaaagtacaaaaattagccaggcatggtggcatgcgcctgtagtcccagctacttgggaggcggaagcaccacttgagcccaggaggttgaggctgcagtgagctgagatcgcatcactgtacttcaccccaggtaagagtgagaccctgagggagggagggagggaaaaattgctatgggcaaggcttctcatacacaaaatcatttcctcccccaatatgcccacaaagtaactacaaacacttaatgaaatcattgagatccaaagcactgctgagaacttgctatgtgccagctgtggtagcaggcacgggggagagaaaggtgaatgccagagaagtacagagggtattcagagaaggcctcggagaccagatgagacttgagctgagccttgaagtcttactaagatcggtgtggcatggaaagcatgcagccctcatcacgtgccaccccctaaggcacaggcacagtgagggagacacagagcagggggctggcacactatgcctgagggccaaatctgggttttggtaaagaagttttactggagccgagccccgccccttggattgtgttagctgctttctgctttcttgctacaagggcaaattgagtggttgtgacagaaactgagaccataacacccgcaaaggctaaaatatttactatctgaccctttacagaaaaagttggccggcccatgtcctgttattccaagaggggtctgtgaaccggcagcaggagcggcccctgtgctaggcaagtcccaccccagacctagagaactggaatctgcctttcaaaaagatctgtggctattcttatgcacagagagggaggggcactgagcctgcggagtaagagaagtctgcacctgtcggatatacggacagaggaacgtggtcaagaccttcccatagaggagtgaggccatcaaacccacccgtaccatgtccctcttgtcgtggtaagaagggttgacagcagaaaagggatggcagctcctgtcataacccaggccaaagacgacccaactaggcagggtagaactcaatctttcttcctaacctcaccagtgcttccaagatgtttctaacaaatatagtatcagttataacttattaggaaatagaaaaatcttggtaatgaaaatatgagtaatcatgtgtttccacgtacagcgaatatatctcggttgaagcaatgcctctagacatcaatgcatacatgaagacgttaacagggtatgctggatgctgaaagatgaaatgaggatctcgtcaagggctccctattatgtaggatatttagaggtgtaatgtcttactgctgggacttttgtccctgctaaataagtgtgagattctgcttgatattcaattttcctgtattttggatgaataagcaatttaaagttcaaaagaaacaaagctgcatttggactaccacgccaacactgttctttcttccagctcagctcagcctcaaagtcactgtttaacattctgcctccttaagaatctagaaaagtttgacagggttattcgtgggattcggtgtgctttaaaggaatgacagcaatatagataaaaatagatgggtgaagaggggaaattcctctcttagacacttaggtttaatactttacattcattacattggcagacacaatgaaaagaaaaaaaagagtgtatatctgcttagagaaatgcataattaaattaataaatctcaagtaagaagaagaaaagggacaggacaccaaatctgtgttgagaagaatctctgtgttgggtttcattaataaaaatcttaaaaagctcatgaattcagtacaatgcttaatggcacttaagcgataatagtaactaacatttatgaagtactcactatgggtttacactgtttttaaatgccatgatacggattggctcatttaatcctcaaaacacctgatattagctctattttagaaatgagaaaaccaaggcacagagaggttaagtaacttgtccaaggtcacacagctaaataagtagtagcgattcctctcgaacagaagctgctctctagttcttcttgcctccctgctaatttgcaaaaattgtaactgtaaaagactctcattcttactaatataagagacaaaaccctggtgatttagacattcaaagtcttatggaacgggcacaccattccaccctgtggacagcggccaagatttggcctgcaatataataaaactgaggaatagtgagatgggttcgaatgaagaccctggattatttttctgtaggatgaaatgcaaattaagtccggtaaaattctgaaatgcaccatttgttaccaataaatacagacaaacacttttaatgacaatgactatgaacgcgttctcttccagctaacatgtttgtgaaatgctgcagtgaatctcaaagataacaggcacccggctaattctattgggttaacacgtccatgctggctgtgcaggcttatttaagtaattgcctgactgtgaatgaacagaggtattaaagtaaagttggcacaagggacagcatccacatggcacgttctttgtttcgagagctttattctatcaatactcctggaaaaaagagaagttgctaaataaataatggaagcacacaagacagtgtgaacgccttttcaagtcctcgaattgtcaagcatcttatataaagttctttcccgactctgagctcatcacatttcattttacatattaattttgcgtaagagcaagctcatcccgttcaaatgttaacagcttcaaaataagatcctggtgaaagctcgtcacattccattttaaatattaattttgccaaagaacgagctcatgcctttcaaatgttaacagcctccaaataagatccaagttatttacctgtaagatacaagaagaagacaggagagggaaaaaaaacaaccaagtgagaggagaggcgacagaaatgacggagtgagagggtcgcctgaactcaacaccgattcaataacctcttcaggttttcctatttaactttccccattaaaaaagaagacacaccctaccggtcatatcttcacaggcgcagataagggcaccagtctatgattaaagggtctggactgtgggtatgattcggggttgcctccgagtgcatggtgacaagcacaaacaattagcgctccctgacaccttgctgtaattcgagttcggcgagtaaggacaaaagggccgcccgtccgtgtggatgccgggctcagggctgcgctctgggagcctggctcgcgtcccctccgcggacgcccggtaccccgcagcccgagctcgccggcgcccgcatccccgccccggttcccgccccggcccctgggcttccgcaggacgcagctcgccgtggggcagcgccggagatggggcgcggggtccccgcgggtcccggtcctcgggcggccgggccgtgggagcgccgggccggcagcgggcggggcgcactcaccttcgtcctcgaactccagcttctccagcatgccggcttccgcgggtcccagggccgccgccagcgccgcctgagggggaggaggaggacagcgatcagcatgagctgcgacgctcgtccccggccggcgggctcgcggccggccgagcgctggggcctggctctgccgcgccgccgggaggaggggcctggcaggggacgcgggcagcgggggccgggggcggagcgggagcgctgcccccacccgcccgaggccgccgccgccgccgcaggtggcgcggccgcggcccgcgtgcccctccgcgagtgggacgcgccgctcccccccgcgccttggtacggcccgcccgggaggaagcgtgggaagggacccgggagctcgagggcggcagcgcctgggcccggggcgcccccctccggccgtggcccgcgtcctccccgccgtgccgccattgggagaggcccgcggcccgcccccactccgccccccggcgccgctcaccttcccagcaccggcggccgcgctcggcaggctccacctgcgcaggtgtgggctccgcggcgcggggagggggagaggggctggaggctgcagaacgccccggggcgccagctaggggatcctttctcgctttcctcttccctttccaaattttagatgtaactgcccatcctcggcccccttaacaaaaatcgttccgtgggctacacgtattgtagatgcactttgtcgctatccatttttttttttccagcatggaactcttaattcgcgtcctctcttcgcagccgagtgtcttctcggttggggagccgctgccaaaaacgtacacaccctgaatctggccctggccgctcaggagctgggtatctgagactctactatggccaactcaggttggcaggctgcgcggccagcagccgctagcctcctggaagggcaggacaggccgagaggggactgaggtccctggccccacggcccatccctgcagagtgcacgggcgccgcgaatgcgattagctccagtaccgattagggctgaaaggagcttggccctagcgctcttgcaagccgggcctgaaagaggaagtcctgaaaatgcctctcgtttagctttgtcatcttacttgcgccaatccctaagtcttaaacctcttaaaaaaagaaaaggggtggggagagaaaaagaaaacaaaactaagatgtttcatggtaaaaagctacagcagataccatacttcatagtgaaagactgttttccctatgaagttcagaaaccaggccagggtgtctgctctcactaatcctattcaacatggttctagaagtactaggccctgcaataaggcaagaaaaggaaagaaaacgcatacagattggaaaggaagaaaaacacctgtgtagataacatgttatctacatacaaaatatcaaagaatctacaaaagaaagaaaaaactcacctggaattagtgagtttggtaaggtcatagcatacaagatcaacacacaaaaatcaatcacatttctataaactaacaatgaacacatggaaaaatatataaaacaatatcacttaatacaatcacttcaaagaaaattaatacttaggcataaactcaagaaaccatgtatagtagctgtatgctgaaaatcacaaactgtagatgaaagacgagctaataaatggagagacagtcctgagctggaagccccaacatagtaaaaatgacaattctcccccagattaatcttttggtttaatgcaattgctaccaaattagggttttttttaaagacataaataagcttattctaaaatttatatggaaaggtgcaagctctagaattctatttatttatttattatttttttgagacggagtctcgctctgtcacccaggctggagtgcagtggcgcaacctcggctcactgcaagctctgcttcctgggttcacgccattctcctgcctcagcctcccaagtagctgggactacagtagaattctttaatcttgaagtcgcttaatattaaagcaaactatatagatacagcaatcaagacaatggtattggcagaagaatggatataataatcaatagaaataaatagaaaacccagaaatagacccatgcaaacatggcaaaccaatttttgatggaggtgtaaaagcaatagaactggagtaattggatatcaaaaggtaaaaagacaaaaacaaaccccaacctaagccttgcgttttacacaaaaattagctcacattggatcgtgaacttaaaactatgaaactttttggagaaaatatttgggaactggggcaaggcaaaagttagacttgacaccaaaaacacagtccataaaaggaaaaacataaatggacctcattaaaattaagaatttttgctctgcgaaagaccctgttaagaggatgaaaagaaaagctacacagtaggagaaaatacttgcaaatcacatagccaacaaattactagcacactgcctatagggttagccctgctctccaaggaatagcaaaaataaaataaaataaaaatgtctggaatacataaacactaccaatattaaacagaaaatggagaaaataatccaattagaacataggcaaatgacacagagctgtttcaccaagaaagatatacagatggcaaattagtgcatgaaaagatgttcaaagtcattagccattatataaatgcgaattaaaaccacaatgagatactactacacaactgttaaaatggctaaaatcacaatagtaacaacatcaaatgctggtaaggatgtagagagacagacaggattacttctacactgctggtgggaatgcaaaatggaaccactgtttttttttttttttttcttttttttttgagacagggtctccctctgtggcccaggctggagcgcagtggacctatctcaactcactgcaacctctacctcccaggttcaggcaattttcctgtctcagcctcctgagtagctaggattacaggcacatgctaccacaggtcagctaatttttgtatttttagtagagatgaggtttcaccatattggtcaggctggtcttgaactcccgacctcaggtgatctgcctgccttggcctcccaaagtgctgggattacaggcgtgagccactgtgcctggtcaggaaccaccactcttaaaaacaatttggcagttttttataaaactaaacatgcaactaccatgtaacacatcagttacactcttgggcatttatcccagggaaatgaaaacttacatttacacaaaaacttgtacatgaatattcatagcagcttttttgcaacagtgcaaacgaaataacagatgtcgttcaatggatgaatggtgaagcgggctgtggtaggtccatctataccgtaaaatactactcagcaagaaaaaggaaggaactactgacacatacaacaacttggatagatctccagggaattatgctgagggggaaaaagccagtcctaaaacgtcatatactgtatgattccatttatattatagtcttgaaataaaatggtcgaaatggagaacagattagtggatgccggggatcaggggctggggtagggggccagaggtgcctatggctataagaggataatgtaagagatccttgtggtgaccgaactgttctacatcttgactgtatcaatgtcaatatcctgcttgtgatatcaccctgtatttttccctatgagtcaggccaagctgatttaattctgtggaggaaatgacaataaatttttttttttttttttttgagacggagtctcgctttgtcccccaggctggagtgcagtggtgccatctcagctcactgccagctccacctcccgggttcacgccattctcctgccttagcctccggagtagctaggactacaggctaattttttgtattttttttagtagagactgggtttcaccgtgttagccaagatggtctcgatctcctgacctcgtgatccacccgcctcagactcccaaagtgctgggattacaggcatgagccaccgcgcccagccaaaaaaatctttactgaaatataattcacataccataaaataactcacccatttaaagtgtgcagcccagtgatttttggaatattcagaattgtgcaactatctaagtttacattttcatcatcccaaagagacagcttgtacccattagcagtcacgtcccattacctgctcaaccctcacacccatccctaggcaactatttcctgtctctatggatttgccgatgctgggtatttctcatcaatgggatcatacaataggtggtcttttgtgactagcttccgcttaatgtcagggcccattcacattgtaacacggatcagcacttcatttctgttgactgctgaacgatactctgttgtgtggacacacacaccttgtttatcctttcgtcagctgatgggcactcaggtggtttccactttttggctgtggtgaaaatgctcctatggacattcctgtgcaagtgtttgtgtggacatgtgtttcatttcatatatacaggagtggaattgctgggccacagggtaaccctatgtttaatatatatatattttaaatttagttttgaaatggagtctcactctgtcacccaggctggagtgcagtagcgcgatttcagctcactgcaacctctgcctcctgggttcaagtgattctcctgcctcagcctcccgagtagctgggactacaggtgcgcacaaccatgctcggctaattttcatatttttagtagagatggggtttcaccatgttggccaggttggtctcgaactcctgacctcaggtgatccacccgcctcagcctcccaaagtgctgggattacaggcatgagccaccacacctggcctctctacatttaatattttgaggacctgctgaactgttttcaaggtggctgcaccattttacatttttaccagcaatgtatgaggattcaagtttctcctgtactgtttagttttgcaagatgttaccactgcggggaactaggtaaagggtgcacaggatctctctgcattatttcttacaactatatgtgaatatacaattatctcaaaataaaaagtttaatttttaaaaaaagttttttaaaaaaacttggagtgagccaaggtacacaggaagtatctctcgttctaagtctatgcttttgtctcttgcaataatttaaaaaaattcttaccggtgtttatgataagcaccatcaatttcacctgtaatcgtgaggggttgttttttgggaggcagaaatgggcaacaaatggcagtatgtacgtcaggaggaccgcaaaagtggttcacagactgaaaagacctataaaccatcactacagaagttggtagagagtagaaattctaacaattaatgttttatgcaactccacttgataatgaatgggtgtacaggagtagcctaaaataaaaatgtttttatgtaatatgctagtgggattgaatttatttctacaggttttttacttagtaagaaatcttatgttttcttccttagaaaggaggctactcatggaacaacagaaaaagtcatgaggttttttttttttttttataacacactaagtcaatttcaggaatttgagggcttttacagtttaggtatgtacattaatgtgcacagggtcaaaagacagacgaatttgtcagcacacagaacttgaagctggtggtcgtcgttgcccttttatggcaatgttttcttaaagtctcaacagacttatgccagacttaattttagctgtttcaggcaggcagggaaagccgggagaagaggcgaagggaggggaagggcgtgggcaatgtcatgcaagcaaagggaaggggcgtgcacttgtgacaccgactcctctctcagtccatcagcatcagggatgtttgatgtagcaaaaacagaccaaatccaccacccaaaccctcctgataatccagaccgatctccccagggagaacaaaatgggccaaccatggcagggaggaactgggttctgctaacagcctggcacagttccaccacagggaacatttccatttatatcacatcagccagtctgaggttactggactctagtgtggtgggagggaacagagggacccaagttggactttatggagagaatgcctgagaaacatggagccatcacaagtgtgacttcttggttggtaaaaaatgctaaattattatcccggcatggtggctcatgcctgtaatcccagcactttgggaggccgaggcgggcggatcacaaggtcaggagatcgagaccatcctggccaacatggtgaaaaccccgtctctactaaaaatacaaaaattagccgggcatggttgcgcacacctgtagtcccagctactcgggaggctgaggcaggagaatcgcttgaacccaggaggcggaacttggagtgagccaagattgcaccactgcactccagcttggcgacagagtgagactctgtctcaaaaaaaaaagctaaattattaagttgtgtcttacataattgtgcccaggtgcagcaaaacactgtattttgaatgactatcagaagggaaaacttcagcctgaaaacttaatcataaaacaattgccaaaaaagcactcctttacgcacagaggtcggatatgagtttgctctgcctcttaaaagaagtcttaaatagctcctgcaagaaataaatcaacctcaaatactgggtaaggagctcctgaataatttagcatacagaactcttagtttctgtgcatcctgctgtcttccttgagctccactctgctctgcaagggcgtcctccaaagagtaaagaacgacgtgaaaccccctggatgctggacaggagctgcacatgcactctgctcccgttcccactgggcattctccaggcagctccaacccaccactgtgcctgacatgtccaggtctcagtcccagcccagccctctcctgagctccacactgccatcatctccactggagttttctacaccaacgcagatgcacttcatctaaaactgtgccccagtcctctgggtcttgccgtcttggtttcttttgagacaacccacttgtctccatccctgctacacctcccctgtttcaggcttccattttctcagggttggccagccgggcagcttgagctcctccagtcttgcccgctttccagtctatttccttccgtgtagccagagtgcctatgatggttaaatttgaatccagtcatcttgactggattaaggaacacctagacaaccggtaaagcattatttctgggtgtgtccgtgcaggagtttccagagactggcatgtgggtcagtggactgagtggggaagatctgcctccagtgtgggcgggcgccatctaattagctgggggcctggagagaacaataaaggtgacagaggatttccttgctctttctcctggagctgggacactttcctcttcctgctcttgggcatcagaactccaggctctcctgccttgacactgggacttaacagcagcagccctctggttttcaggcctttggccttggactgagaattacgccactggcttctctagttctgaggctttcagacttggactgagccacgctaccattacctgcatcccagggactccagcttggagatggcctgttgtgggacttctcagcctccataatcccatgaggcaattcccccaataaatcccctctcatccatctatcagtcagtcaatcaatcaatcaatcaatcatctattatctatctacctacctccatccgtttctatcatctatctatcacctattggctctgtctctctgaagaaccctgactgataagagtgacattttaaaaatgtagtcttggccaggcacagtggctcacatgtgtaatcccagcactttgggaggacgaggcaggtggatcacctgaggtcaggagttcaagaccagcctgggcaacatggtgaaacaatgtctctatgaaaaaaacaaaaattagccgggtatggggcatgcacctgtaattccagctacttgggaggctgagacacaagaattgtttgaacctgggaggcggaggttgcagtaaactgagatcctgccactgcactcttgcctgagtgacagagtgagactctgtctcaacaaaaacaaaaacaaaacagacttattattcactaacttagaaccattcagtggctctcggcaatctttaggattttcttggcaaactcctgagctggggggaagggcctgatcatttattcaccttctcttgccatgtccctctgtgtaccccacacctaaaccttaaggcattgtcctggaatagaccatacactccctgctgtaagggtttctgagcattctggcctccttgtttcttcctcctttccttggccagttcttactatttttaaagattcagatcaatctttctctgaaagcctttcccgattcttttctttcagtctgcttttcctccttcccccaccgccttccttccttccttccttccccgattcacgaccttttctcacaacttgcctggttaattacttctctgaacccacatgcttccatatggcatttaacacactggcttgggatttacttttctgtttcctctgagtcccacattgctctctgaagggaacgaatgactcatcatccttgtattgcctgtgtgtgacacatagtaggcattcaaaaaatatttgagtgaaatgaattgttcattcagacatccattaaaacttggtagggaaacagttgattttagtagcataaatgggtttagaagttatttcactcaatttactcatgcttcccttggacctcattgctgtttggaaatcattatagtcactttccctttagtgttggaattaacattttgaaggaaaaaaagtgactgtgccaagaaatgatggcagggtagtttttattgtaatagattctatctgaggaccaaagttcgctggcagtatgagatcctggcatggatactggctgagagctttgccagctcttgccaccaccctacaatttcagcttttttgttcccttcttttttccttttttttttttttttttttttgagatggagtctcgctctgttgccaggctggagtgcagtggcacgatctcggctcactgcaatctccacctccctggttcaagtgattcccctgcctcagcctcccaagtagctgggactacaggcgcacaccaccacacccagcaaattttttgtattttagtagagacaaggtttcaccatgttggccaggctggtctgaaactcttgacctcaagtgatccacccacctcagcctcccaaagtgctgggatgacaggcaggagccaccagaaccggccctttctttcttttttaagagactgggtcttgctctgtcacctaggctggtgcagtggcacaatcatagctcactgtaaccttgaactcctgggctcaagtgattttcccatctcagcctcccaagtacctgggagtgccagcacgtgccaccatacctggctaatgttgcccaggctggtctgaaactccagtgctcaagtgatcctcttgcctcagcctcccaaagcactgggattataggcatgagtgacatcacctggccaattttagtttctgttaagggaagacaattgatttttaaaagtagtgtagaaatttgaaaaaaatctcaaatatatattcaacactatgagtattaattcttggccacatgcagtagctcggtctgtaatcctagcatgttgggaggttgaggtgggaggatcacttgagcccaggagtttgagaccagcctgggcaacatagggagaccccatctttaaaaaaaaaaaaaaaaaaaaaaaggggccaggcgtggtggctcacacctataatcccagcactttgggaggccgaggcgggtggatcacgaggtcaggagatcgagaccatcctggctaacacggtgaaacactgtctctgctaaaaatacagaaaaaaaaaaaattagccaggcatggtggcaggcacctgtagtcccagctactcaggaggctgaggcaggagaatggtgtgaacatgggaagcagagcttgcagtgagccaagatcgcgccactgcactccagcctgggcgacagagcgagactccatctcaaacaaacaaacaacaaacaaacaaaacaaaaggtagctgggcatagtggctcatgcctgtagtcccagctagctacacaggaggctgaggtgggaggactgcttgactccacgagttcaaggctgcagtgagctgtgatcacaccactgccctccaacccgggcaacaaactgagaccaccccactccccaaaaagaagtgtattaattctgctgattgcttttaatcaatatatttggagagaaggttttgttcattttgacagctttctgaataacaatttcagatgctataaatattagttcctccctaacattcatgatttctttaaagataatttattccacagtatcttttcagagagagtagcaaccaatttgtccagctcaagtcagctgaaaacctgtttcaaaggaagtattgttaaacaaaaggtgaagaaaattgattaacccaaaaagtcctttggattctctatgttaaattatcttcgaatttccaaaataggagacaatggtaagcttttgaagacagtcattcattcagcaaatacttacttaatatgggctatgtgcccagaaccagggtagttggttaataaaatatctgttgaacgaacatgtgctagcatgactagaaattggcatagaagatatgaagaaggagctcaaggaacatggagaatcagcatgattgccttgctacccttcaaattcattcgttacagtctgaaatgcatacatctcttgcctttcacaaataaatccatttttttgccaatcaaaatattttattattagctttgtgtttaacatgagttattgggagcggaatatttatattctcttataggttgataactcttagtattgtcttataatacattgcaaataaaaaaataagtaatgctcaccaagttcatctaacctttcaattcttaatgcagccaagtcacaaactttgaaatatgttgtatttatattagaatgcaatgtacagaatgatatagtgtcacaaggcagtctctgttttctattctctgctccctcccctgcaactgacctattcattaaccctttctagaacagatcactgttaactgtttttcagcccctttaaatcccatattgggtggaagctctattcctaaattggtgaaaaattacaaacatgattgagacagactacttccacttcagttctgctctacataacgtgatcaaaaggaagtacaatattccagctgaaattaaagggacccactaatgcctccaccacatcttctacattctggagacttcagtggtcttcatttactatccacagtgttacatagccacttatggtggattagagtgaactgcagacacagagccaaggaaatggagaagcaggaccttcatacctcataatgcaaatcctttaaagaatgatttgtagtgtccctttttgttgtgtgtaatttaccaacaataaacgatttctattccaagtgtacaatttgatgagctaggatgaaatcatcagtacaattatacgatggaatactattcagtcataaaaagcaataaattaacagcatttgcaatgacctggataagactagagactattattccaagtgaagtaattcaggaatggaaaacgaaacattgtgtgttctcactgatatgtgggagctaagctatgaggacgcaaaggcataagaatgatacaatagactgtggggacttggagggaagagcggaagcggggcaagggataaaagactacaaacatggtgcagagtatactgctcgggtgatggatgcaccaggatcttacaaatctccactaaataacttactcatgtaagttcatgtaaccaaataccacctgtatgccaataacttatggaaaaataaaatttaaaaagtaaataaatgttaaagagaaaattaaaaaaataaaatatagagaaaatttttttatcactccaaaagtttgctcatgctcctttgtggttcaccccttcttcaaggcaaccactgatctactttttatcactatgtcactataaatatttcctagaattttgtgtatatggaatcatacagtatatgtgcttttgctcctggattatttcacttagcataattattttgccattcattcatgtcgctcagtataccagtagtttgttcatttctattgctaagtagcatcccattctatggatagaccccattttgtctattcattcaccagttgatggacatgtgggatattttcactttttgaccattgggaataaagctgtgaacatgtgtggtcaagtctttgtaggaacatgctttcatttctcttgggcaaataccaaggagtagaatggctgagtcatttggtaggtgtgtgtttaatatgagaaaccacccatttcacagactggctgtaccattttacatttctgcccaaagtggttgagagttccagttgcttcatgtcctcatcaatgcttggtatggtctcttaacattttttatcattttagtcattctagtgggtgtataggtttcttgctgtgagtttaatttgcatttccttgaggacaatatctttttgtgtttattggtaattaatgtgttttcttttgtgaagtgactgtacacatcttttgtctatttatttattagagtttttgttcttattgagttgtatgaatatggcaagcagactctgagatggcccccaatgcatgatccccacctcctggcattcatgtacttgtgtatccctcttcttgagtgtgagcaggacctagtgacttacttctagccaacagtattcagcacaggtgatgggacaccacttccattattaagcttctgtctatatacataagactgtggcttgtctttctagcagatcactatcttgctggctttggtgaagcaagctgccatgcgggagaggcccatgtcaatgaactaaggctctcagtctaaccgcttgcaaggaactaaacactgccactaaccacatgagcttggaaagggatccttccccagctgagccttcggatgagaccctggtcctggccaacatcttgattgcaagcttcacaaaagagcctgaggcagaggactcaactaagctgtacctgaacttctgacctacagaagctatgagataatcaatgcatgatttcagccactaagtttgtggtaatctcttacacaactagataatacaatgggttttaaaaaaatgcatttaggatgtaagtcctttgtcagacacatgtactgtgaatagtgaatattttctctccttctgtggcttgccttttcatattcctagtcatgtctttcaaagagcaagtttttaattttgataagatcctatttattatattatgactcatgctttttctgtcctagctaagaaatctttgcctcctcttcttccaaggttgtgaggattgtcttaaatgtttccttctagaagttttacattttccttttactaggcctaggatccattttgatttaatttttaaattatgatatgtggcaagggttgaggttcatattttccatactgaaatccaattgttccacattgcttgttgaaaagattttgctgcctcactggattcccttggtacctttatttaaaatcaattgaccatatatggggatctatttctggattctctattttgttcattgatttatatctatactttcatcatgaccacactgttttgattactgtagctctataataggccttaaaatcaggtagtggacattctccaactttgttcttcatttaaaaaatggctgtgagtcctttaagttccttatgtttctatatacattccagaattaaaaataaaacctactggaatcttggctgggacggcatttgatctacagatcaatttgggaagaaatgacaacagtattaagtgttccaatccatgatcatggcatatctttccatttgtttagccctttgatttctctcagcaatcttttgtagttttcaccatggaggtcttacatatcttttgttaaatttattcctaagtatttattttttgatgctctcataaatgaaattgcttataaaatttcatttcccaattgtttgctgttagcatataaaaatacagtggattttcatacattaaccttgtatcctgtgaccttgctaaattcacttgtaagttctagtggtaattttgtagatttcttaggatttttctgcataagtaatcacatcatctactgcctcttaaattattttgcaattccccgatactgtataattttagctatgtgttcagtgtattatacataactctgattcttatcaaaatgtatcattttagttattccttggctcatacatataaaatatgtactatatgttacacatatatgtaatattacagattacctatgtcatattacacatggatagatggatatctgctgctttcagctcacgtgcacaacctcagtagtggtatccaccatttgacgtgtgcacactggagccagctggagcgggtactcatggctgcctacttggcatccattcctcttcctctaccttccttcctagaataacccaaatgctgttgcagtatatatgctttcatgatagtgacaagctctctcgagctaccctgggctaccagggaggactcagggttggagagagccagaccgcacatgcatgtgtgcacagccccgtccatcccctgttcttgccacaagcaagcatgcagccctgactgctattgagaaacagccttcagatgaagccattgcagagagagagaagaacgtgggtcctaggtgacagcattgagcagggctgtatctcaccttgcctggggcctggcctgcttctgtacctgtatggatgatacaatagatgtccttatccttcaagccagtttgagttggaattctctgctgctttgcagccagaaacagcctaggtaacatttgggtattcaatgagatacaggcccggccctcagaaggttatattctaattaggtgacagttataattggggaaatcagatttctgcatatgtcacactgtaaaaaattacaaagtaatttaaataataaaaagctatagcgactgcattgtgggcacaaatgctaaggaaacctttgagaggaaggcttcctacagagatgtgcagaggcagattttgaagggagcaaggaaaggtggacattcgggtggcggctgtggcagaggaagagcctgaaggtcaggatgtgctgatggtctttatctgagagtagaacattcttgtagagaagtgaaagaaagattggagaccactgggagtgaaaggaatggaattggatttcttaggattgcatgtaagaagtgaatgtagataatctcaaatcgtttttggcaatataaaaaaatcctaatatctgcatacagtagagagggttggctgcaggagagcctggagtcagcggggacattgaagacgtctttacaatgaatgtaaaaattaagcgagcaggtcagaggtactgcagagataagaacagtttcgactttgtggattaggaagtaaataggaaagagattgggaatgtcagggaacagggattgaatgggcctgtgtgaggtaataaagggggaatgctgcaatcaatctgttaaacttcagctattacaaggctgtccaaaaaagtacctttggtgtgtaactagagtagcttccagtgtcatttggcggagaggaggggtgggtggtgtggatcatgctgaggaagaatgacagagatttttgattcatcagctatgcctcccaaactttggacaggtgtcattctatcatatccccatacaacctacacagttatttaaattgacttaaacccccaagtcttcccttaggcaacaattccatgaaatcataggttttgctgtttcagatatatttttccatgatatacaaaaatgtcgctatgaaaacgttcatccttgtaccgcctgaaagcatcttgcatcccaccgtggtcctcatgccccctgctttgggaaaactggtgtgtgagaacaagcggagtcagcatgaagggctggggcacccgggaaaagcacggagacattgctaggaggggccggtgtcttctcaaagggtgaaagggaagagacatcgatttaacaagcagccctagtagctgcaacacaaaggcatttgctataattggaagctgagaaaccaggctttagggaatgaaaatctaaaccagtgtttttaaaactgtaaactgtgacccactcatgggtcatgaaatcaattatgagtcaagtactgtaaaataatagtttactttaaaatgaaatgtaatagagggctgggtgcagtggtccatgtctgtagtcccagctacgtgggagggtgaggcaggaggatggctggaacccaggagttttaacccaaggcaacatagtgagacccccgtctctttaaaaaacagaaagaaaggggaaaaatcaggtatgtgagagaggaccaggattttttttttttcctttttatgatcagagactacataataaagaaatagagtgtacatcttcggatgcctcttgaccgaaagacgtagtcattcatatgggatatgagttaaaggaatgttcttgtcactaaatgtgctcaaatttcccttcacccgaagagcaagtagccagtgtctgtactaagttagacctgagggaaggaatgattattttattttattttattttattttatttgagacggagtctcattctgttgccgaggttggagtgcagtggtgtgatcttggctcactgcaacctccacctcccaggttcaaacgattctcctgcctcagcctcctgagtagctgggattgcaggcacctaccaccacacctggctaagttgtgtatgtttagcagagatggagtttcaccatgttgtccaggctggtcttgaactcctgatctcaagtgatcctctcaccttggcctcccaaagtgctgggattacaggtgtgaaccaccgtgcctggccaagactgcatttttaagttgcaagtaatatggtgaaaaattagtgtgtaccaacttttgtcatgttggttgtgcttgatatggtttggatctgtgtccccacccaaatctcatgcccaattgtaatctccagtgttggatgtggggctggtaggaggtgattggatcatgggggcggtttctcatgaatggtttagcacaatcccctcagtgctgtcctcgtgatagtcagtgaattttcatgagagctggttgttcaaaagcatgcagtgcctcccctccttcttgctcctgctcccgccacgtgaggtatgtgcggccccttcaccttctgccatgattataattttactgaagcctccagagaagccgagcggataccagcatcatgcttcctgtacagcctgcagaactgtgagccaattaaacctctttcctttataaattacccagtctcaggtatttatagcaatgagagaatggactcatacagtgctttttaaagggatatgcaggtatctaattctacatatctggaggaaatgtccccctcacctccccgacacacacccctgtatgtgttgcaaagcgtaatgactacttggtatttctattttctttttaaacagcaaaaattaaaaagaaaattagccggacacggtggcacgcgcctatagtcccagctactcaggagcctgaggcgggaggattgcctgggaggtggaggctgcagtgagctgtgatcacatcactgcactccagcctgagtgacagagtgagagagcctgtctcaacaaaaaagtttaagagaaaaatggtaatggttgactattttcctgctgagaagtgggcctgggtgatagcgaaacccagtctcaaaaaaaaaaaaaatttagaagaaaaatggtaatggttaatgatttttctgctgagaagtgggcaattacgcaaactttacctctagggaatggtttgcatgttaagattggaaccagagcaggggaaggggttatggtcctaaatcctaccaaactcagcagttcctgtcgctgtgttcctaaagatctgtggatgacagtaatgcttgacaacagtgacatatgctgacacgctatactagcagtttgaaaactggccagaggactcctgagggtccatgaaaccttttcagggagtctacaggtggaaactttttgtgccaacactaaggcgtcatttgctttttacccaccattgcttttccccatcaatgtcagcaccgtggcaaattctggtgccttaattcacatcaacaaggcagtggcaaactgtgacaacctcctactccaggggagaaggccagtgtcacttaagaaggtctttgataatgccatacatttattcattttgtcaaatctcagctcttgagtatgtgtctttttaatattctgtgtgatgaaatgagaggtgcacatataacttttccgttgcaaattatgatgatgttcttgaggaaaacatgtgcaattgagctgcttttaaaaccctgaaaaattgtagttatttggacctgggtatttggtagacagttttttttcaaaatgaataaactgagcctgtcactgcaaggaaaacaactgacatatttgttgtcaatgataaagtttgagttttcaagcaaaaattagaattttggaaaccttgtgtctgccacgatgagcttgacaatttccccatacttagagatttctctggggagattagtggtgttattaagaaatgctttttagttattgtgtaacaaaatgtgttcctatttggaagatctgcattagtcagtgagccaatattttccagatgactaatgcatggtattataaaatcatgcatgggtgaaagatccattcgaaatacaagatagggctgggcacggtggctcatgcctgtaatcccagcactttgggaggccaaggtgggcagatcacttgaggtcagcagttcgagaccatcctggccaacatagtgaaaccccgtctctactaaaaatacaaaaattagctgggcttggtggcgagtgcctgtaatcccagctgttcgagaggctgaggtaggagaatctcttgaacccgggaggtggaggttgcagtgagctgagattgcgccactgcactccagcctaggcaacagggcgagactccacctaaaaacaaacaaaaaaccaaaaatgcaagatagatggacagattctaacataatagactctaggtaagtaggctccgaaaagttcaatgatatggtgtcagattacacactgcggctaaccttcaagaaactaccacttgtcctctgggttcatccatgttgtcacagatgacatcaggctaagtgaaataagccaagcacggaaagacaagtactgcatgagctcacttgtagattataaacagtgaaactcataaaggcagcgagtagaatggaggttccagagactggggctggggttggatggggaaaggcaggaggctggccaaagtgtacaaagtttcagtttcatgggagaaataagttctgatgtatcgcacagcactgtgactacagttaataataaagactgctaagtgtagattttaagtgttctcacaaagaaatgataggtatgtgaggtgacagatacgttaattagctcggtttaatcattctgtattgtatacacatatcacagcatcacagtgtaccccataattatatacgatttttatttagcagttaaatatttaaaaaaccccaccacttgtcaagaaggctatccacaattatctgaagaggtaaaccaatacactcctctctttttttccaaccgcctatctgtctgaggctcgattttcttcatgtgcttcaaccaaaacaacatatggcaacagaccgggtgctgaagcagatctgagaattccaccgaattcttctaacccagacatgaaaaagctttgcagcaatgtaaaaggagttctttttcacaaagatggatttatgctaatatgtaatgagtttattactgatcttttcagataaattaatatttaaaaagttttaatttataatatggtaaattctttttcttttttcttttcttgttttgctaatcttctctgtatcatcccagttttagtatatgtgctgtcaaagcaggcacacaatatggtaaatattagtagatggaacccaatatccaaaaaagcccattgggtctcttttttctttttgagatggggtcacccaggctagagtacaatggcatgatcgggctcactgcaacctcttcacccccaggctcaagtggtccttctcatgagtggctgggactacagatgtgagccaccacacctggctaatttttctgtagtgatggggtttcaccacgttgtccaggctgggcttgaactcctgggctcaagcgatctgcccgcctcagcctcccagagtgtcaggattacagatggaagccaccacacccggcttgtttgggtctcaataattatgagtacacaggggtcctgagaccaactgatttgataactactgaactgccgtacagcaagacctcaagctcagaaataactcaggcgctaatgaaagttaaaggaaatatccctttcctccttttctctgaacttaatgccctagaattgtgtgaggtatcaacagaaaaaactttaatcatcatagcagagcctagtacagctataatccaaatttctactaccttctataaaccaagaggtcctgttccctttatctcaaccacatcattagtagtgttttcagtgtgaaaaaattatcattaaatttgcttgttaaaaaaaaatacgttagctttttgcctaaataccacatacatattttaaagtgcaaggggttttagactattctagtgctgattaatatagcttcagtcccctttagatcgaaaacaggaaaaaatttgtccttatgagtactggataattaacaaaatgtacataatttagttattctcacccaccgatacgacaacctggataacctcaggctactagaatccaaatcatgggttggaaatgcaacagagaagcaaacaggaatgggttgaaaattcttttttaacatgttacagacttggggctgggtgcagtggctcatgcctctaattccagcactttgtgagtctgaggcgggccgatcacctgaggttaggggtttgagatcagcctggccagcatggtgaaaccaagtctctactagaaatacaaaaattagccaagcatggtgacggatgcctgtaatcccagctacttgggaggctgaggcaggagaatcacttgaaccctggagctggaggttgcagtgagctgagattgtgtcactgcactctagcctgagtgacagagcgagactccatctcaaaacgaacaaaaatcttacagacttggtacacgtctcgctgcagataagcccaatcctttcatatactcataatgacagaaatctgtcaaatttctattcctcaaaagagactgaaccctacttaagttgataaatacccttatatgcaatataattttacttgtttaaaaattatcataattattttagatgttttaaatcatggtgttttcaaaatgaggataatttctttgtgttttatagatgctggggttttctttatctgtttttggacagacaaacccatccttttgaaatagtcatacagtgttcattggctgatcatagatatgccaaccaggaaagcctttcttccatttaactttgtcttcaaagaaacgtgtctacaggatgtcccatggtgaaggatgaggacgaggcttgcagcaagccatcccctggcccgccttctgtgctgcagtcttcttgcaccccagacacaatcacagcattgctagcttcccctccttaactcatatggctcactgatgttagtcatttctattttttctctatgcctatcaagactacctctcacaaatgcaccttgcccccaaacccttcctcccactgtccatatagttatgaattcttttgctatgtcaatattcaaggtttcaacttattacgactatgcaaatactactgatacctgagccaaaccatatagtgtactatagttcaccttcctttttgtcatttttctcctgtgcttttactatgctcagtctgatattggagaaagtgccagagacagtaaagggagacaaagtagaggaggaggagaaatgtcaaagtagctcaggatatgctgggtttttcttttttgagacagagtctcgctctatggcccaggctggggtgcagtggtgtgatcttggcttgctgcaacctccatctcctggattcgagctgttctcatgccccagcttcccaagtagctggggctacaggcatgtgccaccacgcctggctaatttttgtatttttagtagcaacggggttttgccatgttggccaggctggtctcgaaatcctggcctcaagtaatccacccaccttggcctctcaaagtgctgggattacagacatgagccaccatgcccggctgggatacgttgttgttgaattcactcttgaaaatgaaatattcccaaatttaacctgaggagagggactcaaatgacaagtattactcgggaaatatgtgaacaagtcattatatttttatttttttacttgttatttcttgggtattctttcagaaagaaacagcaatagttttgtattcttgaaggacaccacatcagagaaatgaaagggtacgccatctctggacagccctacactgccattcaaaggtatttggcccaaaagtactctgtgcggcattgctttttccattttcctcttcaaaatagcctattagatatgagctgatcgctcctaagaatcgtgagccctccttaatctctctgctgctggaccctaacacagcccatgcagaatcacctgtgtgtgaagtagcaccctgggcaagaagcccacagctgcttggtggcttggcagcctctctaggactaaaactcagtttccaagggtagtttagcaatggtaaggagtatggattctggacatactacctgggcttaaccctggcttgagcaatttattaaattgctccaggactggctacataatttgccagatccagagcaaaaagaaaatgagaggtcccttgttcaaaaattgggaatttccagactatgacaatagagcatcaaatcaaggatgggactcatctaaacacagggccctgtgtgctgtgaaacatccatgaagctgctcgtgcctcagtttcctcatctgtaaaatgggatcgtagcagcacctacctcatagagcggtaaggaatatgtgagttaattacacagacagcacttataagagtgccagcacttagtaagagctcagtaaattattatcacaccccacatagcctacactttgagtcaggccatctcaaacatactacccaaatctggtgaaaattcatttagttatttctctgtgacatggtaaaagtcaaacaggcaaacttaatttgtaaatttcattaacagcaatacagctgtttgaaaccctggaatttttatcagtaaacaaaaactcagtctaatttttttaaacctgaaacctgagtagcactatattgtgctttattgtagttaagttttaaaaattataagtacatattcatttatcatagccattgataactataaatttgttatctaatgaatgagtcacgaaaaactggaaataaccaacaattttaaaaggatgacaatacaaactacgtttcacgacaataagaaaacccagaatttggccgggcatggtggcttatgcctgtgatcccagcaatttgggaggttgaggttgggcgaatcacctgaggtcaggagttcaagatgagcctggccaacatggtgaaaccccatctctactaataatacaaacattagctgcacatggtggtgtgcacctgtaatcccagctactcgggaggctgaggcagaagaatcgcttgaatccaggaggtggaggttacagtgagccaagactgcgccattgccctcaagcctgggcaacagagcaagactgcatctcaaaacaataacaacaacaaaccccaggatttattccatatgcaaatatcttaatccaacaatatatttagctaaacataaacctttgaaggattgaatccatttattaggatgcaggtagagggatgccaatgtcttaggtagcatgtgtaaataaataaaaaatgtgttttctcttttgatgttgttgtttcctgatttaagaatgaaaggtaacttgattgtattggatcagtagtttgattcaagtaacatcgtggaattcaaaagtgcaaaggtaaaacctcaaaagcatatttaggccaggctcggtggctcacgcctgtaattccagcactttgggaggccgaagcaggtggatcacttgaggtcaggagttcgagaccagcctggccaacatggtgaaaccccatctctactaaaaatacaaaaattagctgggcatggtggcaggcgcctggaatcccagttactggggaggctgagacaggaggatggcttgaacctgggaggcggaggttgcaatgagctgagattgtgccactgcactccagcctgggcgacacagtgagactccatctcaaaaaaaaaaagggggggtggttattcatcagctgttaactgattttaattaagattttgaagaatattctcaaagtcaaattgtgtgaccatagtgtatataaaatgaagacagcaaacatcgcctatggaagaagacataggttgggctcaaagcttgcacctttcctctctcggtagttctggctctgagtcccagctatgccactgactcactgctggactgttctgtgtgtcagtctctaagcctcgtgccaatgtccactgtgtgcctggtataggtcttggctcaggctaggtggcaataaatgctgttgttggtttgggagtggggagtgccatttggtaaaatgaaaagaacatggattccaaaggtaggtctcaatttgaatcctatctcaatcatttactagtcatacaatctccagtagattttatttttctaaaccttggttcttaacttgcaaaatagagataataatatcttctttgcaggactgttgtgagaatgaactgaacttgtgtgtggctggcccataacaggcatcaacaagtgggtttgaatccaagcccctaccttcatagtctagacaccaggcagaagagactaactgctttgggctgtgaggatgagacaaaaaagcagctccatctactttgagaagtcaaatgtgtcaaatgcttgtttttatttgtaaagtaagacacataaacaatattgtgtttaaagaatgatggagggcaggtgcagtggctcatgcctgtaatcccagcactttgggaggccaaggcgggtggatcacttgaggtcaggagtttgagaccagcctggctaacacagtgaaaccccatctctactaaaaatacaaaaattagctgggcatggtggcgcacgcatgtagtcccacctactcaggaggctgaggcaggagaatggcgtgaacccgggaggcggagattgcagtgagccgagattgcgccactgtactccagcctggtgacagagcaagagtccgtctcataaataaataaataaataaataaataaataaataaataagaataatagggctgggtgcagtggctcatgcatgtaatcccagcactttgggaggctgaggcgggcggatcatgaggtcaggagtttgagaacagcctgaccaacatggtgaaaccccgtctctactaaaaatacaaaattagccaggcgtggtggcgcgtgcccgtaatcccagctactcaggaggctgaggcagaagaatcgcttgaacctgggaggcaaaggttgcagtaagccaagatcacgccattgcactccagcctgggtgacagagcaagattgtcgcaaaaaaaaaaaaaaaaaaagtatttcacagatcccagagcacctacaaagtaagagttgttttatgcatttgccaaatccattgaaaattattttaagactgaaaataacattttcaaaaattatttgccaccaaatgtgcctgatctaattcagtattggggtgcgaacacacgccgaaacagtacaaaaataggcttatcccaagcacattaatgaagaacatgttataagatgattttaaactaatctgcagctctatcactaagcatctagcagaacacattataagcgttctatcaggttatttctggtgtagacaaacgaaaagccagtttctattatttgactggtgcccatttgtattaaaggactaagatggaaaagaggcaaagaatttcctaattactgatgacaatgatctgctgagtcaagtcagaatgtgattcagtaagattggaggggaagggaatgcaatataatggatgggtacagtattgctggtactgtgttgagctgcaggaagattttgctgactttcttgagaagtgaggggatctggtgcctgagcaatcaaccatgattcatagtaacttgctacagtgctgtttgaacagaaataaaatttgacctttttctatgcacccaagccactcaacaaaatatatttgtaaatacaattccatcttctgacattggatctaggcggtttatttaaaaagctgggtctttatgattttgttttgcatagacttaaaaaaaatttgtgtttgttttatccaggccatagattcctgctctactgctctttttgcctcctgcttctgtttctcagaaaaatagaaaattgactttgctttgttcaggggagtccatggcatgtccaccactcccatttaagtcaggttaacagggtaaatgctgacgatgcactgagtctactggttctaaaagccctttgtatttgctttaccaccttataaaaaggcatggatcagtatttgtgttgaccttgaggcttttcttctcacaccacgcagatatcttaacacaggggttcacacatggtgaccgggcagacagatgcgtgtgaaactaatgtgtagactaaatgcaatatacagttaatgcctggtgggaaacagaattttcctttaattgcccatttgtaagattgaataagtaggcaggcagagtgtaaacacagccccatctatagacgtgtgtcttgggaacagaaaggatcacacattcttaagctaagacaaaggctttagtttgaagataatgtctttgattatttcagcatggagggctatagatagcctcttggaggctccgctagaaaaaattcggaatggattaagtatatattttcccactagctgtgtctgaacacatcactcacggctcatgcgaaattatttctctgccaggcgtggtagtgcatgcctgtagtcccagctactcgggaggccgaggtgggaggactgcttgaggctgggagttcgaggttacagtgagctatgatcatgccactgtactccagcctgggtgacagagtgagaccctgtctccaaaaaaagttatttccacaattcattcctacattccggaaaagaataaaccatattaataccacatcccaatgctagtattattagatctgagtagtgaacacatagactggtattcagagattccccaaatcaatctttaattgttagacataataaaagtgaaagggcagattcaagtccaggaacgtggacagatcttaagaaggaaaatctcctttctttcaatctcccagcttctcaaacccgtagctgagtcttgagcaggcaaatgactcagaaacgtttatggtctccctggtactaaagtactgtatacttagtttcttaaaagaatctgattcatagtgagccattctactgaaattgcacgatttgtatccaaatagcaatacaacctctatccaatggcttttggtatataataaatgctctccaggctatatgtaacattcgttgtttactatattagaaccagtagtttgctttataatttgaattgtataaagcaatacttatactgtgtgtctactagattttatgaaaataagacttgaaaagatgacattcctccaacaatgaaaccatgtaaattgaagacagggacctgattatactattaagtgaaaagctaagttgctgaacagtctctagcagggtctacatctgttatctgtccatttctgtatttgtgtataaaggaacaacaaaagttagacgaaaatgtgacaccggaatttatccatttgtctcaaagaggcgggattccaggaagttttaattttcttttttatgtttttccttttataatcagaggaatgtcatttttaaaaggtttgagttgtggtgtaatacacatagcatagtttgccatcttaaccatttttcagtagacagtcagtagcattaagcatgctcacactgtggtgtaaccaatctccagaacttcttcatcttacaggaatgttgtttttaaaagagagaaccaaatacttctccagatgtatgtgttttgaaaaatcaaatgcaaagtaagtaatggcttaatcagaccgaaccaccataattgaatagcctgaccaattcgtgaaagaactagccatgggcctttcactgtctttttttgtttttgtttttgtttttctgagacggagtcttgctctgtcacccaggctggagtgcagtggtgcaatcttggctcactgcaacttccgcctcaagcaattctcctgcctcagcctcctgaatagctgggactacaggcacaagccaccgcacccggctaatttttatgtttttggtagagacgggatttcaccatattggtcaggctggtcttgaactcctgacctcatatgatccaaccccccaccttggcctcccaaagggcttttgattcagcacatgaagaggaaatcacgggcagagctgtagaaatcgtattagaatttcatctgtgtagttccttagaaagcttttcattgaaccacctgtttcaatttccattttttaaaaaaataaaatatacctctgtctgtaatcacgctacgatgagcagctgacattcttactcaggacttagaataataatgctttagagtcctgcacgaagcctccaaaagagtggaaaaaatacacaacccttcgaaacaggtttactcaagcacggtgagagaggctgggcggtcattgattaacagggtatgcgttccttctcaaagagatggcaaaggaagcttgttctaaacttttccaccatttcaatggctactttctcctgagtcattaagggaacactggtattaggttttgtgtcacagttgtaccaaggatacctcgccagctaaagttaatgcttttctaagtgcttatgaattaggggacagtcccggttctgagctgaaggaattctcatctaaatgcaaatcaagacaagcctgtctaggatgcataaataggtacagtaatttttccaccatttaatgttcagccccccaaatgcattttcacacaactctattggtaaagaagtatcccttattagaattaaacgacatttgctttcttccccgcaccggctgttacataggtagaaagtgttcagagtcttgatttggttgacttaaggcatgggaaataaaatggacaaagagaatcattttcctaacctctgcttctccacatcagacttctaaatccacgtccgtgccatttctatttgatgtcccaaaggaatgaaagaaaatgtgccccagatggaactgaggtttcatcccagctctacttctccgtccagtgtttttctaatttaatgacactgtcatccttcctttcatgccagaaactggagagtccccctagagtcctcttcccacacgccacatatccaggctgcacttttataatgaattccttcctctgaatctccactcctgtggctgtaattcagccttttgtcacctctcactgggctactgcagcactttactggttttctggtttagtcttttccgcataaattccagcctctagcctgttactagagtaatcattccataaaatgcaagtctgttgctgggcgtggtggctcccagcactttgggaggccaaggaaggaggatggcttgagcccagaagttcaagaccagcctgggcaacacagggagaacctatctcttcaacaacagaaaaaaaattagtcgggcatggtggtgtgtgctggtaatcccagctacttaggaggctactcaggatagcttgagcccaggagtttgaggctgcagtgagctatgatcacactccagcatgagtgacagagggagaatctatctctaaaaacaaacaaatacataaaacacaagtctgggcttggcacagtggctcacacttgtaatccctttggatttgggattactttgggaatctttgggaggctgaggtgggtggatcacctgaggtcaggagttcaagaccagcctggccaacatggcaaaacgctggtctcttccaaaatttaaaaaacaaaacaaaacaaaaaaacgacacaaatctgaacaagtccctcctctggaaatcatggcaagggagggaagggcaagtttatgctgtttgtctgtgccacttcaaatgtgcagcccttccttactcaaggaggttaaggggaagaacaaagacccttccaccttcactttatgttactccaaatctcctcaatcagcccaaaagcagagtgtgtaattctataacgctctgaaggcaaggagtataatcttcaagtcctaactctgctggattatttaccacttggccaacattttctttttgtttttgtttttcaaacagggtctcagtcctctcgcccaggcaaaatcatggctcactgcagcctcgacctcccaggctcagatgattctcccacctcagcctcccaagtagctgggactacaggcgtgcaccaccagcccagctaattttttgtatttttaagagagatggggttttgccgtgttgaggctggtctcgaactcctgggctcaagtgatctgcccacctcggcctcctagaccgctgggattacaggcgtaagccaccacgtctggcccactttgccagcttagtggccagtctgatcctccttaagggcaggacaaataactaattccactgccctctccagtggaatgcactccacgtctttagtgaggcaaagcactactgtttgtcccttgcctttctggggatgagactcaatctgcccctttgcattggatgttccaacaagcaactggctagcagtataaagggaagctctggcacagattagtcacagattggcaaactttctgaaaaaagcccagatagaaatatttcggctttgtgagccatatagtctctgttgcagcaactcactctgctgttgcagcatgaaaacggcaaggacaataaataaatgaatgcacgtagctgtgtgccaataaaactttaatcacaaaaccaggtggtgggccagacttgacccatgagacaccatgtgccaaacccctaatcaggtatatgagctaagatgctgcgtcaaccttggatcagctgagaatctcggatctctccagaggtgacggacaaccatgctgagaacacggattctggagcccagctgccttggttcaaatcttggctttagcgtttgctagccattgagcctttgggggagtaactttacacaattttatctcatttgagcctcacagcaaccctgtgagataaatccgatattcccatttaacagaggcccgggtacagtgggatccaaggtgcaggaacttcccattagcacagggacatgccgagtcactctcatcttttaaaagaggtgccctccctgcctgggtccccctcctcctccagccaagccctcactcacatctcctcttcacaccaagcttcttgataaagctgtccacatcctccacccttactttgtcatctcacactcactttgcaaccctctgcaactggcttctgtccctggctttgaaattggtgacagttttatcatgatggtttcttagacaagaaatacacatatttaaggtctactgcatacctaggtgatgtcctttattgacattgccagcccaagttagggaaaaagataatcacggtgcactctgcctcccaatagaggtgctatatgtaggttacctgtgattcactctagtgaacatctcaactctacaacaccaatatttgagccctggcctcacccaggtgaaggcagggttgcctctctaggatggaaaaattcaatatgaaccctaaagtggccatcgtcatggttaagggatgcagattttatcttgagaactctatcaaccaagagagcaaaataatacactactggacatttccatttttcaccctacacttgcatccctgtgaccaaaatgatgctaatccaaggccatgcaatctgtgcatctgtaggagtaggtatttcatctgttagttttgctgccccgtgagtgaagaggcaggatgcacccttcaatggctttagctccagagttctgcttctacaggatgcaccccctttttgctggggagactctcaaagagaggaatgatctcaactgtctctgagtgctcagtgcctaggacagtgccaagcagataggaaatgaccactgaacaagtgagtcccctcatgggtccctggggagacgacagaggcagggagtttatcacattaaaaagatccaacagcttttctttggagctcagctaccctggggaacagaatgagtaagaatcccaaagaccccggccactgctcagaaaaaagggccacgctcccagtcgtgtgtgtctctctctctgccttctttctgttcattgagtcatgattccaacagtgcaggaacataggaagaatgccaattataatatttttttgacagctgggagaatagacacactctgcctgtctcttcagcacacaggcagcacttgtctaagcgccagctctcgtgataaccaatcccgctgagaatcagttctctctgtagctcctactccttgacccaatgtgaaatttttccaaactatttttaaagtatctaatctgttgtgagtcacagactatagagctgctagtttaccatttctgggcagacagctttaacatcaagacctgatgaggttgtaagggtatttaaaatggcagtcaggaatataagagcaaagtggtgcatataaagtctttaactgttccttaatgtcaagcgatttgagatatttatagattttttaagtgcctttctatctttgaaagaaaaggtaattatttcacataacaaccttgaaagactggtcagtgatcttctcccagattttcataataggagaactaggggtcttggagactgactgaatggcaaaagacagtccatttttaaaaacaacccaaagctcttgagtttattatccatggctcaattcactgagctatgctacctcccctcacaccggatgaaacaagtattagttatctactgatccataacaaatcaccaaaaactcagtggcttcagacaacaataatttattatctgttatggactgaatttatgtgttatgtgtttccccaaaattcatatgctggatccctaacctccaatgtgactgtatttgcagacagagcctttaaagaggtaattaagtgaggccatagggtaggccctagtccaataggacttgtgtccttaaaagaaggagaggagctgccaaggatgaaagcacagtgatgcctctgtaagccaaggagagaggcctcaggagaaactgaacctgccaacaccttgatcttggacttccagcctccagaaccgtgacacatcaacttctgttgtttaagctgcccagtctgtggtattctgttatgatagtcccagcaaactaatatagtatctcttatggtttccgtgggtcaggaattcatgaccagttcagttggacaatcctggttcatggtcttttatgaggtctctcagttgggtatagctggggctgcctaatctgaaggcttgactggggctggatgatccacttccatggtatgccctcccatggctggcaagctagtgatggctgttggcaaggggccgtagttcctccctgcctgggcctaatgaaacttcttcattcagtcctaaccaaccatcctgcagccttccctttagtttagttatatattaaatatataataagaagaaataggacagcccttattttctcctgtcaggattttggtaccataaatttaaaaatgaaggggagaaaaatcccatgtattttccatggtgcactacccagatcccctttcagaaatgaagggtattttcccagctgttgagaaccctgccaactgacaaccttcaactattagccgggattgcccttggctaaagagagctgccttgcccaaggtcagctccctgcccaggacagctgtcgtctactgactggctggtgtcagagtataaaggcctagtttctttgcaccaacctgggataactctgatgagccgccccagcttagtcctccctgtgggttagctgaggcctttgttgagactgcattgcatcacaacttcaccctctgcccaatcttcctgccttcccttctcccacaggtgtcaatcctcagagcacttcatgataaacatcctgcacaccaatctcttcttagagtttgtatctgaggggatgcaaaccgcaacaatctactttacaggaagattattctcagagctgtcaaccatctaaaaatagccaaatgaacctccagattctatctagtacatcatgtgttcaactgcagacctagctgttgaaaccaagtgataaggtagattgtcttggtagagatagaggtgtgcctaatcctccacttcttcctgtatccactccctctgtaatgtgactgccacttctgcttcattttgttggccaaagcaaatcataaggccaacccagatctggggaggaggaaacagattctaccttggataggaggaactaccgtgtgcctgttctgagcctaggcctcaagggaccttgcatatacttctgtctctcttggaaccctgtcacaggcatttgaacgagctggggctagcctgctggaaaagagaccatgtggaattgagacaagttagctgttcctgccgaggtcactctggtccagccagtccccaagtaacctggtaggtgaccaaagatgtagtatgaataagcacagtcaagaccagaagaatgcccacccaaattgctgacccacagaattgtgagttaagtaaatggtggttatgttaagttttggggaggttattgctatgcagcaatagaaaaactgatgtagtatcagctatggtttggatgtggtttgttcctgtcaaaacccatgttgcaatttgatcccccaatgtggcagtgttgagaggtggggcctagtgggaggtgtttgggccatgggggcaggtccctcatgaatagattaataccctactgcaggggtatctcacaggaatggattagttcccttgagagcaggttgttaaaaagtgcctgtcttcctcagtttctctctcttgccaggtgatctctttgcacatgtctgctccctttctgctttccatgagtggaagaggcatgaggccttcatcagatgcagctgctccatcttgagctttccagcctccagaatcatgaatcaattaaacctcttctctttataaactacccagcctcaggtatattgttacagcaacattaaacagacaagactcaaatctgctggatacatgaatcagctggcaaaagaagagcatagagaattcagactatagaatatgtcctcgattcattttaatgggctctggtgcacccagctgctgcagaagctgctaccgatggctcacacctgcaacctttttagcaggatcgttcttgggtgatcaaagccatctcagctggaggtgcatctcccttgtcctgggacatcctataactaaagcctgtcttgtgtgagggcacaaaatccagctgtcttgcctcaaggtagggcaaattctggggcaatttacagcaccaatctcctctgctgtcacaggctgagagtggatctcatctgcaaccacatctttgctcagcttcttcttcctttctctcaccctcttacaggttccttccgagagcactcccttaataaacaaacaaacttgctcctgaaaccccagctcaggctctgcttccaataaatcaaaagtgaattcctaggagaaaaagatggggagcatgggagtgactgctgtggaaggaaattggaaaagcgctgatcatcctaacacctttgcagtagaagttttcaaaccaatagaagatgactctcctcccattggtccaagacaaacgtctccatcgcaagtgcttgatgtgctcccactgcctataaggaaacgcactcctttcctttgtaagacgggaatgacactttcttttctctccaatctttaatttctccctgcactcactctttccccagtagggtttgagtctattcctctttgtaggaagatgccatcacctccattcttctagctacagcccctgtcctctctctcacatcaggatacttgagctatctacactagagatcaccacttctttatcccttaatcatcaactcacattacatggcttctgctgtcgaccctgccactaaaagtatccttgccgaagtcacaacgaccttatgttacacaactagttggctgcatttgatgtcactcaacactcttagtatgtgaaacacgattacacacattccctttgctcctgtgatgctgtgttcacttggatttctgcctcatttccagggaattcagaatccgtttttttcgattgtcccttagatgtccacgtgttttctggttctcttttcacctgccatacatttctatgaattatttcacctactattatagcaccaattgccacttatatctgaatgattttcaaattgaagttccagctccagactcaatatccacttgccctttgggcacctcgacttaaatgtgccacaggcgccttattggactaccaccacctacacacacacctgtgcacacacctgcatgcacacacacctgtgcacacacttgcacgcacacacctgtgcacacacttgcacacacacacacctgtgcacctgcaggcacacacctgtgcacacacctgcatgcatacatacttgcacacacagttgcatgcacacacacctgcatgcacatacctgcatgcacacacacctgtgcacacacttgcatgtacaacttgtcacacacctgcacacacctgtgcacacacacttgcatgcatacacacctgtgcacacacctgcatgcacacacacctgcatgcacacacacctgtgcacatacccgcatgcacactcacctgcatgcacacatacctgcatgcacatacacctgcatgcacacacacttgcatgcacacacacctgtgcacacacctgcatgcatgcccacatacacccacacacatgcactcacatatacaccctgccctcttcctcctctgctccatacccccagagctggaactatcatccatccacttttccatggcaaaacctttggaatcacccctgatttgtctccttccccttcaattaatcaaccactaccttccaaattcctttcaattttaccttcaaaattgccctctacttttaaacacgattccatttctttctaccttcagctgcaacctgggcctagattacttcacactgcatctcgtctgggctcctgttctaaccacctccaatctaatttccataaccagttaggggatcaccctaaaatgcacagctgattattgcttttccctgttgaaaagaatttcgacttcctctgggatcagctcttccactcatcaagataggatggggtttcctcccacaataacggaacgggttctatcacactccattgtaatgaattacctgtctgttcttcccaaagaaacaaaagctccttcctttgttcaattagtagatattcactgacaccttcctatgcataatgcacggagctgttaatcaaatggtaaataaaacaaacattggccttttcccattagcagggctcacatatttgtcatcctattacccatgctagcagttttaggcacataagttgcttaataggtatttgctgaataaatacatgataaaatgagtgctgttggccgcgcgtggttggctcacgcctataatcccagcactttgggaggccaaggtgggcggattcacctgaggtcaagagttcaagaccagcctggccaacatggcaaaaccccgtctctactaaaaatataaaaattagctgggtgtggtggtgcatgcctgtagccccagctacttgagaggccgaggcaggagaattgcttgaacccagaaggcagaggttgcagtgagctgagatcgcggcaaggcactccagcctgggtgacagagctagactgtctcaaaaaaaaaaaaaaaaaaaaaaaaaaaggagtgctgtcttctaaagactaattttctccattccattccctattttagaataaaattcatgggaacagattttataaaaatgatcttcatggtcgatgtttacagaaagtatctttttattacaaaaggcagagataaattacatccaaatattttcagaccatcaaaagtctttaagtaactcacattcctccacagagattatcctggtagccaaattaacagaatcagccaagcacataaggaacttagcacataaagatactcaataaaatccaattataaaggagcaaatttctacgaacttgaaactaccacccaccctgctgccagaatgtaatgatatgttctctgcatgccaaacatatcttctcccaaaagataacaactgttttgggttgaatagcgtcctctgaaaagaggttgaggttctaagccctggtacctgtgactgcaaccttatttggaagcagagtctttgctgagtaatcaggttaacctgctgccaggatgctgaaagcagaaagggcttgagccaaaccttggccacagaggctgtgaatgacgcaggtgaaggcagcccttgctggcctgagggctgaaacttacaagtggggtgaggggcttgcttaccatcaggtaaccaatggggacattctcttccattccttgaaatacaccctttcaaaatgtaagtggggagccttgggccatcagcctgattttcagaagctcaaatgacataaaaattggagtcttgaccagatcattcctctttttggtttatggtgataaatatacataaaagttaccatttgaacttttttttttttttttgagatggagtttcactcttgttgccctgggattacaggcgtgagccacctctcccggccaccatttgaactatttttttttgagaaggagtctcgctctgtcgcccaggctggagtgcagtggcgccatctcggctcactgcaagctctgcctcctgcgttcaagcgattcccctgcctcagcctcccaagtagctgggattacaggtgtctgccatcacgcccgggtaattttttgtatttttaggagagacggggcttcaccgtattagccaggatggtctcgatctctcgtgatccacccacttcggcctcccaaagtgctgggattacaggcgtgagccactgcgcccagccaccattcgaacgattttcaagtgtacagttcagttgcagcaagtacattcatactgttgttcagccatcaccaccattcattgccccaactctttcacttttccaaactgaaactctgtctccgtcaaacactaactcatcttttcccctccccccagcccccggtacccaccattctacattccgtctctatttggatgactctagggactcctataagtggcattatgcagtatgcgtccttttgtgactggcttatttcactcagcacaaggtcctcagggcccctccgtgtcactccctgcgtcggaacttcctctctttttaaggctgggtactattccatcatctgtatacaccacatttgtttatccattcacgacatttggattgttgttgaaatcccactcgactgcacactcctgctgccagccgcgtgctgggcacagggcacgtgctctgggtcagctgctgagtatgggacacagctgagcatactcactctctctctgaccccaggacactccctctctgatcaccgtggcaagcctggaaggacctatacttgttggccttgaccaagggctgcgtggttgtgtggggtataaacagttgggttataaggagataagaacaccactttcctgttacactcgcggggaggaagctgacagcaaacccagagcactccctgtattctcttttctttcaactgggaaggctctgggcttgtccccagcacaaagctgctgccgtcaaacatcagggactcgtggaagagccctgcgtctgtgtctgtcactatcccttcaaatgatctcaaataaatcgtggttttctcgtcaaaccactgtctcttcttaaatggggttattctaatccatgatccctagtcaaagcctaattttcttttctagaaggttctcccttccctctcccttaatgtaaacactgacagtactccaggctcagcccagcaggtgacgtgccttgaagctgtcattgcccttatcagaccagcggttttccgtttctccctcctgtagggccgactgtgccactcattatcccggcgaaaccgctctccccctttactgagctgttttgccccagtactgttcagttcccaatcagattgtaagctctagaaggcaggaacaataacttgcagtttaacctttggcacctgaaataatactttgctacacctgtgtttaataaaataactgaatgaacaagaataggaatagtatgttctcagcatggcaacgcatcttctcctaaaagataacaactgttacagattggaccgtatctcctaaaaagagatgttgaagttctaagtcccagtacctgtgaatgtgacttttggaaatagggtctttgtagatataatcaggttaagatgataggggtgggccctcatccaatgtagcttgtgttcttttttttttttttttttttttgagacagtgtctcgctctgtcacccaggccggagtgcagtggtgcaatctcggctcactgcaacctctgcctctgggttcccacggttctcatgcctcagtctcctgactagttgggattacaggtgcccaccaccacgccaagataattttttgtatttttagtaaagacagggtttcaccatgctggccaggctggtctggaactcctggcctcaagtgatccacccaccttggccttccaaagtgctgggtttacaggcatgagccaccgcacctggccttgtattcttataagaaggaaattgggatgcaaagaaagacaaagggaagatggctatgtgagaacgggacagagactggagtaacactgtcacaagctgaagctggagaaggcaaggaagaactctccctagaggctttgaagagagtgtagccctgccaacaccttgactttggacttttggcctccagaacagtgagacagtacatttctattgttttaagccatccagtgtgtggcactatgtcatgccccagtgacatgcgacactaatgtgacaactgaatggagtggttccagccatacaggtagacccagggatgtggctctcacagtgtcgctgggcacgggaataatactgggtacctgcggtaattaaaccagcagtgacagctggggtctcagtagggcccactgtgttgaaacagagagtgcttaagtgcttagtgaagccacggagattcgctgcctcggtctcaggaagtgctggaggctgcacacgtctgtcgctccatcccactcctctatgaaatgctccccttccaaagagggcatcctaagtctgatgatgtcatcagactcaaaatcttaaacctctagaataacacttctgttttactttttttttttgctttacctatgacattttatgaatactgtagtatcccaagcaaggtaaattcaaataaagctttcaatgaatgatttttaagaagctgaggggaaaaaaacctcctcctggtcatgtcccagatgttaccatttttcattttgtttctttttttcttttttttttcagacagagtctgctctgttacataggggctggagtgcggtgtcatgatctcagctcactgcagtgtctgccatctaggtttaagcaattcttatgcctcagcctcccgagtagttgggatacaggtgcacgccaccacacccagctaatttttgcagttttggtagagacagggttttgccatgttggccaggctggtctcgaactcctggcctcaagtgatctgcctatcttggcctcccaaagtgctgggactacaggtgtgagccaccgcacccagctattttttgtgtatttccatttgctattgtgccctcaccatttctccctcagcctgtgatttatggtacaatatcctgaagatgtcgggagcacacgacctcagcctcggctgcagatagactgctcagcttggggcaataactgctctgccctccctctgccacccggcagccccacccacagaagggcccagacttacggctttggagggagcatagtgtgtcggtgatgccagtggaggcctggtcgggctctggaaggaagacgggcagaacctctgccctgtgtccgggggggaagacgaggcatagatgcgattctctaaccgttcaggctcgtgcttataggattccaggggaaacgtgtgctgcttggtcacttgggtgggtgttgacggagaggaggagaggccggaggctgcagaagaaacaccaaggacggtcagaggtccggcttccaggaagggacgtcgggggtggtcagaggtctggtctccaggaagggagatggggagaggtcagaggtccggcctccaggaagggacgtcgggggcagtcagaggtccggcctccaggaagggacattggaggtggtcagaggtcccgccatggcagagggaggctctcaccattcctggtgcccaaaacctcaaatggcaagaagccaaattattctgaatgttgaggaaaagctttaaaaaccaatttctagtctcttagaatcagctgtttccagaaacgcctcactatccacgctcggttgtgggcagcatcccctcattgggaacggggtgctcacacggtcccgagttatctggtgaacttttacacacaccctccagaggctattttcctccattcagccaaatatcatttgatctcctctccttctttccccagcatggcgccaagagcaaacgcagtggtgccttatttattgaggtaaaacatggggaagttcggaaaatgtgcagcagagatgcaggccaatgctgcagaagccatgggaccatgtatctgaggagggggagggggaggggacgggaggggaggggaggggaggggatggatgtgttattcctaccaaaacgtgcaacatgaacatcaccactgtaagttcccagtagcaagacttcactgcgaagataaatacccaaggagacttcagggaaagggtgggactggaatggggtctaaaaagtgaaacagatttagatggtcaggaaaagggagggggcaaataatgggaggggcaacggtgttagtggaggattgtaggaagactggagacatgaatcttctgggagttaaaggttctccactttgacttatttctaactaacagaaacaactctatttcttccatagacttatttatgtaatttttaagtggcgagtgtacacctaattcattaccatggtgcttttgaaagcagagctggagatgcagaggctcgtcaagaagaggttaaataaatcatggcacagtgcacaggtaggatgtgacctgtgaatgtgaccttatttggaaacagggtcttttcagatcaaccaagtctagatgagattttgctggactagggtgggccctaatgcaatgtgactggtgtccttataagaagaggaaaagagacacagaaacggatacccagagggaaggcctcgtgctggcagaggcagcgatcggagcaatgcagctgcagccaaggcgcgatggggattgctggcaaacccagaagccagggcgaggcaaagaggaatcctcccctacaggtttcagagagagcgtggcgctgccaacacctcgattttgaacttctggccttcaggacagggctaaattttagttgttttaagccactcagtcggtggcactttgttataacagcctgaggagactgatgcaatgcatggattgtgttctaagagaagcagaatctggctttgggtctgatatctcaaatctctttttcttttttttttgagacagagttttcactcttgtcgcccaggctgcagtgctgtggtgtgatctcagctcactgcaacctctgcctcccgggttcaagcgattctcctgccttagcatcctgagtagctgggattacaggcacctgccaccaggcctggctaatcttttaaaaatatttttagtagacatggggtttcaccatgttgggcaagctgctttcgaactcctgacctcaagtgatctgcctgccccggcctcccaaagtgctgggattgcaggcatgagccatcacactcaccctctgatatcttacatcttacaggtagaaaaataaaattttaaaataaaatttgaattatgcaagtcaaaccaaagatgtcagtgaacatgccctgttaaattacatgtagcctagagctgcctccttaaatattttaagtttggcctaaagggttttctgtacattgtgaactgtaacagaccatagcctacattcgtgccagccagagttttggcaatcacatgtagccaactgttccaaccgtgttcaagtaagacaaatgctgagctgtaaccaatccaggtgtttctgtgccttacttccgctttctgtggtcactttcctttttctgtccatcaatcttcttccaccacatggctgagagctgggctctcggagtctactctggctcagaaggctgctcgatttgcgaatcgttcattgctcagtcaaactcctttaaacataattcggcagacgttttccttttatcaggtcctagagccaccagtcactgtttctggtctggacaaggctgcgtcacctacagagccacaggcctggttcactctccccaggcatctctgctgggttcctcctcctcgcagctcccagaaccacccgtgtccctcctgctccatcctcatggggaaggacctgtcctcctgtccctcgtgtcaccaaactcataaagccttttcactgtcctgtatgttaccacttaatgacaaactgtttaacgttcaaaccaaacataaaagtatgtaagtcccctctccccaccaagatctaccgtctgtcttggggacgggggtcctgccactccctctgggccccagggcacccagtgctgtcctgagccaaggggtctggcaaatgcctgctgccaccaggcaaggaacagaaagaacagtgagaggaccggctcaaggtcagggtgaatctgttcctctctgtggagagtggggcgcatgttttgttttgtgtgtccgggggaggtttaggaagtcacctattagagaaggagcccccttttccagggagtcccttcaggagactgagcagtgtgagtggaaagccctctggaagccccgggctggcacttgggaggcagctctgggtggaagcaggaggagagggttaggacccgaaacttaaaatgtaaaaggccctcacaacaaagtcccaaactcttgaaaaatagaggccaggtgcagtggctcatgcctataatctcagcatttcaggaggctgaagtgggtggaccacctgaggttaggagttcaagaccagactggccaacatggcaaaaccccatctctactaaaaatacaaatattagctaggcgtagtggcgcgcgcctgtagtcccagccactccagaggctgaggcaggagaatcgcttgaacccaagaggcggaggttgcagtgagctgagattgtgccactgcattccattccagcctgggtgacagagtgagactctgtctcaaaaaaaaagaaaaaaaagaaaagtagaatattttcccccaaaggtcttgagaagaaaaccctgctttgaggtggggtggggaggaaggagagggaagaggaagagtgggaaggtcctgatgtggtttagcagctcttcagagatgggggtgtgtcagcaggcaggaccacaaaagggctgccggcccatccggacccttctcagggccaggctccagctgcttggcactgagaaatagagacagtagccagggctcggggaggcctgcccggggcctctcagggggatctgcaggggcagagcaaagaagcctgtgtgctattttgtgtgtagtgtggggcactgcctggggccttagaccccagagtcatatccttcagtggttcctgcagcaacaaagtctccagcaggggctcgtcctggtcccacaatgcacctaggacaggctatctcctctcctgagagtcaagagggaatgttctcatcctcctctcccagcccctttccccactggacacagggccccttcagtggcacttcccgggggctgtgcccctgcttcctgtaggcatgtgcagggacctgatggggcagagctgaataggatgtggtggggggcgttttaggttcaaaaacctgtgccaccccccacatcctcatgacctgtgacagccctgcagagaaacccctctggggggctggggtcttcgtgtgtaaaggaaggggccagccacagagatctctaaagcctcctccatggacaatgctgaaaagtagctatgtccatccctgagcagggcatgatcaaaactagccctggccaggtgcggtggctcatgcctgtagccccggcactttgggaggctgagggagaaggatcacttgagcccaggagtttgagaccacctagggcaacatggcaagaccctgtctctattaaaaaaaaaaaaattggccagatatggtgacatatgcctgtagtctcagctacatggcgagattgcttgagcccaggagttcaaggctgcagtgagctaggactgcaccactgcactccagcctgggtgacacagcaagatcctatctcacaaaacacaacacaacaaaatgagcccaaactgcacccatgcaggcattgggcaaaggcccagaggaaacaggtactctgtggtgcctatctaggcaccactgatcaaaaccacaaacgcgcatgttcctggacccagtaattccatttctggggccatagacttatttgtgtaattgctaagtgtcgactgtactaagtgtcggcttattcattaccatggtgcttttaaaagcagagcctggagacgcagaggctcgtcaagaagaggttagataaatcatggcccatctgcaggcacaggcagccaccattcctgtcggaacatgacagggatcctcgttcctttcatctccaagatggagcggtaagtgaagaaagccaactgcagagccatctgtatcgaatgataccatttgtagttttgaaaaaaggaaagaaagtatctatattctgcctgtctgattttgcctagactatctctggcaggatctggaaacactggctgtctccagggaagggaacaactggcagggaggactttcatcatatcccctttttgatttttcaaactttctatcatgagaatggattatccattcagaaaattacttcttttcagccactgctttgcttttgagccaagaggctggcgaaggccatatttaagcactgacctgcttcctgccctgcctgccccgacgcgccccccagctctgtgcaggggtgtctcccacgaggaccaggaccaggacctctgtcctgtctcccactagaatcagggccatggctgtgccttcctgagctgtcctctcccttgctctttctcttcgagaagtttttccacttccaacattcttcagggatgaagcttagtcactgttgtgcaagggatgttcacagcccatgaaaactccttgctagttctttgggtacagaacgttcatctttcaagtaaacagtttaaagagaatgcaactgtgaccaagcccctccccaccccctgccgagagctcttaagagcacaaaccacggtgtccgctcctcccatggccctgtccccttgcaggccacccccgtgtgagtactggaatgatcctaacccagtcccaaaggaggtgagagaggtggcgggatgcaggagtgaacctctggggccgaggagatgagaaggtggactgttcatttgggggtgggaacacctcatttctggtggggctgaatgattctctatcattgccatctttccaagttcagaagctgctcccatctttccacctggccttcctgttccttccagagctggtgactcctgtggggaaaacaggtggcactctggactacagagggggaagggaaacttttagaggaagggacaggtgaaatgctgagactcacagtgtgtgcattagggatatgtgtgtagttaggggcatggggagtgaaccctcctggaacctaacatatgccctatctgttgactgatacccgaaatgtttttaagagggggtagagtcttgcagcatcaacactttttttttgttttttgcacgatgccaccctgtttacagagggcttacacactctggccccctctgcccctcacagatgaagaaactggtagctggagaaagttcagctacttatccatggtcctttagcgaataaatggcagggaccacacctcagctccactgtcctgactctataacccagacactttctgccacaatcaaactggggtatcaccgagagaaagaacatgaagacttaaaattacattttagctgtatgaattactctcccagaagtggggcttcacggggccaacaggaaggagagcttggatgacactgggtgactgcagagggaaagaagaggtgccacagaagagagaagggcacagagacggagtgagcttgggaccccatgtgcttcctaaggtgggacagccccatgtagggagggacaggcttcccccaaagagggttttcttccatgccagccaggaagggtagaccaacaaagaagtgacttctactcaggtttatgctattcaatcagtagagaaacaactgtcttatgagtcaggtaaggtgggtagtaagaatgattcctaagctttttttcttttcaatgttggtatcactattcataaataaaagggaaaatgggcaatgctgacacaatccctcattactttttttgagacaaggtctcactctgtggcccaggctggggtacaatggtatgatcacggctcactgcagcctcaaactcctgggctcaagtgatcctcccacctcagtctcctgagtagccggaactccaggcaaataccattacaccagctaatttttttatttttgtagagatggcatcttactatgttgcccaggctggtcttgaactcctggtatcaagtcacctcctgcctcagcctcccaaagtgctgggaatataggtgtgaaccgccatgcctggccccccattacttttaaatagaccaatgtatttcttaatcataaggtcaactgctgaactcaaccttgggtctgatcagtaaatgaatagttcctggacagcttccacgggccaagtatgctgggggtgttgaggaaggaggtgctaagatggattagagcaagtccctgtagtctgtaggagaaatggggacaaaaccaaaaaatcagccccaacaccaccatgcaataaagtcgagaaccaggaaagcaggggggagctcagggaagaggagagggcctgagggtgggggtgggacggtggctcagaaaccccaggaaagagctgggccccgatcctggaggaggacacaggtctgccccggcccaggggcctctcctaagggcccaggcagaactgggccatggccaaagtcacccaagaaggctctggccaaaggacagacaggtgccccctttctgttccttctgagaagacatctcctcctttttcctgctccttaaggactttgtttaggacgccgccagcctctgcagtgaacaatgcctttgattctcccagggcggcagccaggcccagtgaacagcccagcgagggaacagaaactgctcctggcagccacacagaacaccacgaaagggggtccagacactggggagccatgggctggtgacttcacagggcctggccctgctggcaggcgctggagaggaggaggaggagaacagaggtgccaccaaagggaactgagccctgctggaacggaatagctgtgctgggtggaaacagaggcctggccctcagaagccccaagctctaggtctggttttaccactaagttgccatgggctctgggacaaatccaccccttgccttggtaaaaataaaccaggtagaccagatgcctatctggtgcaatccggcccctccactgcgtaaatggaatgagctagagcctcattcctgcctgaggaacggaacgacaagaaggaagtaatgtattctgctgactgttgttacaagagccatgaagtgagaagagcaacatttccattgacactggagggaggctttgcttatacagggttttgaaacctcctaccactcatcagagtgaggggccaggtgttgttccctactttggagggaggatggcgagcgccgtgagggggaacggtggcccagggaggtgcccaacgaaagtgccacagccagagagggacaggagtacctgtgctgagtagctgtagcacacagagggatgcaaccagcaggcaggcggagaccctgggcggcgcgagaccctgtgtgacacaagttcaggccaggcaggtgacccagaacccagcctctgatgtctgcttaggactctgttttctcaaggagcaaacccactgcttcaatgttttggccctttctcaggtgccctctggcctggctcctacaccctctccccgcacggcccctattgcccgcaggttttaccttccacccctcattccagagccctaccctccagggccgctggagctgagtgcccagccctctgactccagaatggctctgggcagtgcaggcaactgcaggaggctgggggagccagggaatagaggggcagtatcctcagggaccctgcctgccatgcctccagcaactcctcttcccctcgtcgctccaggcctgggcggtaatgactcctgaaaccctgcccacacccctgggaaaagccccttcagaaccccagctgaatgtccttgtttcctgcccccaacgatacagtttccagcctccactcccaaaccaggataaggactggccagcaccgtggaagcagctgagctctggggccagaaacctgggctggaccctaagtcaccactcgccagctatgtggcctcagaggagtcagctcagaggcttgcttcattctttgaacatctgagctgcccgtgggctttgtgtgatgagtaagaggtaagaagcaaagcaccctaggacactgaatgataaggcccgtattcagtatgggcagctgccattgatagcaggtgacgtctccgggagaagaccctgctggtcggaagctcagagccagctctagcttctgccttgcctgggggacaggagtgtgacacacctgaagttcaagctgcagctcacccctggctgactccaccctgcggcccctccacacaggctcagtgtggaggtgagaaatcccagctgagccctctctgacaagttggggtctcctccaggcagtcctggccatagccatcccagtgcccccagccacagtcagccacaatgcactctggaagctgttcctgagggcgtggaggccagtccctggtttctcatcacctggagacgtaagaaattggaaaaagctggtcacccccaagacaagctccaggtgccacacgtcagttcattgaacagcgcctggaccagggtgactttaggtatcagtaccacttaggcccaggagtccacttcctctataacccactgcaggctgctgtttcatttgcacagaggcaggaataccctacacagagcgggcctgcctgagccttcagccatttcttctctttccccccagcccagggtgggagtggcgaggtcatcttcaagaccattctaccattctccaccctccgtgttggtggatgcattccagaatgatccattcaacctgaactattctacctcccacagccccagctgcccaatacttctctgaaagaagcctgtcctcagggccaccccaccaacacccctatcccatgctcagcttctctttgagaactgctgtggtagacaaatatttcagcttcagcacccctttacactcttgaaaaatagggtgtttaacatataatgagtttatggttgtcatttataaatgaattaatgtttaaaattttctcagttttaatttctaatataggctaggttcggtggcttaggcctataatcccagcactttgggaggccgagaagggaggggctgggagctcaggagttcaagatcagcctgggcaacatagtgagacccccatttctacaaaaaataaaaaattagctgggcatggtggcctgtgcccttggccccagctactcaggaggctgaggagggaggattgcttaagcctgagaggttgcggttgcaatgagccacaactgcgccgctggactccaatctgggtgacagaaagaccctgtctctaaaaaaaaaaaaaaaaattctaatatggtgaatattgattcatatgacccacagaaataaaagctccttgggatcctcatttttttaaaagtaacttctcagcaatctatattttttaaaacaaaacaaaaaataagtggcatttttactttttgcaaatgtcttgaatagctggcttaatcgaagatgctaggtttatgtatctgctagtgccctctttccctgtgagacggttttgctctaaacccttgtctgggcagtccccagtccctgtccccactgagtctaacccgacatgctgagtagagcatctgagccacagagacagttaggatgcttctcaggcttcagttctcaaacctggctgggccaaaagtcacctgggagcattgagaacacatgtgcccataggaccggaagatcctgaccgatggggccaggaggagcctggggatgtgagctgtgtgacgttccccaggtgacgcgggtggttggacatgttttggaaccattcatttaatccaatctccctatttcacagataggaaacttctaaagtaattgttagttcccattctttatggtcatgtggtccgagtgcctccatcctgtctcacagctcccttctatggaagagcaaattcccttccttctgagttcccagccacctgcttggactctgataggaatgactctccctgcagccaaggtcagcctcatgcagaaacgccctggaatgatgcctcgtccccgggtaccaggcgtttatgcagctgccggccaggccagctctcctgagctctgctgctcctttccagccagctgctttgagaccttgctctgaatgttcctaaaagacaagtttcacacccgcctggtgtcctccccaccccactccagccctgcccctgcaggaccccctctctcagcaggagtttctggactctggcccctttatagctgaatggccctggccctagctgagctcactctcaattcatatttcaatctggagtaaggtttcaggctgcagatttcggttctaggctctaagaatctgttttatgatcttttgtcattgaaactgttcaaaatatgttggaaaatatctgagtgatcttcaagtcaaagcatcatggtaatatggaaggtgaaaaaatatttctatttaaaaaaaaaactttcaggaatttttccaaggttattctcctaaaaggaatccggaaaatatccagtcttatagggctttgtatacccaataacattctgcacctagttatgaaatagttggctctagcatatgggtatttacatgggaactaacaaaacaaaacagaaatggtggtgcaggggaaggaaaggagaatctcacaggggctaattttaaatctgtcccaactctgacaatgtggtcccagcctctgctgtctgccctgttccttcttcacgcttgcttggaggtcagagttctacatcatggacccaaaacgtaaccctagatacttcgcttgggcaaaagacaacagcagatatgcatcttgatgttgccacttagaaagcagtcctggggaggcacaggggaggcccctctgctgctttgtgagagagagaaattctgccacagaacttttcccatatacaatggtttcggaaaaacaatttgctaataatttgtcaatgaaagggaaatgttagcagcctcagtccctctaattatcagtatttgtggaatcacaaaagcaacaggcattgtttggtgctgtggagatgaactctgccgaatgtgatagtctggaatgggccagcatgagaatcataggtggtaagaatgggcatgaccttggacaaacatctcagaacctcattttcggtggaggaagtgcaggctctgagaggtgaagtgtgtggccgaggatctaccccccaccccagaagcaggtccacagccatgactcaggtcttcaggccgcagcccagggccttgctccattccaggaggtttctgacggtgacctcatccctgtggaatgttggggagaagaccgtttgtatgggcgacaggaaaaagcacacggtcgcaccaggcgaggtgggtgcctcaggtcagaggtgtatctgccttgggctgcctctccgtgtccaccctcctccccaacggggctccctcggccagctgccaagggtgtatagggtggagcgggtagtggaaggccaagacttggcactttgggtttggaaggggagggaggaggaggaggaggaggaggaaatgaggcccccccccgggctccttgctgagtcagcatggtgactactgtcatttcctagaaggaaataagggaaggacaccaattcaataggagacctgggggactttcatactctcagctgatgccagggtgcccagtgagcaggggaaaggcttcctggccctggcggcaggatggggccagaatattcctgggcaggagcccccccaggtggcccatcctgcctgagcatgtctgaacatgttcttaggtcaggactagagttcgagatttcagaaatgtcattctaaccttgatctcttcgagatgcctgtttataacacagcatcgttcatgccaattgtctggcaaagccggtatacacggctatcgctatgatgtaaaacagcagatctcatgtgagggtaaacttggaatttaccccgatgagatgcggtgtggggagggtccagtggctgcgaggccctggaagcatgcctctttcagggaggcctccatcatcagagcttccgtctgcaacgtccctgccctgtgctggccagggaactccgcggcgggctcccccactgtgcccgggattcggacactgcttgccgcggagtgtttccagtccctcttgaaattcctggttgttgacaatttgtttattattctagctcttgaggaaacttcctaaaaactggggaagaagtagttcttcaactttcttgaatctcaggacacttggatcatctgacgaaactgatgaatgaagcatgggtacacagatttctctgtctctcaaatcacttcggggcccttctaactccccaaaagtcaggttttaggaatctgtattccgaggggtctcaaaatgttcacgtggttcccctctcctccagggtggccggcctccctgttccatcttctgagaggagctatacccattttgcaccctgaacctccaaactcagaagtctctgaggagccctgaataggagaaaatgtggctgaaaatgaagtggaaaatcagtgtgataaccaaatcaagatcacgcctcgctgggaccctgtcacactaaagcttccagagcatagtcgtttttaaaatctgtaatagtacctggagttttttcctgtgctttctataattcagctctttgagtctgctctgaacccttggtggtagctcactgctcatgaacagatcccctcctggggggctccagtggcctcccacaatggtcccattcctgagctgtttatcctcactctggagggctccctctgatcatccaggctcacggctctggatgaggcacaggtgggaagggctgtgggtgatgcagggagggctttcagtcaccatcccctcctggaagtgtatcccaagccatttccaggtgtacagctctcaggggagacaagaatgcattgttctacctggcacgatggggtgtgggccacgtggggtatgggccacagaagcacattcccaaacctccactttggagagccacgtacagcgaagcaggagaaggcggcagaggcggggatggggagaccgtctgtgagtgtggttcctgcccggctttccccttcccgccaggtctcccaggaggccaggtggcggctgcagccggtggcagacactcccttcctggggtgctggctgcagccggctgccatgggactccaaccagggctctcctggggttctgttgactcaacacatcatctgacgccaccccggcaggccctctgggtgtcaggtgccagtgagacgggttggggaggctgggacggtgtccagactgccgcctctgccccagagctcgtttccatggtgccgttcccagctccaggagctctcctcattcacatcatgaagggagaggcagggatcgtgagctctagtggttgtctgcctccagtgattaattggtacgattctccacggaggaggaagagaagaggaaggaaagctgcagatgaaagggaaataagcgtctcgtggtggaaacaaaagtattggttgcatcctttcaaagacgatctggaatctcaaacctagggtttacctctgcccctcgatggcaacaacaattctgggagttcagggccatgataaaaaatgacagcatcacacctgaattgctgctagtgtttttaatagacaggtaaccactcatcccgagggaggtgggaaaggagccctcttgctagggagcttggaattcctaatgctgcctgtgtctgatggacagtacctacccctggtagagctcgcttcgcggggagggagaactcagccctctgtttgcatgatctgaggctctggaaagccccctgcccccttccagatacctcatctacttgacaaacttccaagatgccctgcctcccctttctacacattgctcttccccgaaaggttcctgctctgttattcttggtcaatctgcagaaggcaggccggatactccacaaaggacccaagagaggagcagccgttaggaaggtgcaaggctgggagggaaggacaggaccagggttcccggattcaattgtaccacatcatacatgttgcctccatgcaattttctctttagtgccaggtttctagaatcagtgcatgaaaaatgatatctgaatacggtgcttaggggagccgggttttttccacttctgattcactccacagcttcagcatctattgtcagctaagctcatcttctgtgaagccctcactggtttctagagtgaatcattcctccttttcatgcacttagcacattccaatgttatcaaatgatagagtgctgggttgtttcctgatgcacctcgggtcttccactaagcgtgaatggcagtgagtctcgcttatcgctatcccatggggcctggtgcactgtcccagctcaagaaagatttgtggagcttgctttgtacatagtgctcaacaagtagacaaatctaactttaaatcttaagctctttaaaatacgccgttaagaaaatgaaacaagaaacatgacagagagaaaacacagctatccctctgtgtctgcagggaattgattccagaacccctctcaggcaccaaagtctaggatgtgcaagtccccgatataaaatggtgtaatacgtgcatatgacctatacacaccctcctgtatactttaaattatctctggatcacttataatacctaatataatggaaatgctatgcaagtaattattatgctgtgttggtttttcatctgtatttttattgttgtattattatttttattattttttcccctgaatatttttgatctgaattggttgaagctgaggaggtgaaacctgcagatatggagggctgaccgtattgcaaaacacatatatgataaaggacttgtagcagagtatataaagaactctcaaaactcagtaacaacaacaacaaaaaaaactcagtaaaaaaaaaaaaaaagtggacagaagatttaaacacatacttcagcaaagaagatatacagatgacaaataatgatatgatattcaccatcattaatctttagggctatatacattaaaactacaatgaaacatcactacacctactagaccagctaacgtctacaaaaacctgacaatactaagtgctgacaatgatttggaacaacaggaactctcatttgtcactggtggaaatacaaactagtatagccattttggaaaatagtttgacagtttcttctgtagttaaacatacatttaccatacaacctagcgatgccactcttagaagatatgaaaccttgttcacacaaaatcctgaatgcaatgttttcagtggctctattcatagttgccccaaactggagacaattcaaacatccttcaactggtgaattaataaactggtacagcactttgggaggttgaagcaggaggatcatttgaagccaggagttcaagaccagcctaggcaacatagtgggaccccatctctacaaaaaattaaaaaagttggctgggtgcagtggcacactcctgttgtcccggctgcttgggaggctgaggtgtgaggattacttaagtctgggagttcaaggctgcagtgagtcatgactgcgccacagcactacagcctgggcgacaaagtgagaccctgtctcaaaacaacaaaaaaacaaaaaaaaatgaaaaacaaaccaaaaaactggtgcatctatacaatagaacactactcagtaataaaaaggaaagaactcttaatatatgcaacacaatgaattaatctcaaatgcatttttctaagtgaaggaagccaggtccaaatatatacatactatatatttccatttatacaacattctggaaaaagcaaaattatagcggacagaaaaaaaagtcagtgtttgctgaggatgaggggagaaattgactataaaaagggatgcggaaatttctttgggtgttggaattgttctatgtcttgacggtggtgctgattacacaactgcagatgtttctcaaaactctcagaatagcacatttttttttaaaagggtgagttttactctacgtaacttatagctaaataatcctgacttttacaacagtgccctaacatgagttcgggggggttgtctctgcaatgggggaagcaggtgcttttcccctgggccttgaaggagggacaggcagggctcggatggagacgcctcagcatgatggtggaaaccttgcctccgccttggggcccaagacctgctcacataaaaatagcagctgaattccctctccctctggcccaaaggtcatctcctgaaggtgacagaatggagccactaccagggggcgggggagtgcgagggggaaggagcgaggtctcagaggctcaggcaacctgggccctgtcacccagacaactccctcccctcctggagacagctgtgctcacacagcctgtaccctgccttcccctgctgttgggagaaggggagggggcaggagagagctgaaaggttaggctgggagcagaaagggagatcccactccttcacccgccctcaccttccaccagactcagtcacccggcgctcctgaggacaggggtctttggtatatctctgcatatccctgaaaggtgtggacaggtcaatgagtcttctctacagcggctcttggcacaggtccgaacatgcagaaagcctgatgatgtcctgctgcccagggcaggcctgagacccgcagcacaggaggcccaaggcggccataaggagacccaaggccctccgaggggcgcacgaggggttccagggaaaagtgagaaggtgaggccctcaccaggtggctactcatcccagagaggagtttgcaggcctgaatatgccccacccgtccctcctccaggcccatcacctccccgggccatcagcagccacgctaggcccacgagagggttctatgcaatggctgcaccttgagagcttgctttatttttagctttaaaagttgtgttttaaagacatctatatactgagtataaaaatatttacaaatatccaagaaatatgttagtaaaactttctgaaggctgtggtctgaatgtgtgggtccctgccaagtccttatgttgaattctacccgcaaggtgatggtgttaggaggccgggccttgggaggtgaggagggtggtgccccatgcccttacaagagggaccgcagagagacccctcctccttccaccatgtgaggacgcagccaggaggagctgaagcaggtcctcagcagacacagaatctaccagcaccttggtcttggactctagcctccagaactgtgagaaagaaatttctgttctttttttgttttgagacggagtctcgcactgttgcctaggctggaatgcagtggtgtgatctcggctcactgcaacttgtgacccctgggttcaagcaattcttctgcctcagcctcctgagcagctgggattacagttgctcaccaccacacccagctaatttttttctatttttagtagagacagggttttaccatgttggccaggctggtcttgaactcccgacctcgagtgatctgcccgcctcagcctcccaaagtattgggattacaggcgtgagccacagtgcccagccacaatttctgttctttataagccacccagtctatggtatgattacggcagcctaaacagacgaagacgctgagttagctaatttgttgatccaaacagtccactctttttaaacatttatttttgattttgttaaaatgcacacaacctaaaattgaccatcttcaagcgcacagttcagcagcattaaccacactgctgtgcagcccccaccaccaccatctccagaaccatttcatagtacaacactgaaactctgtcctcataaaaataactcatttctccccacctgcaacccctggcaaccatcttctacttcctgtatctgggaatctggccactctagggacctcatatgagtaaaatctggcagtgtctgtcccttcatgactgcgttctctcactcagcacaatgccctcaaggttcatccacaaggcagcacctgtcagaatctccttccttttgaaggctgaatactattccaccacatctacacacagcacggagggctttctctcacaattccctcccggctttgccatcgctttgctattgctctgtgtctcccaagagatcgctgcccctcctaggtctgcagcttccctttcctgtggtgacagcaactatggttgctgcctgcatggcctggtgtccccatgtgcccccaacaccgagggccagagcaaggagtaaggacatccgatgcaaacaccgcacccacacgtttcctggggatgccccagtccctccgggtcagaatctgtcagcctgtgcccatgcctgtcccttccttctgggccacggtcacaggacttgggtcagcaggcccgggcagggagggagcccgggacaacgccagacattcctgccttcctgcagccaagtttccgatgtgctgttggaggaatcctgccaagggtaatgtgacatttacatgatgcctggtggggctgcccagtgacataacaggggggttgggggtgtgtctctgggcacagagcctgcagcccggcagagtctgatgacactgtgttgtgtaaattgaagcgacagtcacctgtttctctaagtcatggctcaaacctgtttcctcttatgtgaccataaaatcacaccgcctgtcaccttgatctttgggactcttctgtcttccttctgaataaagctacttgataaacacccatccacttcctgcagggggagaaggccaaatgccctcaggtgcattcttttgagagagtccagagagcatgagcccagccagaagtaggcatttgtgatggcctttctgtgcacttgtgcacacaaactttctcgtgtgggtgccctaagtgccggcattgtgcaggaagctgtgttgggggctgggagcacagtggtagcagacaccatccctgccctctttcaactgattttgcaaggacttcaggaacacattctagcacaactaactagagctgctcacttatgagcagagcctcagttcagccatcagtgaaatggacaaatcaaataggaactcttgaatgggccacctcccctgggcagcagggtggcgttgcttccaaggtgtgcttaaagccggctctcttctttgtggtctgagcagaagctgtaaggctaggccctggccttgttcttagctgtccctggcctacagacctttgaactaatcactcttggtggtctgaattctctgtagacaggtggaaaccgtaggcactgtgtcctccagacctcagcacagcaagaacagtctggtgttcatccgggcagaggaagcagaccccaccctgtgtttacacgacaccagctcttcaggggtccgagggggcgggcctgatgccggcataaggtttgatgttgccagctagaatcgccaacacatccccggaagcccagtggcttagcctcctatcagtgcctcctctgcagcccctgccagggctgccaggagctcagccggcctttgttctatttcaccccaaccaaatacctcctcctcctcccttctccttattcgttaaaattcagcgcatgatactggcaagcttcagccgcagctcacagcactttcagaggaaaacgtggcgcgcccggggccttctcacagccatcgtgcagccgcctgggcagctcccagctccaatggcaactggtagcatcaggagagtatggggttccccagtggggctccggggcagcgcaacgccacaggaccttgtggtggatgtggcaaagcatctgctctggtggcctggggcaggtgaggaagtgagcgcttctcaggagcagagccaggtcgtctctgcaggcccaggcctgccggcgcctcagccctgacgccatcatctctcctttgactgagaacaaggacctctttccttgcctaaatagcctacggctaagaggaaatcacccccagttacgagaggtttcaggaagccccccgcaaccttccacccaccatcatcaaactttcaaaagcagagagtctgggatttgaagcccctgtctgaaaagtaggtttcagatccatcggaaggcagggtcaggccaaacctctcctctcaagtcagataaaaacgatcacaccagggaggagaggcctgaaaaggggcagctgaagggaaaaagagctggagagtggggagcagcccggagtgtctcctctggctgggaggggccctgtggagctggcagcagcagctcttgggagcagacagaaggccgctccttaggaccaggcgctgccacctgcaggctcaggccctgttcacctgccgcagattccccgagagccaggcagaaaaagtggaccctgcccccagagcgcaggcccagggagaggcaggcaggtggccagtctgagtcagcgggatggaggcgcctggcatggggaaggggtgtgtagcctgggaggggccttgggcgggagcatccccggggagagagctggagccagttcccttaggacacatgataactggcagaggaagagcagctgctggggaacggggggtggtgtgtagggagctgcacaccctggggtggtcaaggcagaatgggcaccagctgcagcccaccaggcctgctcttggggtcccaacaggcagggagaagtggtggacctgtgtccgagcatcagggggcgctgcaagtgggcatgctgggtgcccagcaggggtaccatcattccccaggggtgtagagagtgggccgagcccgggagccctctgaggaggctctgccaccacctgtgggacagcaggaggagcttgaactctgtggggacttggagcagaaaggacccgccgctggaagtgagggtcacaggaaaggggaagccccggagcccctggtccttggcttggagagctgggtacacaatgatgcccaaccctcataaggtccacacatgacagggtgcctccaatccactgtggacggtgacaggtcagcaagggtctgacataaccccttagctgtggggggcacagagaatgggcacggctgggatacagtggtgcgctgggtgcagggagggggtgtggacgcagggaggaggcaggtgccgggagcagacatcagagcccagaaaatgccacagaaatcgagcctctctccaccctgccttccaacctcatccacccagtggctcaaggctgccaggataaagaaggacgggtgtaacgggtcaaggcgaatccaagctttgaggtgtgcaggtacagaggactcttgtgtggtccccacagccatgggtgcacaggccagtgggtgcattcaggggacacggcagagggaggtgcatttttgtgctgttttcctctgtgccagccccctgggaagcaggcactgttgatgccctgtccctaggtctcacttctgagttcgcctgcagctgggaggcagttcctgtgggcactggggcttcccacccacctcaaccctgcctgagagtttcctctggtgcccaggagctccctcgggaggagcgccgccagcttggggaactaggggtttggtccccacagggccacctgggctaatgcccctgggggcacattcagccagcacttcaccaggtcccttgtgaggcctcagctgtccccactgtccctctgagcctcctcctggtttttcccttcactgtcccatcccccaccccctcgcctgtgcttcctgggatcatcgctggtatggtttaggtgttttgtcccctccgaatctcatgttgaaatgcgacccccgagttgaaggtgggcctggtgggagaagtctgggtcatgggggcgaatgtcgtggtgctgtcctcgtggtagtgaatgagttctcgctctatgagttcacacgaggcctggttgtttgaaggagacttgcacctcctccctgtctcttgccctctcaccatgtgacacctcagctccccctttgccttctgccatgactggaagcttcctgaggcctcgccaggagcagacaccagcaccatgcttctcctacagcctacagaattgtgaactgaaatcaacctcctttcttcataatttgcccaaactcagatatttatagtgacacaaatggactaacacaatctcccaaaccaactccctgacccttgtcaccagctctgcttttgagggaatccacattacaggcaggggaatgggtgcaatggataccagcgtcagccccttgcagacctatccagatgcaaggacttggctctttggaccactccaagccaccctgagatgccacgtggaaccctaggaaaacccacctctgcaagaaggtcctgaaatcaggtaacttctcgctacagtgtaaatgactgataggctcaaacgggccgtgggagggtttcaggacagggtacaggaaatgacctgcaagtctgcagagccagtctgcaaactctggggagcacccctcaatgcccttaggccacctttccttctctgacctctgtccccatccctgccccaagttgtgtctctttgacacctgggatgtaagctgtgaaagctaaactgcactgtagttggagactcttgagaaaccgaatgaacaatatttctgaagatctcccacgaaggttgcctccctccctgcggtcaggctgcctgcaggcctagtcccagcagatctccgggagatgctgactgctggccggatgcctgtgtggttacgatccggttacatctcagccccctgctgagaaagaggcgctaaggtggccctggagccgtgaattcactgggattgagatcatctcggcgactttatcatgaaggccagcacaggaggcccctccttcctgttggagatgtttagttttatgattaagaaatggcaaagggcctttcagactacttttgctttgaaataaatcagtgaatcaatgagatgagaagtattcactgggcaccggctgtacagggaagaactggaagtgggatatgcagtgcctgggcttggggtaacagaacccagcctacgggccagaaagaaatgcatgagccattaagacagtgcaggaagcatctgatggaggacacgtcaatcttttcatcaatcattgaaagcaggacgaggaggctgggacacagcaaggtgctcaggccctcagaggaggcagtggggaggttcttgatataggctggtctttaagaaggactgggactaagataaactggggtacatagcggaggaagaagggagtagaggggcagtgctctgctgccacaggcggccgcagatgggtgcccccacattgcagaaacagcctcaacaggagccttgtgtacctgccaacattttgctgcatacaagattaatgaaatagttccactgaaatctggtgatggagttctcggcaatgtggtttttgtcctgtcatctcataggaaacaggtctttgaataagtcattgcatcattgcaaaatgatgtttcctccccaacaagggaaatcgggggtgacgtttagcagctccttctgcagcagtgttttaagttgagtggctagaaaagaaagaggcgtattatacgccgggctgtgttctgggtgctggggacagtgaacacgacagagaagagcccagccctcgtggagctcaggtttgtagactctggctccttggagtatggtctgaggaccagcagcctgtttgttagacacgcagacctccaggcccccaccccagacctacggagcctgaatctgccctttgacaagactcttcagtgaccgacagacacgtcagggtgagatacgcggctgtaggccaggggttccgaattttggcaagaatcaggaccccctttttaacgcaggcttgtgaatctgtggatttctgagccccaccctcagagattcagatttgggaactgggatggaggtccagaaattggcttttctgatgaggttccaggtaatgccaggcctgccggtctggggctcacaccctgagagccacctgctgtaggagatcatctgagttctgggagaagactggggctatctccgccacgcgtcccaggccctggagaagctgacggtagcttccaggcttccccttatgtggccaggccatagttcccttaacctcccacacccatcccctccacacggggggagcctggccttgtgccgaaccccaaataatcctcagtgcttggcctgcccgtttagaggtcaaacatccatgcagaacccatccagcctgcccgggaaatccgagcagggatcacacaggatgtcccaggcatttccacacaggcgagaccacagagcattatgcagccttgatgtgccaactgagtcatgcaatgtgctgcacacacgagcacccagcagacgcctgtcctctcctcccctcagctgtcaggcacaagagtccacccccttccacctcccactcctcaggggctgccccccagggaagccccactggagcaggcacctgacccagacctgaggcctgcgtcactgggccgggggaggaggaggtctgaacagaaacactaaattagccaccttctccctccagtctctacctgtgctgtccaagaggcagccactggcctcacatagctatttctttataaaattcaagttcagctccttagttgctgttatgggttgaaatgtgtctccccaaaaagatacaatgaaaacctcaccctggtacctgtgcatgtgaccttagacatagggtcattgcagatataatcaagttgagatgaggtcatactagggtgggtcctcatccagtggccggtgtctttataaggaggaggaaacgtggacacagatacacagggagatggaagctgagattggagcggtgcatctttttaagccaaagaataaggattgccggccgggcgtggtggctcacacctgtaatcccagcactttgggaggccgagacgggcagatcgagaggtcaggagatggagaccatcctggctaacacggtgaaaccccatctctactaaaaatacaaaaaattagccggcctggtggtgggcacctgtagtccccagctactcgggaggctgaggcaggagaatggcgtgaacccgtgaagcgggggttgcagtgagccgagattgcgccactgcactccagcctgggcgacagagcgagactctgtctcaaaaaaaaaaaaaaaagaataaggattgccgagaactgccagaggccaggaggcaggtggggagcaggttctccttcagggcctgcagtagaaaccaaccttcccacaccttgacttcagccttctggccggcagaactgtgagagagtcagtttctgctgtttgaagccacccggtgtgtggtgctctgttgtgtatggtagccctgggtgctaatccagctgcactgtccgtatttccaatgctcaacagccagatgtggctggtggctaccaagatggacagcatggatacagaacacttccccctgtgcggggagttcgattggagggtggtgttctgcagaatgctttctaagaaagaagcaaaggttaaaagtttaattttcagaaaaagttgctggggtagcccagttgcatcttccacatcctttacatccctagtgccggtcccccaaaagagagaggaggcctcatcatcaaagggacatcagtaggcacacactgactctcttccctgacatgagaaagtccacctagacattcaggccggagctttcgtccatgctgacagcagacggatggggatgcaggtccacactgatcctgagagtcccacccacagagggagcccccacggcagtcttgccaggtccctgcccacccgcttgccttccttcccctatctcctctccccatctgccaggaagcccatcagggcactgccaggtccgctctgtacacagacaaatgcaactttgaagtttcacactcaccagttggcaatgcattccttaggatggaggcattcatagtcccaagaatcccaagttaaaatactctcaggagaaacaccaagtcctgttattggataataagactctagcatgaattaatgatcagagtgaaggcctggggggcacagcccctaggatagcaaagttttggttgaggggatgaggtgatggcaaggagggcgaggaccagagcccaaaggtctctcctgggaagggtccaagttcaggactgtaggtctggaatgccagaagctgggggtgatacctctcgccttccagttccgagaactggagcaagtagagtgaatgtcaaactgccaagggcacgattttgcctctaagcatccgtccatgtactactcacctctgctcatctctccagggacccagcctctatgctgggctccctaacctgcctgcccagggagaaaagggaacacctggcagaagacacctctgccagcccttcagcctctcacattgcctgctgctcaaatagctcatctttcttcaaggccatgatggcttctctgactcactcatcagcgcgcgcgaagcaaagaaggaaagaggaaaagcgcaccttctccgtcacagtgaatggcaccctgcaaaggactgcgggtgctctaagaaaggaaatctgttttcagagctcctgcagctgcttttcaatgtgtcttcagtttattttaccaatgagcaaataaactggtgtttcccctgcagtgtcttctgcccagatagcagcgattctgctctccgctgtggccggagcactggatggctccgtcaagccctcagttgtcttactgatgagaacaactcaaggaacttctcccacatcatctggccacttgggctttaaaaaatgttttatggagcataatatagaaaagtgcacacattgagagtgtacagcttgacaaatttgcacaaagttcatgcatccatgtaaccagcacccagagaaggaaaggaatgttactacccacatggcagcccccttcaatctccctgccaggcaccacctgcctcctcagataatcatcatcattctttttctatttaaaaaaatttttttggctgggcgcggtggcttatgcctgtaatcccagcactttgggaggctgaggtgagtggatcacaaggtcaggagtttgagaccagcctaaccaacatggtgaaaccctgtctttactggaaaacacacacacacacacacacacacacacacacacacacacacacacacacacacacacacacacaaattagctaggcatggtggcaggtgcctgtaatcccagctactcaggcggctgaggcaggagaatcacttgaacctggggggcggaggttgcagtgagccgagattgcgccattgcactccagcctggatgacagaccgagactctgtctcaaaaaaaaaaatgtgggtacatagtaggtgtatatatttatggggtacctgagctgttttgaaagaggcatgcaatgtgaaataagctggtcacggggaatgggatatccatcctctcaagcatttatcctttgagttacaaacaatccaattacactttttaagttattttaaaatatacaattaagttattattcactacagtcaccctactgtgctatcaaatagtaggtcttattctttctaactaatcttcatgattctagcatcatatgttttgcctggctgtgtattttgtgacccagagctgcacattttgtattcttttgcttcaggcttctcttgctcagtgttggttgtgagatgcagccacactgctgcatgtggctatagactgtttctccacattgctgtaggaggttccattatgcaaatctaccatcatgtgtttaccatttcgactgctgatgggcatctgggcggcgtctactctggggctattataaatgatgctgtatgaacattctatacatatgttccccagaattgctgcttgcttttagttaatgtatttattcagcacagaagacattatagagagatgaggaaaggggaggggcccaagtctgagcatttgtggaacacctacaatgtgctgggcctgcgtatctactgcaatccacgcggcacctaccgggtggggatttacaactctctgcctcccggggcgccacggcttggagaaagagagtgagtattgccaagggaggcacagggagagcgaggctgctcagcggtgcggcaggttttgaacccaagtgtaaccactacaaagcctatgatttagtggacagaccacgtccccaaaatgttagcgcttaaaagtcctgcccctgctagcctcagcaacgggaataaaacagccatgaacgaaatgaggtttctttggtgtgtcagatactatcttctataggagacaccactgaaattaccagccaaatgctgaacacatttttgacgattagcaagttaatgagaatttttcaaccttctgataaaacgtaaatgcaattgagttatacttccagctgctctgaacagaggcctggtgtctgaaacgtacaggataaaatgttcaggttatcaagctgctctggaaacccctctggtctcagagttggctgagaatatcaggctcccttttcattcctactgataagcccacttcctctcgagcaacaccaaggaaacaagggattatggtgttttttctcttttctcaatcgggttgtaaaacacacacacagatgtacatggattggaaattaatccagccgggaaagttggctggcaagcactcggtcccaagcaggatcaccccggtatgccgaacacgcagccggcatctggctgcaagcatctgtctatcacacacagctgggcgaggggacagccgactgtctgtgacagacactccttagggagacagatagggggagggctacgtcttttcagagagaaagagacgtgagaggtaagcacagttttcccaaaggcccataaagaaagcaattctatttgtccaggatcagctcactaaggtcctcctagagcagggtgttcgattggagggtgctctgctcttcaaattaatttcagtctccctgcttaactctccaggctctggggtcccctcctagagcaagagtgttgactcctccttacactgccctctgcaggttggtggcacttccttgtagaaatctcataagtggcccttcttagccgatctcatctcacccgctgcgttttatttgacattcctacacatgttttatgatttcacatccccccgccccccatctgtgcacctgcaactcccaagttcactgttgttgagggtagaacttcaagccaggagcctgggtctcttgagtcttgctcatcagggttaagatgaaacgacaggtatgtgaaaccatgttgtaccctgcaaagcatgttgaaaatgcttcccggagtaaaaggttaggtaacacaacttcagtgtgactcagcacagcagatatgcagcacagagaagaccctgggacatgcccaaggccacacagctggctggtgtcagtcagagctccagccaagccttgaagtctggctctggagaccaagctcctgactgctgtctcctcctgcctctttgccctgtagcaccaaaggagaaattaatctttcctcctaggtggtaatgactagttgcaatcaaggctgcagagagacccactcatagcccaggactgggaggtcaggctcctgcctcgccctgcctttaacaagtcaaattctccaagacatccaactcatctcccagactgtgaaactagggtcccaaaagggtcaggactatctccccacctgggacagtgccttgctgtaaagattaagtcccaggaagacaccgagatctcccaccacgaggcttcttgcagaaagccagagtacgagcaaccagcaccctgacctgcctcctgctttgagcaggtgtgcactggaaatgcaaatgatggtttttatagaatttcaagctgaaatcttctgactttcttccaaggaatgtattcaaaggaaagatgcaaacccattttggctgtctcccagactaggcgttagctgtggcagtaacagcagcttcagcaaacgctcaacacagcctgagtctagaatacgttccggcaatggcttctgcttctccaacctgagccggaggccacggtggttccccatgcatctcagcccaattggagccacctggcctggccagggactagatggagtagggcactcaaatacaccctccagaggcgtctaccatgagggaagagggtgcctctggcccaacccaacgtcagcctcaaatgttcggacctgcctgcagtcatgcagaggaggccttccccctcggctgcgtcctgggtgccccagccttactgagctcagccctgtctcagtttcagaaggaaatgctcacaggggaccacaagtccccaggacatttaacacctggtcagaggacaagtccaagcacctggatagcaactggaccatgtcatgaaacccagtcctcctccctccgacgctgcccaaacttgagctgccgttgtccaggctagacggcatcctggcagcaggagaatgaacagcagtgtcccattcattcaacaggtgagcaggggacctcaataaggcaagtccctgataaggcagtccccagaatggagtgtggagcagggtagctgaggtgtggctgcaaattcctagcaggtccctcctactaaacggtggtcggagaagctgctatataatgaccgtttagtgacattcctagaaatgtttcttcccgcccttgagcctgcatttcagcttccagagctccccaaacctcgggagggtcacactgttggctctgggggagaggaatgggaatttgaaggccagaggctctctggctcgcacccatcacccgctctcctctctggtggggtgctcccgaaggtgactcagttctccaagccaaatgcagccatctgatgtcaccacctcatctccagaaggagtcctgagggagaactgggtcctcaccactgctgcagtggcaaacaaaggacacaaaaataattgagtggctggtcaagaaccaagttaaaccggccagccagggagctgggcctacgtcagtagggggctcagaatagccacagagcccgtgatgtgcccaactcaccccggggccaccggggccaaagaaagcccaggcatgagccagcaccggccccaaggcaggaaagcccaatagcgaacatggtggacatctacccagagaactctcggcccaacccagacggggcaggggaggacgcacagagaaaacatgctgactgtccacctgcaaaggcccccggacatgaccactgggtgtgaactggcccccgctgtccacaaggggggcgctgtccccgttgaaagctggggaaatggaagtaggaagagatgaaggggcttgcccagcaacatttggctgacctggacctgaacccagggttgtcaggctccaaacctccaattgcttcttaccctaaactctccatgcagccagctactgtgaggtattgtgaaaggaaagtcggatgaatcttattatttcttttttggcttactagactctgaaaggccgcattagtgaactcgggactctaataactcctggtgtcaggccttgccctcagaatgatcgtccagtggggcactgtgtggcccctcaaacccccatgccaacctggcacctgccagccatcgaagagaatagaagcaacaaaaaataaaaatagtaaatgtaccagtatcttctatgcagcgtaaagatggttttcactctacagccttctctgtttagcaaaggaatgcatttgtaacgaaggattttcagccaccgagccagccaggtaaagggaatttggagccagagggtcctcatggcatgcctgtagggtcctggcaagtgaggatacactgtccacgtggagggctttcctgtcgtaccccgtgttagccatgtaatgtgggcagtgaccagaggggatgacaaaggtaaaatgtccagcaattcacagggaacttgagcacagcaaagtcactgggtaagtgcagtggccggcagctgcctctctggagtgcccttggtgaggcagggccttttaagttccatgtgagccaacagcctggtgctgccacctgacactaaaccccagcacaggttcagctcggggcacccatggacagagctgaaaggaagccaccagggcacgccactgctctcgtcagagcccagcagaccagctacctagttctgtgagaataccagaagcagaggggccggaaaccatgacactgtgtgacactgtgtgatgggcgatggtgacactgtgacactgtcacagtgcatgacattgagtgacgtgtgtgacactgacacgtgatattgagtgatatgacattttatgatggtatgtgatattgtgacaatgaacaatgtgtgaactgtatgacattgagtgacactgtgacaccgatgtatgaactgaatgacattgtgtgacacagtgttgtgacactgacattgtgtgaaatcgatttgtgacaatgtgtgacattgtgtgacgatgagggatgtatggtactgtatgacattgacactgacaatgacgtgtgacattgagtgacgtgtgacaatgatatgcaatgtgtgacattgatgtatactatatgacagtgacattgagtgatgtgatattgagtgctgtttgtgactgtgtgaccctgcatgacacttggtgatgttgagtgatgacattgagtgatgtgacattctgtgacattatgtgtctgtgacatgagattgacactgagtgacctgtgtgacatggtgacattgagtgactttgatatttgtgacattctgtaacattgagtgtgacagtgacatgtgatactgaatgacgagtgacactgacacatgtgactgtcagtgacatgatatatgtgacactgaatgacacatgtgacattgtgtgacacacacataacactgacactgacaagtgacattgcgtgacactgagtgaagtgtgagacattgtgatattggatgtttcttacactgtgacacggagtgatgtgaagtgatatgtgtaacattgacagtgatgtgtgatgctgtgagtgatgtgtgacattgagtgacagtgacgagtgacgtgagactgacattgagtgatgtgacagtgacagtgacatgtgatattgtgacactgagtgacgtgtgacactgagtgcctgggggactcaatggccacttcgccttccagagggctttcaggaggaaaagcatttacagtagagccccacggagcactctcgagtctagaagggtggccggagcccagtgaatagaaactgcactggtgtcttcagctcagttccaagtcggagcagccacctcagcagaagggccggcctttgggagccgcctctcccctgagctgaggcttggatgcaccagcagagagatggcagaggcaggtggagactcaggaggcacctctcacttcaggattgaaaccagaactctaagtccgggactttctgccacccgtgccccgcccagcctgtctctatctcagtgcgtggcacccctgtcccccagctgccgaggcttcgctctcgccccccgccctgaggcagcacaccaagtggtcacccaccagtctccccaccacaaaagactcccctcccctttgctccgctgccacactgaggccacatgaaccttcgtgggaagagaagaccccgtcactcctctgctcgaagctctgcggtgaccccatcacacttagaggaagactcaaggggcagccccttcagggcccgtgcatgtgctgttctcccctccccgggagccctgccctctccctgctcttgcatctctcccagggcgcagccacccaaagtgaggcctccctaagcataccatctaagagggcaccgctcacacacccccatttgccacatgctcattcagcttcatttttctctcttcacttgtcactatccgcccagatacacacatggagatgtcatgacatctaacacactctgcttgcccctacaagcaaataggctccacgaagccagggactttgttctctgtacctctgtgtcagcagagtctagaatattgcttggcacagagcactcatagtggtaggcagagagtgtcagcagtgctgggtccagagtactaagagtgctaggcttacaaagtactaacagtgctaggcatatggtaccagcagtactagccctagagtattgcgagtgctaggaatacagtactaacatgctagggttagagtactaagagtgctaggcttagagtactgagagtgctagacttagagtactaacagtgctaggcctagagtatcaacagtactaggctgagagtgctgagtgctaggctgagagtactaaacagtgctaagctgagagtactgagggtgctaggcttagagaactgagggtgctaggcttagaggatcaacagtgctaggcttaaagtgctaagagtactaggctgagagtatgaagagtgctaggctgagagtactgagtgctaggctgagagtactgagtgctaggtttagagtactgagggtgctaggcttagagtactgaggatgctaggctgagagtactaatagtgctaggctagagtactgagggtgctaagcttagagtactaagagtactaggcttagagtactaagagtgctaagcttagagcactaacagtgctaggcttagtagtaacagtaataggcatcacagtaccagtgatgactaagcactttagtgtatgcacttcagaaaatagtcaaagagttaatattcaaataggttaatatatttcaacactttaaatctattgcttcctttaatctccatccaccaaggaggacagcaatattatccccattttatggatggtgaaactgaggcacaggaaagttaagcaacctgtagatatttatcaaatgtgttgaaggaacgaggaagagaacaggctctccatcacagaagtgtttaaactacttgttagggttactctcggatatgcaggttcctgagagccgctagcctgtctcaactcagatgcaagttctacaatttagaaatctttggaccccaggactcttcctagccacagcctggtgctaactctagacatggggacacaggtccagtgttggtggcctgccaccgactgggtttggcaccatcacccagaagccgccctcctctgggtttcccaggcgccccaggtggctgggctgtgtctcgggtgatggaggaggtgtacagatcccatgtcagggtgtgactgcccggaggcagtggcggcagaatgtcaggtgccaccagggactccaggccttcctccgcggcgcgtacgtgcatcacgtggtgtaacatgactgggcggctcagtgtggcccccaccctcacgtgccctcctggcacccagcctccgcccgaccctctgagagctctgaggagtgtgaacaatgggacgggctcaggctcactcacccgggaaggacgctctgctggctcagcaggaaggggcctggcacccaaagcctggacatcctgtgtggcctggagggagaatcagatggggtggccaccgcaggagactgggtccctctcctccactccctggcagtgactctacactcaggacccacgagactgctaatggtaaccacagggacagccctgcaggggccttgctctggcccactgtgaaagggaaagtccccttcctccactgatgtaacaaaacaaatctgctcttgttggccctgatgagctgacacccggccagagccaagcccagggatgggaggtgcccactggcctgacctcggacaccagctcctgggctgcaggtccaggaggcacccaggcacaatcaggctcctgttgccaaaaaagggagtgcatgcagagtaagcaaaatgagtgtgccccataaccacattcagtcacccggggccacgctgtgctgagggagggtgtggaacacaccacaatcctctccagcctccatctctgtctttcctgggagaggttctgaggcctcgtggagatttacacaaagcctgatgcttcagaggggaaaatgctctggccatgcaaattcattccgttttccatcactcattttgggtgcaggatattttcagcactttcccagcatgcaaagcaaagacaggattgtcatggagagccctgtgtgcttggaacgtgccaagagcagaggggcgtgagctggtttggggcattctctctgcttccctacaaatgcccagtggatggcccttcctcggagctgaagcagttcccatttctcctgtatggcactgtcaaatcgaggcagagggacgggaaatggtgaacagagaaggaagactcaagggcaaaactcccggaaggacagggggtcatggaagaaggaattctgagcctgacatcttagaaaatggatatgcagtttgcagatctacatccctcacactgtcttctgggaatggcgagaattgtggactttgtttccttttgctctgatatctttccccccacccaaagcagacccttttgtttaattctgatgctgtaggacgcaccccggcttgcaagccaggctgtgaatcagcggtttttgaaaaggatatggtaccacagctcacacatgtatgtaatgcagtattttctttttttacttttttagtatggaaaaatttaaacacatatgtaaaagtagacagaacagaataatgaactccattttttctagcatgccatttcaacaactattaactcatgaggatggtgtttttgcttttttaattttttttttttttttgagacaaagtctcgctctgttgcccaggccggagtgcagtggtgcgaacacagctcactacaacctcaggaggctcaagtgaccctcctgcctcagcttcctgagtagctgggattacaggtgcaggccaccacacccagttaatttttaaatgtttcatagagaaggggtctatgttgcccaggctggccttgaacttctggcctgaagtgatcttcctacctcggcctcccaaagtgccaggattacaggcatgagccactgcacctgacccccagtgtttaaatgtagctaccatgacgtatgcatcaaaatcacctacaagtcttatgaaaaatgcaaatttcctggatctcaccccagatcaaatatatcacaatttgggggttcaagtccaagaaccggcacatacccccaaaggattctcacagacagtcaagtgtggggggtcactggtagcggttagataactcgggctggggtcccagccctgccacttactagctaggtagctgaacaggtgatctccattggagtacgggctttacggggttgtcatggggaataaacaagatctcacaagaagagcacctagcacagagtcagcgctcattaaacatcctatgcagttactcaccggcctaacttacgtttgacttctaagccttgaggaaaatgtgtgccaaggtatgggggaggcggcagggcttccgagagagccgtcctcccatcccagccctgccatcctcccacacgcacgctgccgtcctcccatccgcgccccgccgtgcctaggtggagaggcggcagggcttcccggagagccgtcctcccatccgcgacccgccgtcctcccatccacatgccgccatcctcccatccacgcaccacgtcctcccatccacaccctgccacctctccctggtggccttgcccttcgtgtatctgttcagggccattggtgaacagagaaaaaaactactctagtaaaaagcaagtttcctttcattataaagaaaagtgaaataaattgttaaacatctacttctaaattaagaataagtgggccgggcgcagtagctcatgtctgtaatcccagcactttgggaggctcgggcaagtggatcacctgaggttgggaggttgagaccagcctggacaacatggcgaaacctcatctctactaaaaatacaaaaatcagccaggtgtgatggcacacacctgtaatcccagctactcgggaggctgaggcaggagaatcgcttgaacccaggaggtggaggttgcagtgagccaagatcgtgccactgcactccagcctgggcaacagagcgagactccatctcaaaaaaataataaataagaaaaaataaataagaatatgtgatgttaaattctacccaattaaaagcaatttttttttttttttgagatggagtttcgctcttgttgcccaggctggagtgcactggtgtgatcccgactcactgcaacctccgcctcctaggttcaagtgattctcctgcctcagcctccaaagtagctgggattacaggtgcgtgccaccatgcccaactaacttttgtatttttagtagagacggggtttcgccgtgttggccaggctggtctcgaactcctaacctcaggtgagccacccacttcagcctcccaaagtgctgggattaccggcatgagccactgcacctggcctaaaagcaaaaaaaaaaaaaaaaaaaaaaaaaattattattattttttttgagacagagttcctgtctgttgcccaggctggagtgcagtggcacaatctcagctcactgcaacctccacttccaattctcctgtctcagcaattctcctgtctcagcctcccaagttgctgggactacaggcacacactaccatgcccagctaatttttttgtatttttagtagagacggggtttcaccatattggtcaggctggtctcgaactcctgaccttgggtaatccacctgcctcggcctcccaaagtgctgcgattacaagcgtgagccaccgtgcctggccaaaagcaaattttttaaaaattccaatttgagttgtgatctagaaagggaggatggagtggaagaagagaaagatagggggaaggctgaagaattaaagatcatgccagggaggcagcgaacaggaaagccaagaccacagaaaacaggtgctcaaggcgaaaggcaaaggcaggagagagggcggggcggggcaaggagccttggtgcgggactccactctcctcgctcacagggcggcggtcccatctcacggcatcttaggcttccaggaaggattttcgagaggcacttttatatatttatagatgaaatgatatgtcttggatttgcttcaaaataatccaaggggcaggggaggtgggtgtgtgcagggatggagctcgattgcccttgagtttgtagtctggggttgagcagaggacacacagggcttcagtacgctcttttctctttgataagtgctggagatttgcctaatacaagtttaagaagtttaaacatttacaactatacacaaatcaggaagttcacaggctgatgtcagccccatgggtcagatgtggtgctgaacctgaggtgcccttggcctttaagaaaaccggagattagaggaggccgagtgtgaaagtgttgattatgacatgtcaggcaaatgtttgccaagtgaatggatagagacctccatcgggtgaaaatgctttgtgttcaagccccctttgtgaccctgggcacctgttagagaagcaggggctgggcaggggtccgtatgtggactcccaacagagcaagcccaccttgtccaggcagggcttggatccacaagtcctggcctcaccactccaggctcaaagggcagccagccagctacatacttgttcccatgcttgacacgcacagaaccccgcccagccttgcacttaacaggtgcataataatcccttaggaaggagggtatgggacactgttgccccattctgtagaggtggaaactgaggcttagacataatcaacctaagaatgggacttcatataaactcattctgcaaagaacggggaccagtgaaattagcagtcagtgttttgaattcctgaaaggaaacagcgtctgaaacacagagccctgcagaaagcacgtaggcctgagccacgcagctgctccagcccccaagcccgcgtggagcagagatgggtacacaccccgcaccttcagcttccagagcgttttagggaaatgagtgttggcaggaaggggagcagtggcgacttgccccacaaaaattcgaggcaacaaaagagggaaagaggtgggccgggtgtggtggctcacgcctgtaatcccagcactttgggaggccaaggtgggtggatcacttgaggtcaggagttcgagaccagcctggccaacatggcaaaaccctgtctctactaaaagtataaaaattagtcgagttgggtgacgcatgcctgtaatcccagctactcggaaggttgaggcaggagaattgcttaagcccgggaggtggaggttgcagtgagctgagatcgtgacattgcattccagcctgggcaacagaccgagaccccatgtcaaaaagaaaaaaaaaaaaaaagaaggaaagaggttgccttcataaagctgtaaaatcgcataaaaagagggtgcaatcagtcattgacgagagttacccaagagactgtaattacatggttaaagaatttggaaacacctagaactccactcaaggtgactggggtcatttgcagggaggcaagaataatatttgacttgaatttcatatgcaggaactttctggagaaacgccaggtgaagagaatggcagaagggtggtgtcccaaggaaagggcagaaaacaggtggctccagatgccttttaagagaagggctgccccggccccagactcaccggctggtacagtgaccactcagcagctctggactggctcccgtgtggccctgccaacaggatggggagggcctggcatgtgtgagtagccatgcccacccacgtatttgcctactatgcctgccaactgggatgaaaaagctttggatctggctaagtttctgtgaaccaggtaataaatctgttcttggtgtgctgaaaatagtggggtttttcagcctataaagttgatgagccaccctgagccttggggacccaccaggaaagcatctcctcatgagaaaggagctggccttgaccttgctggggacctgcctcaaattcactatccctgcatgggtaggtgcttgtcattctttctgcccacgcagcatctttttacacctcctctatgcctgaccttgggagtggggggaaggggctctgatgtgagggtcgtcctgggccagactcagcttctgctacatggaagcagatgccaggcaggaggtcctgccttccagagcagacactatcttagtcatcttgggctggcagaacagagcacatagatggggtggcttacgtaacagaagttgattttcttacggttctgggggctggaaagcccaaggtcacggtgccagccctgttggtttctggtgaggaccctcttcctggcttgcagacagccgccttcccatggtggtgggtggaggggggggtagagctcttcctcttcttgtaaggccacagtcctatcagcttacagccccacccttatgactttatttacccttaattacctcctcaaagccctatctccaaataagccacatcgagggtcagggcttcaacgtatgaattcgggggacacgatctggtccacagcacggcacgagtcctccagctgcatgcaggtcatggtggctgtgcccagtgccacgtgggcctccgtgtccccgctctgtaagtcatggtgggctcctctcggaaacccaccaaagtccccagtaaaagtgctgagtagctcatgaagtccccaggatgcaaaaaaaaaaaaaaaaacccaaaaacaaaacaaacaaaaaaacccaggttttttttgcatcctggggactctgtgagctattcactgcttttaatacatttttgggatccactacaaccagccagaatgaatctctgggcccgtagctgactggagggaccccttccatggagtccaaagatgacggctcaatgggattctctcattcttgtccaccaaaccagaaggcaggtctgcccacctcccctggcccttctgttcaagaactggcttcatctctcttcagcatcggcctctgagacctaaagggctgcctgtttccctgtgttcctgagggtgccagcctgcatcttgccaagtagtttcttagactcagatgattcctgttctctctgtgctcagactttccaacccacccacaaacattcattaagcccctgataagtacaaggccccgaactcagggaaatggaggggactgaaggagacgtgtgccaccctgttccccgagcgttgctccgggagacgagatgtatcttgcaaccagctcagcggtggaagcagtggaagtgcagacagaaagccccatggcagaagggagagaggtcctgccccactcccggtctctgcaacatgcttcccggccccggcacgctcagccctggtccaacttatcatacaagttcttgggcaagtgggactttatgaaggaggtagtcacagagacccaccgctcaggcctcctgctgggggagctgggctataacttccgcttcccccttcacacagagaccatgctcccaacccaccccaaacccgccagcaccctcagcccctgccctgggctgctcccagccaatgcctaagcgccgggtgctgggtcaccctgagactctcgctgtccaatcttccctgccaccgtggccgcaggggtcagaaagaagatgccccctgtcttctgcctcctaccctcatccttcccgggcagttcccccagtgagtctggtgtgtgttgagtcctgtcctggcacctgcctctcaagggacctgcattcctgcctgggtcccgcccacagcaccactgtcttgcgatgggcactgtcactcccacctggcttcccagagcctatgtgggcctggcaccctgatctgttctcaacaagaaactggagcctgcccctcctccccctgagtttgccaggcagcctgtaagttggggctccaagtaacgccttccctggcccctgtgcctactgaggtagttctgttatttcactgaggccgccacattcaatctgcaccttcccatggaactctcccaattggctgtgcttgctctgcccaggtccagaccaggggcagctctggcccagtcctgggctcctccaggtctgtgagcacccccaggggatgtgcttaggtcagggtgaggcctggccactagcactggcccaggggcgagcccttccaagatggtccaatcagaatcagggaagggccctcattccacagtagggggaaatgccctttcttctttctctccctccagatcataaacctacaaactcctccagtggctgcagacagccgtttgtgaccacaaggaaaggtagtggaagcccagatggacacagagagaaagaacacagacttgctggtctgggacaagcattgttgttcaagccagttcgcgtttgagtttctgttacttccagccccaaaagcaccctagataggagagtctacctaatacagcaagaccatggccctttccagaaagggtggaggctgctagctcaggaggtcggtctataggcaattaaatctctgtgggtgtaacacagactgtgttcttactgctatttgtggaaaacaattttcttaaaatagatagaacagaccttgacaccctgaagtcaagcactgacagcctctgttttgaaaacaaagcaccgtcaagctctagaaaatgcatgcagggctccagagcccgtccagatgagcagaaatggcagagggggacagagggggatgaaggaggagagaatggaggggatggagggggatggaggggatggatggggacagagggggataaaggaggacagagagaatggaggggatggagggggatgaagggggcagagggatggaaagggatggagggggacaggggattgaggggagagagggcaatggagggtttggaggggatagaggggacagaagggcatggaggagaatggaacgggagggagagggtcagaggggatggttggggacagagggtagtggtggggggaatggagggggatggagagggatggagcggggtaataagggcagaaggaacagaaggagatggagcaggcagaggggatggagggaatggaggagaatgaagaacagaggggggtgaaaaaggacagaccagggtggaggggcatgaagggggcagaggggatggaggggacacagagggcagagggggacagaaggatagaggatgtcagagggctggatggggcagcctggccacctacccaggcatgggagccagaaccctgcagccgcccagcactcaggcttttctggggtcccatccctgcagccacccatcctgcatcctgaagcgggggtcctgtcccctctctgcatctcgaaaatgccccttcctgcttcctctgccatctcctcggtcactctggagctgccttctgcctacaactggagctctaatgccaacaggaaagggctgaagacagggccagggccagggccggggccagggccggggccgaggccagcacagcgctatggggcccagctggggtgcctgagggcctggctccccagagcacgtcctccctccaaggcctctcatgcagaaccgagggtgaccagccacctcccacaggaggcgtgccacccctctgccccatggtcacctaatgtccccctccaggcctgcccgtgacagtgggggacatatgctaggaccccctggggcagtcaaggacattctaccctgttggccagggagcagcagggtaggcccctctaaaatctgagtagagatttagtttgtctggagaagacagatgttttggcctcggatattcacagtgtcaggccaacgtcccatcaagcatgtaccagccaattatgtttgctttcatagacgttatctggccttaccattcctctctgacccaggtcccttagttcccatggtgactctgtacaaacactacacatactccttgtcctagattctttccccttatctgcctatcccaaccctgctactccctcgaggcccagttcaaggccacctcctccatgcagcccaccctgactactccttcccacacaatcaccttgcagaattcctcaagcgtggctgtggcattctgtcttgtgggtgagctggctattgtttcctgcatgtgaatatgatggatgttgtagaatcctcctggcatagctcctagtgcccacagcacagtgagcctgtaacccgtatttctcattagttggctctctcatttacccccagagacattctttacaatgcaggtgtagactcagatgtgaccaagactttgctatcttataaaaggggttcagcccattgcagtctggttttcctagcacccttcctcctgacgagctatgttcaggggagcgttagttcgttacctgcttgacatggcactgcctgccaacctcaccttaggaaaagggtaaataagtttacaaacattaggatgggtgaaagcagccatctttcagccaaggatgtcttgccattggcatcctttcctctcctactcttggcatcaaaacttccagcgaaaggactaccatcacttaccccagctccctccccaggggtctcctcgtggagctcatctctcactgaggaaagaagggctcggctttgataaaggaatgctagactttagcaggtgagtggcgggggtaggatcctgtctattctccagaaatgccatgagactcccgtggggacacacggacatgcagccccatgctctgcgaggttcgtgtgcaagggaagccgagagtgtgcaccgccgcctccccaccatcagccaacagctcaacaccgattcccagtcccggctgtcacaggcacttcttattatggatgtgctactaacacacagcaaaactgattagataggcacaggcccggcaggtccccattaaaggacattcttccctgccccagaggccttttaatcctccagctgctccccatttctgagcaccccagccccacaaccacatccttggctcctcttttcttaggtctctgcctcccaaaaagtggaaaacggaaggctgcagacaggaaagacatcccctgcagcctgcccactcctcccctccaccgcaggagaactggagaaattctatgctagtcaccatctctttctgtgtccacagccccggctctgagaggtggaccacagtgacgttgtgcatctcctgggctgaatgtcagtttagaatcagtgttctgtcacctccaataccctttccctaatgcccagttgccctggtaaaagccataagtccctttggggaagaacgggagagaggttaatagtatacatttttggtagtgcagtggagtccttcttcaaggggacccagcctccccctccactcaaagagttctgggtctggaaactggctcaagcctaagaattgattgaaggaccatgacgcattcgagctagacttttgttcacttggcctacacttctacttatacagatcgagttagaatgtagtaggcttcccatccatttcacttctaagaacatggtggcgaactggcccacgccctaggtcacgcggcccaccccaaggagttgagtctgacggtcctgatggctgcttggcctctgctttcgccgatgggccgcacctgccttgcctttggtgattgtttccacttggcccctgccatgctgggacccagatactcccacttcatttaggatccctggtcagtggcagtaggtccccctgtgatttccaacctacagggagctcttcaagggcgctgggctccctcaccacagtcttggtgaaaggtgtgtgagtggcaggtgagttggtctcaactggcaaatcctctccagtctccctgagccatgatgcctccctctgcagcagacgcaggcgtttctggtgtttcaactccgttcagcatgggccacctttgggtccatgtttcagccaacccgcccgtgaagcctgaagcagctccatcttgggagcaaatcctccacctcggcttctgatcaaccccggttccagctgatctactgttctgtgtaagagcaagtacttgtcataaatcctgcccttacggcaaatcaaccttgataaactccacggtaaatcctgcccttaggcatattcctacaccttccctctggagcaccatacctttgccctatgtatagaagccctgggtccggggggtgctggtggggacctacctgtcttgtggttgcccaagactacacttctgcccgtaagttcccccaataaaatcaccctataacaacacactggatttgtctgtcttgttctttggtttctgggctctttctgcatttgggggtcgctttgcatacagggccctttcacagacacagccagacagactgcagggctcttccagctcccagcccctttgtcatcctctcagcaagcccagggatgggcatctccacagagtctgtcggccctgctgtccctcagaggttgcacctgctcccgtcctcccctcctgaggaagggggtgactggtgacttcccaaggcagggaggttcccacaggccatgctgctcagagcccgaggatgggaacttctgcgcgggcccttggagggtagagctggtgctggctcacttgtctccaggtcccgtcgtcgccctcccaggcgctccctcccggcacttcccgggctttgggcacccttgcttccctcttttcaaaggaccctgtgctctcggaccctgcgcaggattccagagcttgcacactccctagccggagcagccgcttgcccgccccacaagtgcggctctccgcgccacgctccctcctgctagggctccaagtgccgacttgcagaggcctcgggagtgacagtggaacagagggtggcaccggcaccagaaagcaccccccgagcctagatttctaccttcagaaactccgacagtggggacccggggcgtggcggggctgctcagtgcgtcccagctcctcctcggtgcccaaggaggctgccactgtggccgtgagtccaggagaggcctcccaaccctggcctgtggatgcatcgacccctttcaccgcgcctgacgtgagtactcctgccccttcacgggccaacaggagcgaggtcggccctgcctcaaagggcctgtgatccccctaccgtgtgatgatacaaagagcaggcgagaagcaacccacgtgtccatcgacgcatgaacaaaatggggtccacatgcacagcagaatattactcagccttaaaaaagagggggatcctgccacccgccacccacacacacgaaggacatctgtgtggacatgatgcttgagggaaacaggccagtcacaaacaaatactgtctgattccgctgacgagaggtccctggagtcatcaatgcatagagacaggaagtagaagggtggcctccaggggctggggaggagcatggggagtcagggttgatgggccagagtttaagtgcttcaggatgaaaagggttccggagatggatggctggctgcacagccacgtgcgtgtacttaatgctactgagctgtacacctaaagatgggtacattggtaaattttatgttatgcatatttaccgcagtgaagaaaaaaaaaaaaagagccaggctgggtgtggtggcactttaccattccacagaagagctaatatcaagaaaccaaataaaacctaggcaaaaatacaattatttataatttgtattcaattatatacagacagttcataccagacaggagaagacagataagacttgaagtgtggggaagacctcagcacccggggcccccagggctgcacaggggctggtctgcaccctgcctgtgccctttctgccactggtgggagaagaaagaggccgagaggagctatgtcactgcacctcgaaatcccggtggctgagcaggttgggccctcccccactttgattttctttgatttttctatcctagggatgaaggtgatctatttttagtgtagaggctggtataaggagttgctatagcgacagctggtggttacaaaccaggtcctgctacagttcccagtcatgaataaatcccaaggctgagcccgaggaagcaggcagcctcagagatggtgctccctctccacaggggtcccacctgctatcttcatggtgtgtccttcacaggcagcatctaagtcctgctagtggggaagcagctcaggacatggggcgctggggactgcccatcagaggaaccgagggcttcagcagaaatgcatgctgagcctcaactaccaggtgaggcaaagcacctgcgtgtgcgcagagccggatggtggcagaagagagctggcatgcagggcgccaggttaggaagcctggggaagtgaagacacagcacctgcttacagaatcaccagggaggcaggacacacacacacacacacacacacacacacgcacacacacacagagctgatgccacattatttactatggctgcgtgcgtaccctactaccagtaatcttagtacgagtccaacagaaaggcacaccaacgcacaagagtgcccatgagagcactctgtcacagccccgactggaaaccacggtgtccattaacaactggacggacgcaggagtcgttgtctgggcagacagcggagggttctgcagcaatgaaatggagttgatgaacttcaacgccgcacgcaggcacggctgcatctcacaaagtgcaagtgaaagaagccagaccaaaaaaaaatcgtgtaaattcaaaaccagacgatgccaatcttgaggggaagtagctgggagagagtatggggagcttctggggtgctggctacacaagggtgttcagtttgtgcaaattcgtcatctatgatctgtgctcttctccatatgcttacactttagcaaactttgccttaaacatttttagaagttagcacagcattgttagtcaagtatcaaaaaggtgatactggctgggcgcggtggctcacacctgtaatcccagcgctttgggaggccaaggcgggcggatcacctgaggtcaggaattcaagaccagtctgaccaacatagtgaaaccccgcctctactaaaaatacaaaattagctgggcatggtggtatgcgcctgtaatcccacctactcaggaagctgaggtaggagaatctcttgaacccagcaggcggaggttacagtgagccaagattgcgtcattgcactccagcctgggcaacgagagcaaaactcagtctcaaaaaaaaaaacaaaaaacaaaacaaaaccgatactcaatggtatttggtgttggtgggctttgaggcagacctgcctgtgggggactgggacctccaggaggaggcagggccctacgcccctccaggctgtaatgagtgcaggggcagaggcatccagccatcgaggtggggaggaccccaggtgagccaccagcagccacgggagccccgtggggaggaaggcaggctggggcagcaggagaccagagctggggtgcccctgggcagggactctggaagggctaggaaactgaggctgatcaccctgcaggctggcgcacgggtgcctgcctggagacgcaggggtttgctccttttttctgtgctgccaactggacatccctcctcagggtcactggccacagctgctcagaggtcactccagactgcagccactccctttccatcagccttagctgttctgtgatcaaaacagggctggccaggcccaggagcgagaaggagggagggagggagggaggaggggccttcaggccctgtatcccctgggaggcgcagggcagccgggtcagcgttcaggtgctgttcattgatgaactcactagcattagctgatgtgtcatctcttccagccaaaagtggggcccagccaagcatcttagtgatgtgagtcatcaaaacttcctcctgggtctgctttgagccccaccttcctcctcctgcagtcatgctcttagcctcagggccctggggcggacgcccggacactcccccagcagcctgctttccagaggccactgcgctgctcagctccgggggcccgtcctccgtggatccctccaggcccagcagagtgtttgaccacgggcctgaccgggaggggagacgccacctcctggggacttgcaccccaaccagcaccactgtcatgagacacccggaggccagcagtccccagggccccaagaacacacagcagcaccagagactgccttggccctcagggaacgttcatgttgatttacgctgagagcacctggactttgcctatttttttcttctcaatcgctaaaagacaaattattaccgcagggcagaattcatcttgctctctgaatgtaccaagtgctcactctcatctggaaattggaaccccgggtgaccatccttgggtgccaaggctccctggacccacgcacaagccctgagtgaggtcctgtctcacaggatgggggtgacagagcagcaggggctggccagcacccagccaggctgcggccccaaccccaggtcaccaagctgtggtggcttctctgtcaccgtccagagtcactattttaaaaatacacccccttttgaatctcctttctccctgcttcattatttaccccttcaggctctgaaatctttccctttcgtcttcggacactttcagacgctgcagtcctggaattgtttgtccagtgttcagcttctctgctgggaacccgggctctccagagggcggctgctcccagagccacgccactgtcacgacagctcacctctcacagccctgatgagcgcccctgggagagcacgcacctcgctgacaccccaccagcgcccagccccgtccacaggcgatgctcacctgttcctggggatttagtcttcctgacttagagcagcagctctgggtgactgggatggggtcagaaaagggaaaggggcacttgaccgtgacatccaaggacacgcaccagagctgctttgctaccctgccaccctgtgaggtgacagccgcctggcctgctgagtgactccgggagtcctcggggagcagcacctctgggagagctgggccacttgtccagggttccaccaggcagcgcttggtgacagtgacgtagggagaacaggcagatgggttatgagcttttccaggcatggatgagagtggggcggacagggggtggcgggcgggcctcaccaaatccacggctgggagtggagagttctcaaattgtgtgaacactgtcccatcatcccaaatgcttctactcactggctacagtgtccgaaaccccccaaagacccatcctcacaaacaaggatgccgcacccctaggagtcttctgtttggacacatccagcagaacaatgggcaccagggctggacggttttgggtgggaactggcaaaaggagaggtgggtgggggccggggagggccttggagccagaggggttgggggagggacagcctcagccccagctgtctggcacataataggctcttaatagtgggctcagccccagctctgtccgcactccacttgggcaggccagtccttagcccatcggtgctcaagacccccgagggccttcatctcaagcaggtgtgatccagagccctcccacggtccacaagaggggcatacactggctgctgtgcccagcctcagcctcatctcctacctgccagagaccggctcctgtggctctgcctgctgccgtccagccccgcaggcctctcggagtccctagaacacaccgcaggctcccttctggggcctggcctctccagctctcggaagggtctgagcacaggcatccacacagccctctccccatcacccactgaaccgacccctcgccctgcctccacggcatcaccaccacctgacctggtgatgaaaatacgtttgccatcgaaacaaggcagacgcaaaaggacaaacactacgtgattctatttctaggaggtccctggagttatcacattcgtagaaagtagaatggtgtttgccaggggctggggtcaggggagtggggagttagggcttagaagagacagtttcagctgtgagtgatggaggacatggcaggtggtaatgcctacacaataatgggaatgcatacgtgaaatggtgaagatggtaaatttgtattatgtacatctgaccacaattaaaatcccctcattcatctacccactctcaccaggccgtgtggccccgagggtgcatgcatctctcactcactgctgtccctagtgtgggaacagaggccagcacaaagaccctgaggatgcaggtgagaatgacagaacctgtcattgttaaccctggaagacagatgctgttatactgttctccctacttctgtattctttcgaaaatttctggccaggtgtggtggctcacatctgtcatcctagcactttgggaagccaacgtggaggatcgcttgagcccaggagttcgagaccaccctgggcaacatagggaaaccccgtctctttttaaaaacaaatttaaaaagtaaaataaaaagaaaatttctattggaaaaaggcaaacatatatattgggaaatttcagggcaaaaccaatagtgataccagcagccaggccagcagatgggcgccagaggcagtgtgaggactatgaggggtgaggaggagcaggggggctggatgggggcgggagagaccacaggcttgacttctcagccctatccctctgctgaagtgaagagcacaagatggtccccacagggccatactcagccaagggcaggagagccatggcacgcagtattggggtgacctgaatgttcatgggccaggaaggatgctggcgttctgggcaagaagccgttgcgtagtcatgcggtgtgggctcatggaaggggaggtgggtataagggccaagcgtcctcagaggatgtggtctccggtcttactgggaccctgggcacacaaggatgaaacaccagcttcctgacacaccgcttggactcctggctccagtgctggcctcagaaatgagcccttaagacgctaaatggtttttatttaattactgccctgtaattgcagagggtgaaagcgctactacagtcattgctctttgatctgattagcataatcctttcctaatcttccctctacatttttattattgttgccacataccctttgtcgacataatctggatttctctttgccaaagaggccgaaagaaaggcttagccaagctcgtcacttgtctagcgcctggagcctgaaagctggagaggtggggagcttcccttctgtgccagacatggcctccctgcctggctctgcagccagagaggggtaagggctgagcactcctgagtcagagcttccagggggctctgtcacaaggccagcgggtgaacatttccagcgacagccacaggctttccagtggaaatgccatccaccgcaattacgaatggacctggtgattccgggggctgcagggccttgatttgatggctgtggggagagctctgtgtgtgtgtgtgcgcacaggtacatgacatgtgtgtgcgagtgtgtatctcttgacccggggaactgcagggaagcccccagataaacagtgtgcaccttgtccctggggaagcagctccatgctgagttaaggcagaggagcccgtggttcctggaaaagactgacacagccacagaggaaacccagtggatgggagggacctgtgccaacagcctaggtgggcttcctgtggagaggagggaggagaagtcaatgacagggatttcatgaccctcacagaagctttctcagggagaagaggcctcatctaagatttttgtttgtcttttgagacagtgtctcactctgtctcccaggctggagtgcagtggtataatcttggctcacttcaacctctgccttgtgggctcaagtgatcctcccaccttagcctccccagtagctgggactacaggtgcacacaaccacacccaactaactattttttgtagagaaggagttttgccatgttgcccaagttggtctcaaactcctgggctcaagcactcctctacctgcctcaacctaccaaagtgttggatcacaggcatgagccacagcacctggcttttttttttttttttttttttgagacagggtctagttctgtcacccaggcgggagtgcagtggcatgatcacggctcattgcagccttgacctccccaggcttaagcaatcctcccaactcagccttccaattagctgggactaccgacatgcaccaccacgcctggctaattgttgtatttttcatagagatggggttttaccacattgtccaggctggtcccaaactcctggactcaaacgagccacgtacctccgcctcccaaagtgctgggatgacaggcatgagccaccgaacccagccctgagattctatctccgggaataactgtatgaaggagagggcgttgctgagagggaatttaaaacacaaaaccctgaagcaatccttcttggagaacagggagcaaccctgggctggaacgttttccagctatcgcagagccagcggtttttatggagaacctgcgatgctgcaagacctagggttagagctacagaccgtgctcctgagatatcgcccctgttcacaagcagccagatcacagaaaaggcacccagagtggtttttctttgagacggagtctcactgttgtcacccaggctagagtgcaatggcataatcttggctcactgcaacctcctcctcccgggtttcagcaattctcctgtctcagcctcccgagcagctgggattacaggcacctgctaacacccccggccaatttttgcatttttagtagagacaaggtttcatcatgttgaccaggctggtctcaaactcctgacctcaggtgatccacctgcctcagcctcctgaagtgctgggattacaggtgtgagccaccgtgccaggccctcagggtggttttctagacagtgatcgttcagctgggtcttgagaaatgggtaaggtttagacaggcacaggcttgggagggagggcttggtcaacactcttggactgtttttcctcactcagtgtatccacgcccaacactgtctgtggggcacagggctcccgcctcccacccagcctagctcttggctcttctcactgacacactaaccaaagtcagacatactatcaacccaggtccctgggctccagcccactaagaggagccttagcctgagcaggggctatggcctcttgctgtttcccaaattccagaggaaggctctggagggacctccgattttcttgaccctgtggtcagagcttgcatctgcatccaggctcttacaaaacttggttgagatgtaaacattgtttttgatgtcagaagcgtaggagacaggatgacagccaaccgttaaacacaaggcgggaagccactgtctggcacataataggctcttaataatgggcctgtccatccccattagcaaaaccagatttttagttaataataggttctggtttaattctacagtagataagtgtttattactttattacttaaataaaagtcatctttttagaccgtgttagtgagtctcccgtctaggattccatccctcctctccctgctcagggctgggtgtcctattcccgtgcacagtcaccatttttttttttttgagggtcttgcgctgactcccagcctggagtacagtgatgtgatcagagatcactgcagcctcccctcccaggctcaagcgatcttcccacttcagctttctgagtagctgggaccatgggtgtgcaccaccatgcctggctaattttttatttttttgtagagaggggtctcatgatgttgcccaggctggtctcgaactcctaggctcaagcagtcctcccacctcaacctcccaaagtgctgggaatgcaggcttgagccaccgcacctggcctacattcacctacaagtgatcccccaaccttagcctcctgagtagctggaactctactcgattagacgccgctctctagttctctttatggggctttcttcttcacaagattgaacactctctgggttcaaggactgctgtctccttcacctgctctcccccgaggactcagcacaatctgagcctgcagacgcttccaggagagctgcccaaagcggatatagcaagaaatacaggcagattttagatttacctttttctttttctgctcttccagttttcatttacagttcagacattttgccaaagtcacctccctgttacacataatgacaatatttttccacttaacacatcacattccggtcaggggacatggcttcatacaccccccaggctcctcattttactcatcccctaggctgtgtctccccagccctggtgaaactcagctgataaataacagcactggggtaggggtcctgctgttccatcttgcagtgggctcttcaggaataacctatgccatgcaagcagtaacgctggcaatgcgctgactctgatttgtttttttagatagggtctagctttgtcacccaggctggagtgtagtggcccaatcacaactaactgtagcctcgacctcctgggctcaagggagcctcccatctcagcctcctgagtagctgggactacaggcatgtgccaccatgctcggctaacttttaaatttttttgtagagagaaggtctcattatgttgcccaggcttgtctcaaactcctgggttcaagtgatccttcctccttggcctcccaaagtcctgggattataggcccagcctaaatctgattcttttttttttttttttttttttttgaggcagagtcttgctctgtcgcccaggctgaagtgcagtggtgtgacctgggctcactgcaacctctgcctcctgggttcaagcgattctcctgtcttagcctcccgagtagctgggactatatgcgcacgccaccacgcccagctaattttttgtatttttagtagagacagggtttcaccatgttggccaggctggtctcgaactcctgacctcaggtgatccgcctgttttggtctcccaaagtgctgggattacaggcatgagccaccgcgcccggcctctgattcttaataaatgaaatctgacatctaattttgagtgggcaggtcttaaccaggtgtggagctaagaaagctttggaatcgacctgtgtggctgcagacagacaagggcaaaacccactccaagtctgcaggtccttgaaaatactgaaccacagatgcttcaccacctgttccacttgccctgaccccatcctcctgtacatggaggagctgcagaagttgccagagaccagggagaccacaatgcaagcttctcctcatggggcacaaattaggcaggtgtttcccctcccacattagcccacgatctgtcagattactccgctacggaacctgggaagaagacctctctcttcctgacctccaatagtttcctctaaactgcatgtttcatttttaacagctgaaaacaacagtgcccatccactcttacttttcccctgagccacagtttttgcataaatgaatgacaatccaatccatcactagcctccctgggccaggtggggcaagaaaggaaacagcttcagaaagagtattgtcaggcggctccccacagcagcactgccatcagcaaggaaacacttcccacgtattcctctaaccaccgcctgatgttatatcccagttggaagagagtggctggaaacagctactgcttaggagggtgtgcacacacgccgtggggttccctcccaaggacagaccaccaggggctcgggaatgggcagagtcctaccgaaaaggccatgaggctccgactggcgcctctccgtgcttcgattttggtccttgtgtttcttgttgctcctgaggctcccaaagcgcttcatgggtagctgtggccacaggagtggcgacaggtgaacatatcaggacccacagaaccggtgtcagccccaggtggccgggagccagaggagcatcagcccgacaggcacagggcgccccaaaagctcagagtggcagcctgtgctcaggtgacagcccgggttcaagcgtcctcaccagggggtcttcagggcgacctcaccgcagccccagagtctgtgaggcgccagggagtggagccgtcctgacggggctgcacctccggccacagcagctggagcgtcagcccggctgtccttaagtagcaagaagctgccggaagcgcaaacagaacttcgcaggggatttgttgatgtagttaaggtcagctgctcactgatactctccagggctttttttttttttttttttctccttaaaattaaaaaaaggagggaagaccagataggcaaaggaggcacaagcctgcaagtcatgtgcagccgtgcatgatgtctctttaaacagactgtaaaaggaaaccaccctgggcagacaattcttggcaccaattggccagagcacattcccattgtgacatgacatcacacaactattttgattcatgggttccagggccccacggggtcagaaggctccggctgctgccgggtggagaagccacacaagtccctgggctggaaattgctgaatctaccctggctcacggttccactcaatgaaagcagcaatgccgtcttcaaggaggggatacagctccccgactggaatttaacggaaggtcttcggcaaatgcgtaatttgagctctggacttgctgagaattgcagcatgacagagctggaagagattttagagagatctagtccaactcccttctatgacagatggggaaacaggctcaggacagggaggtgacttccccaagatcctgtcgccaatggtagaaccaggactggagttctaatctccttgactcctaagccaaaccgctgatcaagtaaaacctaaaacatttataatttgtatatgttttgcaaccaataaaacaaactttggaagcaaaagatagaaaaaaaatccttgactttttgtctgatagcctcactaaagttacctgctttgctactaaccagctttgtgaccatcagaaagttacttcccatttctgaacctcagtttcccccttagtgaactaagacaagaccaggtcattttaggatttagtctagggccaggcacggtggctcacgcctgtaatctcagcactttgggaggctgaggtgggaggatggcttgagcctaggagttcaagaccagccagggcaacacagtgagacccccatctctattaaaaaaaaaaaaagagagatttagcctagttccaacagtctgaacctctcatggtaactgattcttcccaaatgactatgcacatgaggaggagactatgtcagaccagttaaataacccccgagctaaagattagtagcctgggttcttctggccgcccactagggtgggataacctcccaaaactgcaacgccatcagtttcttcagcggaattgttattatctacggctcgtccgaaaacaaggggatggagtgtggggtggaagcgccccagcagcttgccactggagcccaggcctcctcaggaaccacaggtccagcctcccaacttgggttgggctgcttttcatgccttttctctcacctctttcatttacagagctcagtgccactggagttgttggcccagtcactgcagatgcctgatgagataaagatggctccacactcgggcaacaggaaggagggcaagggaagtcttccattctatccccatgagatgaaaccctggaagctcagctcccaccccagatctgccattcccatggggcctccatccacagaagccagagatgcccagatctgccactcccacggggcctccatccacagaagccagagatgcccagatctgccactcccacggggcctccatccacagaagccagagatgcccagatgtgccactcccacggggcctccatccacagaagccagagatgcccagatctgccactcccacggggcctccatccacagaagccagagatgcccagatctgccactcccacggggcctccatccacagaagccagagatgcccagatctgccactcccacggggcctccatccacagaagccagagatgcccagatctgccactcccacggggcctccatccacagaagccagagatgcccagatctgccattcccacggggcctccatccacagaagccagagatgcccagatctgccactcacacggggcctccatccacagaagccagagatgcccagatctgccactgccatggggcctctgttgggagcaagccccccaaaatctggccataaactggccccaaaactggccataaacaaaatctctgcagcactgtgacatgttcataatggccctaacgcacaagctggaaggttgtgggtttacggaaatgagggcaaggaacacctggcctgcccagggcggaaaaccgcttaaaggcattcttaagccacaaacaatagcatgagcgatctgtgctttaaggacatgctcctgctgcagttaactagcccaacctattcctttaattcggcccatccctttgtttcccttaagggatgcttttagttaatttaataactatagaaacaatgctaattattggtttgctgttaataaatatgtgggtaaatctctgttggggctctcagctctgaaggctgtgagacccctgatttcccacttcacacctctatatttctgtgtgtgtgtctttaattcctctagtaccactggagttgttggcccagtcactgcagatgcctgatgagataaagatggctccaggctagggcaacaggaaggagggccaagggaagtcttccattctatccccgtgagatgaaaccctggaagctcagctcccaccccagatctgccactcccatggggcctccatccacagaagccaaccgggttcgggtctccccagctgagctggtctcggtagcctccatctgcaggggacacacaccagctcccaagaagcctgctcggccccggcatggctccggtgtagctggagctggttctagcatttcagatcccatcgactggtagagcaactgctcacgtgattggacctgacctattaaagatgtgtaagtgtgctcttcctgcctaggggacctgacccatctctgtctagaatgacctcatagtcataccattgcttagccgatcaagaaactatggtctcaacttttctcatgcaatttctaccaaattgactgagtaacaactgtctacttggtgctgtgctgaatgttgtaaggtcagggagtcctataaggcatgacccagcctttatttatttatttatttatttatttatttatctatttttatttattgagacagagttttgctcttgttgcccaggctggagtgcaatggcacaatctcagctcactgcagcctccgcctcctgggctcaaatgatcctcccacctcagcctcacaagtggctgggactacaggtgcacaccaccacacccaggcaatttttgtatttttcgtagagacgggggtttcgccatgttgcccaggctggtctcgaactcctggcttcaagtgatccacccgccttggcctcccaacatgctgggattacaggtgtgagccaccacacccggctggaattttctaacctacctgctttcgcttacaccatttgccctgcctcctaagcccgtggttttcagctctgcctgctgaaaccccatgaaacccttacggcccaatccagagaccgtgccttcccccaagtgagccctccctcatcactccccaaagaggggacttttctctcctttgaaagattttagctcttctattctatatgtgaatgtcgcccttaccacagagaagactgggaaccccaaaaagataggggcccaggcctcacccgttgtgaggatctcccaagcctacagcaaggcacctgctttgggaggcaccggacagtcaccctgaacgcctgcggtccctccagctgcccctgctccctgatggagccgactggagggactacctggccaggctcctcctcccgggctgctggttagctgcagccaacagtgggcacagcagacgcccgaaggagggaggagttgaggctttcatagctccctacatccctgcagggttgctctggccttgctgtgtcatctcccaagggaagaattcagctcctctcagagaaaccctccctcagacctctgtcttgggtcagggaccctctccttcatccttcaggcacagcagtggcagcagccctgctgatacgaacccgagttactgcaccagtcctagggggttcctggcagcctgcccacacctttgaaagtagtgtctttattcaattctcctccagtgatccaaaaagttcagtgtgcctcctttctcctgctgggactgactgatagatacggggatcagatatttgtagcaaggatgcatgaatgaacacacaaaataggtcttgctctcagtgactttgcaaatgagctggagacaaagataaacaatgctaactgcatgaaaaagccgtgagtatgtgagccgtggctgcaagtgtcgtcagcacaaaggaaggagaggagaaggcccgtgtggccctgcccggagaaggggaacttgagatgggccttcagggttggagggtgtgaagaagaggggggaacccaggccaggccaaatcaatgccggaggggaccccagccttcccaaacaagccgcgaaatctaccgccagctaggtcccctgatatactgatggattatttctgctgttaaatatggtagcccaaacttaactgtgattaaattctggaagtaggtaagtttaggagtttcatgtttagatgtctttttttctttttaaaaatcagcttctaacaaaaattgttttctcgatttaaaaataaaataacacctggtgcggtggctcacacctgtaatcccagcactttgggaggctgaggcgggaggattgcttgagcccgggaggtccaggctctagtgagccatgatcctgccactgcacatcagcctgggcaactgagtgagaccctgtctcaaaaaataaaataaaacaaaataaaataaaagtaacaaagcaaaacatctttaggaaaagacctgaacaagtatcccaataagaaagaggcagatttgattaaaaggaaaatgaaaaggttttgtttcagccagtgtactattcttacactacataatacaacggacagaaagaacatttcaaggccgggcgcagtggctcacacctataatcccagcattttgggaggccgaggcaggtggatcacctgaggtcgggagttcaagaccagcctgaccaacatggtgaaaacccatctctactaaaaataaaattagctgggcatggtggtgcatgcctgtaaccccagctattagggaggctgaggcaggagaatcgcttgaaccaggaggcagaggttgcgatgagccgagatcatgccattgcactccagcctgggcaacaaaagcaaaactctgtctcaaaaaaaaaaaaaaaaagaacatttcaaagtttagtgactgaggtaaatgtattgaaatttgtgtggaaaataaccagcaacttaggcaggcctgacgtttccgtgcttgagtttaaatggtcattcattcaacaggtagttattaaacctctagtaagcgtgcagggcagttgttgattgaagggatgaggtgctacaaataattcggagaaattcctgtcctctaagaaccatattttatttgtaacataataacatttactgaatgcctaccatatgccagctggggtgctggtcaccttacagttattattttatttcatccttcccacacatgagcagggcaggtataattaacatttcattgaaattgaataactgagggtcagagaagtagtttgacctggatggcacagctggtaagttgagagaagatggacttgtcccctcatgtggacccgattcccaaattcacatccttccaccataccatactttctcatccatgtgcacaggaaaattcagcagccattcaataccctagcctgaatcccataggactccagaggaccgctgtggactgaagggatttggaaaagaatttctctctacatcctgatttttcattttaggctgggaaatttaaaggcaaaagaagaagcatgtttaaaaatcctgactgtggctcacgcctgtaatcccagcactttgggaggctgaggcgggtggatcaaggtcaagagattgagaccatcctggccaacatggtgaaaccccgtctctaccaaaaatacaaaaattagctgggcgtgatggtgcgcacctgtagtccccgctactcgagaggctgaggcaggagaatcacttgaacccgggaggcggaggttgcagtgaaccgagattgtgccactgcactccagcctgtgcaacagagtaagattacatctcacaaaaaaaaaaaaaataaaataaaataaaaagtccttatttgcattaaagccacctcgcaacacagaccagacgagtcaggaggctacaacaagctgacctgccttgtgggtacaccgtactctggaagcacaaagccggctgcttcctccccgaggccacttctaggtggctgagcacagaggtggggcacaaaaaactcctcactgctggggtctttctgtttgactcacacatgcctgaaattccttacatgagggacaaagctttggatcccacgattagagatgaacgctgatgcgttgggagagatggcgccttcccattgcagggcaggggctgaggacccttcttcagcatacgtgggcgggggaaagttgaccactcacaggcggatggggacaccaaaccttcccctcttctgtttccgccagtcgatgatcccacatgaatagaggggaaactccctgccacaactgtgaccctgctcagagttccttctaacagaatgcttttcacactcagaattcttttttaaagggaggggctgaaaaaggaaggaaagaatggctcccaaataggaaccgtattttctaatgtatttttaaagggccagggcctttttggatcacagtttaaaactcacacccctggctggtgctgcaacccaaagcctggcacgggaccaggtaattcgggtggcagatgcctttatctcttagcagtgccccgtgctgtgtggccaaggcttccaggtcaccattctgacactaggtttataagatctgggagggagtgaaatcagagctcagctcattcaacgtgtgttctttacgtgtgtcttctggtggctgttcttttagatttctgactacaaacctacctttgacaactcgaaaaagaaaacagtgtggaagaatactaccacaaggcatttcatactgttagcatgcttcattgttttctggcttttggtttaattttctccccagctagactgaaagctccccgatgacaggtatctcacccgcagaagaaagaaaaggagcgattactgagttcctccacgagactcaggagcagcatgatgggtcagggaacagcaagccagctgctgctccatgctcggcatccctgggagcagcatgtcctgttcctggaggacgcttttgtggctgttctggagccagggaggctgtgctgactgctcctctgccctcggcagggctccaggcttggccagccagggctgggctgcgggaggccatggcactaggtcccgttcactctaatacttggattttaccaggtgtgccagcccccccacatctggatgctgcaaaacattccacagccagactgtgcactacacagcagagctgggggcgagagagatgaggaaggagaggtcaggggaactgcagatgggctcgaagatggagcacggtcacccctgcttcctgcacatgaggataagtggcgtgaaggcgaccacccttccacaagagacacaatggcgctcctgtggctctgatatgtaacccccacccccagactccggtgacccaaaacatgcgagtaaaccctttaattgctggaggttctcagccggtgccccggggccacgttcccacggcatcggggaagtgccaggacatgtggcacatgttgtcccactaacgtggtgctggtccaggctgcaggttggagccccaccccagccttatcgcctggtgaatgggactctgggtctccgttgtagacaccatggttggtgcctagcctccacttgtcccccaccccaccactgcagtgggcatctgagagccgagggcgtcatcaggccgagctgcctcctactccaggtagcctgtgaatacctacaggatcaagccccttgaagcccaccctatctctggacttccaattatatcaaaaccaaatttttgaaaagaccccaagctttccgtctcatcaaagccactttgcatgttatgtgaagctgcaaatagtctccttgaagctgtcactggggacccatatgagagaaaagtcactgagactccgtgtaaccaccctccctccatgcgcctccattcattcatgagactggcacttcccagggcagggctgctgaggcctgggagcaccgcgcaggcagaatcagcccggccgaccgagagatccaccagcagagcagggcagggggaaccctagtcacccacaccctgcggctgtacagagctgggagactttgcccgcagcagtttcctacattcttctcaaccatgctgtgtggtagggaggccagccatgactattcagttcaagaaataacatttttcaaaaacccagaagttcagaggtgctcagtgatttgcccaggatccgtgggcagcttgtgggattgtgggggtcgacactggctctgctggttcctcatcagggggccatcaagagccaggctgcctctgctccatgggtggacggctgcagaagcaggtgaggatgcactactcaaaaacttcccgctcatcctgaacctttgcggatcacgaggccatacctgcaaagcacccagtcccctgcacggctgcgttccaaaccacatctcattatgcaagagggcacgggtcccctccgcgccggggagcagcaacacgccttagcacatatttgccagagctctcctgccggttgcaaaatactgtgtcatgtttcatggaaagttctaaaggtcactgctgcacttgactctgagatcgccacgtcgcctcactggggcctccacgccctgccccaggaggtgtttatgagctggcacctctgcggagcaccctctgccctgactcaagcccccacgcctctgttccacgtcagcccgacacactcatggtcatgcacagcctcgtggtgaccacaggaactggagcctgagtctctgagtgacaagagggtgatttttttggcagagacaaaccacctcagctcacacagctccactcacaccagcgatatctaaggccactgagaactggcagaggcaacaggggcatcttgattttaaaaacacagagaagtactaaaaaggtgaaaaacgatagcaataattatttttagcatgccgaaatgcagcacccaaagagtaagaaatccctggatctccttaaaatctggaaggggcatcgcattcccccatggagggctcggtggggcccttttcagtcccttctcgtggtgcctggcaaccctgcagtcgctcagtgtccaagagcacaccaggccaagagctctgagggctccagcggcaagaacctgccctgattccagctgctccgtggcgcagaagctgagcgctgggctcaacgggggccaccaagcaatggcttctgaaaaccagattctgaaactctgcaggccagccatttgggttttctgtttaattctctttaagtgatttaattctcttacaagtgctgaagtgagctgggaatgcaccgaagccttggagaaggacccggttaactcccggactcagcggaaagccagtttggcctgtggtctctcacttctaggcgatggggcaggatttccagtgtctggacctgggctggtcacagagcaatccacctcctcctgcacgtcactccttaagaagcccctagcttagattatgagggctgagctgaagtttgcctcagatctctttcttcttatagtgaaatatatttcaaaacaaggtaacaggtagaaaggtttaaaacacttaggtcagagaaccttaaagcaacacaggttcacccattggcatgcaattctgagccatttagtttattcttccacatttctcccataagagagaccattttacagggtttcaaggtgattaaataagacagaatagcaaaaatatcctgtaagctgcagagcatttcacaaacagaggacatggccattctctgtccctgaaagcagcctctcaggagctccactagctcaggcacaaggtgcccgaaaggacctcgcgtgaacagctgcggaaagcctgggtgaggactgaaggccgcctgctccagtggctgctcctgggacggctgctgggcaccatgctgagaattcagaggctgtggccggagcctggggagagagcgctgggctccacgattctggcctggccaggcagcgcttggacttgcaataggagctccacaccttggcagaacctgctctggatctcagcagagaaatcagaaggaattggacaaagccctgctcatcagcccagtgctcaaagccccagcatttcacgtcctgaatgaggaatgaagggattttctcagtaacaatttactctttttaaccacacatactaagaaaactttattcgcagcaaattgtgatggggcgggggagagggtaggtaccattcaaggcaggaacatgggctgccacagagcaggtagtggcacaaggaaggagacagagagggtgagcagaactcgggcagagggcacagacatcctgcctcaaacagaagtttgttctcataactcagtggctgctgctggatgtgttgacgcatatagggtgatctagcaagaacctgactcatctataaagagtgaaattacagtacttggtatcttttgaataagaaaactgttggctctcgccagtaatctcagcactttgggaggccgaggtgggtggatcacctgaggtcaggagttcgagaccagcctggccaacatggtgaaactccgtctctactaaaaatacaaaaattagccgggcgtggtggcgggcgcctgtaatcccagttactcaggaggctgaggcaggagaatcgcttgaacctggaaggcggggtttgtagtgagccgagattgcgccactgcactccagcctgggtgatagagagagactccgtctcaaaaaaaaaccaaccaaccaaacaaacaaaaaaactgtaaagtatgtaatgcatctgacacttaaaaaagatgtatgctctggtactcgatggcttaagttccagatatctagaaagttagctcacgtggcttgttcattccttgagactggcaagatacaaaaacaaaacaaaacaaaacaaaaaacaaaagtcattctaccacttgattgttcactctttcagattggctttatcccaaatgtcagatgttactacattcacggacatcactcacctcaaattcttttctgtttatagcatcactctcagtggggctaagggggtgaaaatcacctcttggagggggcaaaaaaacttactttttttttttttttttttttgggacaaggtctcactctattgcccggggttgagtgctgtggcacaatctcagctcactgtaactgccacctcccagactcagcaatcctcccacatcagcctccctagtagctggtactacaggcacgtgccaccacgcctggctaatttttgtagtttttgtagagatggggtttcaccatgttgcccagactggtctcaaactcttggactcaagtgatccgcccacctcggcctccctaagtgctgggattacaggcgtgagtcactgtaaccagccaaaaatcttacttcttatatacaaggaacagctatacttacagtataagtaaacaatagatagtatatgtaacaatgtaaacaatagatagtatatctgttttattaaaatttcatagaggttatcagaaaaaagtcagaaaggcattttagggggtaattttcaaaagattgatttttttaaaagagagcagagggaaaactgggaaggtgtggggtgggacattgaattatctgcccctccattttaataggacgtcaacatacaaggtttaacactgataaatcataaaatagttgacgaggcatatgatttttaaaggcttcttttggggtttggttgaggagggtgggaactactgcttttcaatataaattgttttggaatgtttggtttttttaaccatgcgattgaactacttcactgaaaattaaaatgtaaaggggagaaaattgaacaaaaaaaatctggtaaatggtgataagtatctatagcagacaaaaatcagcaaggtacattctcaaaaactccctttggcaaaagctaaaataaaaataaaaaaggttgcaaaactccgtcatcagcagcggcaaggaggaaagaacatccgtgccgtgccacctggccttcgccccgccgcgcccgcagccagagagatgagctgggcactttcacccaacctgcccccagtgacgacagtgagagtatttgctaatcattcgccaaaattttaaaacacagttttctgggctttaggcaacatggggctggcctgggtgttttggagcctccgagggtgaggaagaggctgacggttttcctcatagaggcccacgggccagatgtctccagagaggagatgctcaaaagaaactgtgctcactgcaaagcagaagagatgcggttaagcaagagaactggattaaccatccatccaaagatcaaactcagaaaaggaggctacggagaatttgccatcttttctctctcctcactagaagctttaaagggatagttagaccctgagtcagcctttcacattgtagcaagcagacacctggaggggcaatgagacagtcccccgtccatcagcctatcctgatgccccatttctttgaatcagtgaactgtagtccccggtatccacctccctcactctctctgcttcctccatttcagtaagcgttcagtgtctacatgggccaggtacagagaagcagcatatgaaggtgacgttggtcatcaaaactctgctgttatgaaacatttttgtgcatcagaggacaataataagagagtgaaaaggcagctcacaggaaaggagaaaatatttgcaagtcatatatctgataagtgtctagtatccagaatacataaagaactacaactctacaacaaaaagacaatccaatcaaaaaaatgagcagctgccttgattaaatatttccccaaagaagacacacaggtggccaaaaggtacaagaaaagatgctaaactttactagggaactgcaaatcaaaacagcaatggtagaccacttcacatcctctaggacaaccacactgaaaaaaaaaaaaaaaaggaaaagaactgggtcgggcatggtggctcatgcctgtcatctcagcactttgggaggccgaggtgggcagatcacgtgaggtcaggagtttgagaccagcctggccaacatggtgaaatcccatctccactaaacatataaaaattagctgggcatggtggcacatgctcatagccccagctactcgggaggctgaggcaggagaattgcttgaacctgggaagcagaggttgtagtgagccgagatggtgccactgcattccagcttgggtgacacagcaagactccatctcaaaaaaaaaaaaaaaaaaaaagaactgaaccgttggcaaggatatggagaaactggaaccttcatacattgctgatgggaatgtaaaacactgcactgtggaaaacattcctcaacaagttaaacacaaaatgaccatatgacccagaacctgcagtcctaggtatatacccaagagaactgcaaacgggtgttccaacaacttgtacatgaacgttgatggcagctctattcacaaaaggtggaaacaacccaaatggccaccagtggatgactgagtaagcagaatggagtctattctacaatggaatattattcaggcataaaaaggaatgaaattccaatatatgccacaaagtagatcgactttcaaaacaatctgctaagtgatagaagccacatgcagaagcccgcaggtcatggggttctgtttctgtgagatatgcagaataggcaagtccagaaaggcagacggcagcttagcatctgctaagagctgtgggaaggggtaatggagattgagggctaagggatgtgaggtttccatttggggtgatgaaacagttctggaactagattggggtgatggtcgcacaacactgtgactactgagttatatactttaacactgttaaggtggccaggcacagtggtatgttcctgtcgtcccagctactaaggaggctaaggtgggaggatcacttgggcccaggaggcagaggttgcagtgagccaagatggcaccactacactccagcctgggacagagcaagaccctgtctccaaaaaaaaaaaaaatttgttaaggtgctaaattacatattatatgcattttaccacaaaaaaagttaaacctacaaatactaaaggaaaatatggattaattctacaatctggatttctaatgatgactaagtatgctcatgctattgtctaatggctattttcatgtcttttgaggattgcctaggcatgtcttttgccatactgattcaaagattcctttttttttttttttttgagacggagtctcactctgtcgcccaggctggagtgtagtggtgtgatctcagctcactgcaagctctgcctcccaggttcatgctattctcctgcctcagcctcccaagtagctgggactacaggtgcccgccaccatgccaggctaatttttatttatttatttatttacttatttttagtagagacggggtttcaccgtgttagccaggatggtctcgatctcctgacctcgtgatctgcctgcctcagcctcccaaagtgctgggattacaggtttagtaagccaccacgcccggcccaaagatgccatattttttttacagctacatggtactctgctatgtagctgtaacttctttatttcattgaactactctatttattatttatttatttatttatttttttgagacaggttctcgctttgtcgcccagactggagtgcagtgcaatcacagcgcactgcagccgtgaactcctgggctcaagtgatcatcctgcctcagactcccaagtacctgggacgacaggcacatgtctccatgcccagctatttttgtttgtttgtttgtttgtttgtttgtttggtagagacagggtctcgctacggtcttgaactcctgagctcaagcaatcctcctgcctcagactcccaaagtgctgggattacatgtgtaagccacctcacctggccaactactctcttctatgtgggtgtttaggttgtctctaatacatctgctgagaaggcctagaagcaatgacaccccaggagtgacatgcacacgtaaacactatttgccactaaaagtgacaagggctctttagagcaatggctaattccagggctggggtgaggaatgtacaagatcagccagaaagccaggaagtgcccacagcatgatggggacagggtggggatatgatggggaaagtcaaaggacacagtgatccgcctggagaggctcctgctggccacgtctaggacaatttgagcatcaaaaacttgataatgaagacatggaatcaacctaaatgcccatcaatgacagaccagataaagaaaatgtagtacatatgtgctgcggaatattacacagccataaaaaagaaagagatcacgtcttttgagggaacatggatggagctggaggcgatcatccttagcaaactaacacaggaacagaaaaccaagtgctgcatgttctcacttatgagtgggggctaaataataagaacttacgaacacaaagaaagaaacgacaaacactgggggctacttaagaggcagagggtgggaggagggagaggaacggaaaagataactattgggtactgagcctaatacatgatgaaatacgtgggtgatgaaataatatgtacaacagacccccatgacacatctttatctatgtaacaaacattcacatggacccccaaacctaaaataaaaattttttaaaatatttgataatgagaaataacatggcactgaataggatacaaatccatgagtccatagatacatacacacacagggagagaagaaaaacctgttctttaaagtagcattccaaccagtcaatgtagaattcatgataaatttagaaaatcgccttttggtaattactatagtaacaattcaggcaagaaatacatatcaatcctaaaactagcaagtgaaagtttgatgagaaagaagacatttacacaatcccaaagtaggtccccctgaagccctgactggtgacaagggggaaagtaagccctttattaaagtagagaactttatggtggcagacgcccccttcaccaagtgaccggcgtccacttcaccggaaaggtgtcgcggccgcatcgggtgaccctgctgggatgcagaagcccagggcagcccacggatgggtgggtgcccacctgagggcggaggctggctctgatggtgaggaaatgtcgaagggcaggtgacacaagaactggccgttgtcctcctgaaaagtgctcaggtcgtgacagatgagacaggactgaggagctgttccagatgaagagactgaagagaaaggacaacgaaacaaaacgcgtggctggaggtctcctcttccaagaaatgacgcccctgagacaaggcacaaaatgtgaatgaagcctgcagcttagctgatagcatgatatttgtgctgatttcctgattttgacaattatactgtggttaggagaatgaccctgtttttatgaaacatccactgaaatatttaggggtaaagggatatgatgtctgcaaattcctctcaggggttcagaattcatataaacacacagtgagagatcgtgagaaatgagatatgggcagatctggtgaaatgctaacatcgggcaatctgggtgaaaaggatatgagaactctttgtattatttttgtgactttatgtttgaaattgtcaaaataaaatgttatttattatttaataattgtttttttagagacagagtctcaccatgttgctcaggctggtctcgaactcctgggctcaagtgatccactaccttggcctcccaaagtgctggaattacaagcgtgagccacctcgcccagccctaaagtgttattttaaaaaaggaattaagaaatacaggctgagcagtggcttgtgcctatgatcccagcactttgggaggtcaaggcaggaggatcgcttaagcccaggtgtttgagaccagcctgggcaacatggcaaaaccccatctctacaaaatatttaaaaattagccgggcatgatggtgcacacctgtagtcgcagctactcaggaggttggggtaggagaatcgcttgagttgcagtgaactgtgatcgcaccactgcactccagcctgagaggcagagcaagaccgcatctcgaaaaaaagaaaaagagctacagtgggcctgtgtgttaagtaagagcatgtgttagtgctgccttttactgtctccgaaggtgggagcatcaccaaagcaggccctgagagaactagaggactctaactcgctgagggcaaggagattcttccgggaatttttcgttggcttctcccaaataataacagcctggacacaggatgtgcaggccagccctggctggggacgtcttccaggctggcgccagagggcgctgtccccagggaccacacgggatgccaggccacataactctgcaatgtgttggctgaacttttcaggaaacttggatgccgcacatacttttcctttctttgtgggcaggcaagatgagtcacgtttttctggagtctgctcagccccagtattcagacctcatcagctgccctggtccggaaggctccagctgtggccagtgagcggggggcccagggtgcccgcgttggctgggccagcactggggcttaggggcagacttgggcaagccagagtcaatcttttttgtcgggtacagggtaaagctcacagtaattctggatcatggcaacatctggggacagacccagggccctttgtacaactcacagggcacagccctgagggaggctgggctttggcttcatatagtccctgttctcccgcccacccaaccccctccgccgcacctgactccccaccacctctccaggccctaacttcgagtacctcactctccagcacttcgagctgcacctcactccccagcacttctccaggccctaccttcgcggtcccctcagttcccctgcctcccttccttccgaaggccactgtggtattggaaagttggagcagcgacctgaaggaagggaccccacctgtgtctatctgcaggaagggtcgctgcaggctctctgagaggcaggctctgggatggaaatgagcatgttggatgtacatcagggagtgctcttgggcctgacaaaggggcgatggagaccccgtgaagccccgacagagagttctgaagcccggatgccccttcagagctgtcctgagcgggggtcgggggctggtcctttatgtacatcggccggttattgggcgtaggccggctctgggaggggctgaaggctggcgaggtggtgctccttagctgagggccatctgtctgtcacacccacagctgggagtgagttcctcattcttgaaggaatcgggaatctgggaggcacggcacagcacagcctcaagggtgttctggctccagggtgttttctagcagagggcctaggggacatgctcagcatctcagggtgtttcaggcagagggcctaggggacatgagcctgagcagaggaagacagggggtgggtgtgcacaagacacagtcagagccagcccagggtgacctcagaggacctcagaggccatgtgtggtggggcttggagttttcatttaaatgtgctggggcggcgtcaaggggttgaacaggggatgacatgatgggatttatgttttaaaaacaggagttggcaaattactacccaatggcccaatcctgctggccacctgcttttataaatacttattggaacacagctgcaccattagtttatactttgtctatggcttcgtagttgcaaaagagaccacgtggccttcgaagtctaagacatttaccatctggctttttacaggaaacatttgtcaactgctgtttgaagagactcctctccttgctgggcagagtcatttccaaggcagcaaggggactctcacgggggccacggcccctcacgagccttcccagtttcaccccggtgcctaaagcaactcactttagcagttgctcgtgttctttggtattaatgatataaatcacctgtgcacaccatgaggttcctccaggaggctgcggggccctcccaggtggaagtggagaaaagtcctcagtgtctctacctgtgcgcaaacacaaatacttccactgccctctcccgcctcctctcccatcccccattggtctcctcctcttctcaggcctctccccctggaccaccagtgatgccggcagccacaggtccctctgcccccaaagcaggtctcgcctctgcaccatcggtacagtcccacaggcccctgtggcctccctgaaagtgaggagtaaaatgactcacgtacaggtcatgtgagcaatgccccaggaacacacaccacacacgtgactgcaacgaaggaagtgtgggttccttttaacgtaggagccaccagagcttccccaggaacctctctgcctctgaggcaccaaaggtttcctgtccttgcaatgctgggagggaccctagatggatttgtgggtgcatctcgggcaccccgctcagcacatggctcaggcacacgcaacgactcagtggtgcctccaggcgagcgggtacctgcgctgctctcatgctcaatcctcacccctactctgcctggatgcaggggctgacctctgacccctgctgccatgtgtccaggctcccgctgggcaggagacagggagacaccttgggcaacatctgaccatagctacagcccctttggctcccgttcctgccagacagaccaactgcagctcctggttccagccccgccagggctcccagcgccgccctcttcccttctcccacctggggtgggaaaggattttccttactcatcggtgggtcgcttcccaaactctagtctggcgtctcagctctttcctcacctttataaccacgcagccacataatcagaactgtgacgtccgtgtattaaactccatctgcttttagtacggagagtaaccctcttccaggtaggacccgggctgacagctgagctagggccatctgcaggagacgattcagacggggtcagcgctgcgattcgggggagtaaccagcggtgagcttcaggcctaaatgctggagtcctaaaattactcgagtctgaccccccggtttttggtcttgctctatatttagggacaatggccctattgatgctcactcgctgaaccactgcctggcgtttgttctgcggggcaagctggagtggggtgctcctcagccccgggagcccttgggatggaaatgcaagactcagaggctctaaattaaagtcttaaaagcttgggctcattcctccacacaaagcacaaaacctttggcattttatgggaaaacagacttttatttgaaaaataaactcaagttgctgggatataaaggaagagctgtctgtgatccaacgctgaaatggtgtgaaaggacctgaagttttacaagttaaataaacttctctgaaagactcattcgaatttcaaacagctcccagcacagatcctctgaaaaagatccccagatgcagcaggatgagacacagtgcccgctccagggtgggggtcaaccatgtggaatgggagattcggattcaaccacaaacagagaaaattaaattccttttggatgttcaaaatacacatgacctcggtcataattgtgagctagtcttggaaacggacagggggaaaatctaccattccacatctctggcagaaacccgggacttacttccatccagcggatcctctgtgccctaagaaccccccaaaccagactcgcctcaaaggcgttccagacgcattctgctgttctctgaccatctagggtggtgttttccaaactgcaaccactgcccccgccaccccatcatgaaatcaaccgtgtgggtcagataaagcagctgaaacaatagaatcgaaaataaagtacctagtcagggtcaatattgcttcgtaaaagggcttttgttgatgtgttgtatgtgctggattatgccatcagatggatttgttactgtgggctgcagtcaaaacgttttcaaaccactgctgcgatgaagccctgcggctccgctttaccatctcagtgctgtaaatcttccccgggtgtcagagtatattctccaccttttgctttgtgcttgtccctaccagacaccatggtcatcacctagagtagccttcggtgtaatcaaagtaggtggctgtctaggccagtgattttcaactcttttttttttttctagtaggacaaagataatgtcccaatgtccagcagggctgatcctgtcagtagcagttactgggtgtgccctgctgcccccatcagacaagatgccatttcttgctccgtgggggccagctggccaaaggccaccttgtctcactccctaaaagctaccactgcatgattttagggttctgggaagacagtcgcttccaaaaagagaatctgtggcatctggttttgatgctaggaattctttctttgttatgagataaatgtgtcaactacccctgaactatgtcacctttaagttctataatgtctattttaaatatttttgccagaactgtttccatctgagggaggagggaaaaggataaaggcatgttgagctctaggagctgggagcccacagaaaggaaaacagagcagggagatccaaggtccccagagacatggtgttcttcccatgttgggtgaccatcagtgtaccccaaaggttccaaaccccgaaggcactgatagacctggggggatgaggaggtatgaactggaagagcttgggaaaataagaggcaagtgcatgaaaagctcaatatgtgatttttaaagagacaagaaggcaataggaagttatcacgagagaacacagactgcaaagagacttaaaataacagctatatttcagggctctggcagattgctcaaggcaaacagaatccagtaaggctttctgtagcgggcaagacttgaaggaggtctctgaggaggcgggagaccatgctaatgtatctccagatccactgcagggacccctcactgctcaccccagccctgtctctaccatctctttactgcacagtagccagacatctctctgcattgcatccgatcgacatccgatggctttctgtatcgctcaattaaaacctggaatcctgacctctcctgcaaggccccgccccactccctgacctcactccagcacctgctccctccctacttggttctggccacattgaccagctccctgcaggctcagaggctgctcctgcctccggacatttgcatcgtgggcccctccgccaggcgtgccatggcctccacctgtcctctccctggctccatctcaccactggccaaatgtctccatgtcagaggctattgctgacttgcccacatagagcagcacccccgcagcccctctcctttgactgttgttcctcttggcacttgggacacatgacacttttccacctgtggtaccgattgtccctagaatggtatccccacgagggcagggatgggctcattcactgctgcgttcccaagggcccagcacttagcaggttctcatgtaacgtggtgcaggtgaatatcctccatgccagacaactcccctttgaaacgcctgggcaggcaggtatccttgtccgctcctaacaccagctttcttctgtctgggaggcgcatttgaaggtgaaccgcactggaaaaaacccaggcaggaacgatacctgctgctttcccccaggcaggaccaacctgctcccagcaccagactcagcatgtgaggctatgtcaccccctagtggtcactctgtcacaaagccagaaaaaccagaggtgggctccgcctggccagctgttctcagggccaaggggaccccgacctactctctcacccagactttttctacgagtgaactcagatgtaaacagacattcagaaaataaaggtgaaaaggcatctaatattgaggccacattgtcttgaatgagggagagatttaacatcgacattcttccttctagtacgggctccaggctgagcggctgtcccaagatgtggactgtggtggggtagcaccaagtcattcctacagagtttctctgttcattgcagattatgtgggaatttatcaaagattagccttttctttttttaaaaaaggaagctgagatgggaggcaggccagagagaacctaggagaagtgaatatacagcaggcagagcccagacctgagcagctgggtctcccagaagcctgtctccatcagcctgctttgcttccttacttctttgagagagagctgggtgtttgtttattgtttttgaaacagagtcttgctctgttcccaggctagagtgcaatggcaggatctcggctcactgcaacctctgctgcccaagttcaagtgattctcctgtctcagcctcctgagtagctgggattacaggcacccaccatgcccggctaatttttgtatttttagtagagacggggcttcaccatgttggccaggctggtctcgaactcattatctcaggtgatccgcccacctcggcctggcctcccaaagtgctgggattacaggcatgagccactgcacccagctgagagagttttttaaaagctggggactgccctacagcatgaggcttttgctaatgtgcacttagcatttcctctgccccagacctctgagtggctctctctctggctccagtgtggtctccttaccagagaagacttccctcgccattccatccaaagcagcacccaccccactacccactctctcgctctgctttcctttccttgacaacgtgggggcagttaaagtctatctgtgctcccgtgccccatccctcctccagccctctgtctggaagattccaggctagctctgccagcttggccatgattgccttcagccaaacagcgcaccttgtccatagctcccctggggcaaggagatgtgtcaggataaagttaggatggcttcgtggcatgaacagaaaaaaataactgaaaggaggctaagccacaaggatgcttatcacctacaataacgaacagttagtaggtaggcagttgcaaagcaggtcagcttagcgaaactgcctttgcaaaagtatcactgttaggagaaatctgacatagctgattccatattgcttctgacctccaagtgtccttggtcattcctgggcacacacaggccaagctaattttgggagaaatttagtttatagtttaaactacatacagtttaaagcaaggatgatactagcccttccccaaactaaaacaccattgcaaaactaatgagaggccgcaaggttaggattgagagaggcctgaattctgctaagatgtaggtgtagttaaatgacaaccagccattgtcccgaggtcacaagatttgtaacttccccaattactcctgtagataacatcactattagagaacctaagattggccttttgagatgtctttccagacttctgcatttctggcaaccaatttgacctcacctggactcctgactcaccacccaaccagtcctgtggccccacccagaggaggagtcagtgtcattttccacacccctctgaaggcatcccaactaatcagctgcacccattccctagtccctgcccgccaaactatccatgaaaactgctaacctctgagccttcaggtagactgacttgatttgatagataactgtcctgcatggcatgaccggactcatgtcagttaactctttctttactgtgacgccgtggtctcagtggattgagtttccctgtacaagaggcggaaggacccatcgggcaatgacattggtgctgccaactgcgtggagaatcacctgcccacctttccactcagccaccttgtgccttgacctttgtcctcatggccctagaaaccatgtccccagaccacagtcaaaggaagaaaaggaaatttatccccgtgtgtcttttttgttgttgttaggggacgcacgtttttcttaaatccctagccgacttctcccattcactggcatgtgggaaggggatacttctgactgaactagaccaactgcagctcatggcctggggccatgccctgagttaaaccaggttctgctatgaagaaacaagaggcagccactgtccgatgggttagcacagtctgctgcgcacctcagcgaggaacaaactgtgcacatggacaaatgtgatggacttagcgggagaaggggcccaggacaggtggggagaagacgagaggaaggccctgcatggtagccgagggcagcaggatcccctacacgcatctccagggtgggaaatgactttccgcagtaggcaggcaactgttgcaagaatgagcccaatggaggaaggaggcttggctatctcacagtattgacacacgtactcacacacatatgttaattcttacatatacgacgtatacgtaagcttaaggagcaggtaggcaggcacaagaagcctagctgtggcctactgggagcctctaaagggagccaccactgagaggcagtgtcagttctgtgaggatgggggctaggaaggctggcatgggcaggtcagctattcatgggagcaaaatacaggggtttggtggaaaagaggcaaactatgccaagcatcctctgtgtttggggcagactagcccacgcacatcgaccagcacctctgagctgtgtgccgtagaacaagccacttgccttttgccaggatgagcagctgccttgcaggattgccatgtgttcagaattggactcaaaccccactgaagctcactgctaaacactgaggggtgggggacacaagagaggtccatctgcaaccctaagaagcatcctttacagagcagacggcacattcagacacatgcccacagcgcggctccctgactgatggctggctgggataagggcaggtctgtgaggacaagcagcctcatcaagaccatggggacaaacaggaggcgtcccccaaagcaaataagccagcagcctgagcaggacaaaagccagcactagagatgggcagggctcccgagtcgtgacagctctgtccctgctccctctaccggctcctcccctctcagcctgcacgtgcttctcccaccttacaaagaaccaactgaaaacgtccattaaactgaatccatcccctcgctaccagctcgccttaattgtcgggtgggctcggaagtgccacagtaagaattaagcgccagaatctaagctgagcccctaaaaaggccacacacagtcagacgcagccaaggcaggtctcacgctaaggcgggtctcctgctgtcctgctccctcctcacctctgtgtctctgcctccagccatcccggcacagagtcgagcacacgggttgctcttgatgtcttgggtgggaagtgacgcctgtcctctctctttggtgaaaccccatcatgtggtcccaccctgaccgcaggggtgggctgggagaggcagaggagctcctggctcttgcacaagcaccaagctcctggcacagatgcatccacctgcgcttctgaccccagggccttgaaggaagttcgctggctcctcagccactgccccacacgctttccttcccttcctggctactgaagctgctctcttggaaatcaccaatgacctgccaagtccaaagcctggccggacctccagggctgatcgtcccctctcttgagggactcttctgggcctctgtgacccatatgcctccttggcctctttcatggaccctgggcctctgccctccctcgtgtgccagccatacccagctgtctgtctccagatgccgtgcctggtctggctgatgccgtccagggctatagctgctgcctgtgtcacctgacgagccctaacacccatttgcagctgacagtgccctgagcccaggctccccttggagcttgcaggcccggaaacccgcaagctctggacagaacatgcagcctcactgctttcctccttgtgcgtctctacaggagttggtgtctaaaagggacaaaggcacactccaggtggagaggggcacaaatgaagttaaaaccaagttagacagggctgggacgggcagacagcctggcagaggagggaggcagtgtttgcgcaggtggacggggtgtgaattggggggtgaggttggccctgatctggcaagcagtttgagttttctgaagtctctagcaagggaatgacataataaaagtggtgatggaaacatctgtgcagcagccgctttgacagatctgcaatcacagctctaatggccacaggggacacttcaggccactgccctgggccaaagccagagcgcagcccagcccaggagagtgatggagagaccagcgctccagaagggagaaaggctgtccagagacccagaggttggcgcccttccttggatgctttttcattttgctatttgtcctttaagctaacaaacactcaactccagctctgatttgctgacacctgagctgagggcctagggacctgctacccccgcccagtactttctgactgtccacccccagtgccaagagctctccacctgtcagacgacccagggagagcggggaagtgcctagaggcatcccaggactgcgatggctacaccacgagtgctgtcaactccttagttcatgagtcctaccagaagcccggagacctcatgacctattcacactgtcctgcctcccacccaaccatgctcccaggagcaagtgggtcaggggcagagccaggaggtgggggcagtgtcaggatggtcagggtttggtcccaggacgtgggggcagggccagcaggtgggggtaaggcctcaaggttgtagagagacagggactccttccccatctgtgaagcatggggaggctgcagtggggactccaaggtaacacacctgccctctgcctcactgaaaacaacagaagatcatggctgagaggccgagcatcctgtctgctgtgtggccatagctttcctggacatttgctgtgtctgttctctggctgctgtctatggccaggggggcttaagcaatgggatttatcccttcacagttctggaggctgggagcctaagtcaaggtgtgtgtgagcccgcagtccatctgtattagtccgttctcacactgctagaaggaactacctgaaactgggtaacttatgcagaaaaaaagtttaattgactcacagttctgtaggctctacaggaagcatggctggggaggcctcaggaaacttacaatcatggcagaaggtgaagaggaagcaggcacgtcttacatggcatcaggaaggaaagagtgaaggggaagtgctacacacttttcaacaaccagatctcgtgagaactcattcactatcgccagaatagcaatgggaagtctgcccctacgattcaatcacctcccaccaggcccctcctccaacatgtggggattacaattcaacaggagattcgggtggtaacaagaagccaaaccatatcaccatctgaaacctgggggagccctttctgccctgcagcttcagggatcacaggcaccagggcatccccgtctcagctccaccagctccctgggtctccgtcatcactgggccttcttttaaggacaccagtcattctggactgagggcccacatgaatgacctcatcttaaataattacacctgccatgaccctatttccaagtcaggtcacattctgaggtcctgggggtcaggacttccacaaaccatttttgccgggaacatcatacaacccttaacagttactataggattaaatgaaatcctacagtgtattttaaaactctatctaattgcacctgaaataaattcttcatcttgtctaattccccaattagccctggcctgataacttgattttcattcctgtgtgacccctggcactcctgacccactaacctgatgctgatgatggcatcatgtgtctggattggggaccttcctaacgttgacaggtgattcatctgataatggttttgagtggctattgtgtgcagatcctactcaggtattatagtatctccaggaactgtaataaacagcaatttcagactcaattcatctcctttatctgtgacactgtgtgaatgggaacacaatggaccaaaagaacactcagcccatgccaaaatctcccaaaggacacagaggtgtcactgtaacttctcacatatgcgctgcacgaggactcggctgggctgcagatctgaaacctttgttcttccaacttcacttacagcagtaaagcccatttatcaaaatctatttcctttaaatgatggtaggaacggggaagaagtgaggtgggggagaaacttacaggaagagtcttgtcaaaaggagacattttggagtcaacaatggtaggtgggaggttggtgggaagtgaagctcaaacacagttcactcaacaacctgtactcagtaacaacagacatgttcatctcactaaaaaggagaaaaccaaaggcgaggcgcccagatcgtggataagtcccaggagagagtaaaagcagagtgctgagaccagctatcaccctgatttggaacactggctcaggccactttagaaagggggactggggatgacctatgcccaggcactagtgtgtttcaagaaaaaggtgtcagaggactgcaagttcacagacacctgaagacagtggggtctgctactgtgtgggaggctccctctcatttatccgtcaaggcccgctaaagtgtctccatttatcacaacacctctccgagccagtccggcctaccactaactcatctttctccaactctgtccgtacctacggcctgtgttgttccattcagcacatcaatcgtggagaaggcaggacatatccattccttgatagtcctatgtcatgggttgaattgtgtccctccaaaagtcacatgttgaaatcctaactcacagcacctccaaacgtgacctcatgtggaagtagggtcattgaagatgtggttagctgagatgagggttatactggagtcagagggtcccgtagtccaatagggatagtctccttagaaaaaggggaaatttgaacacagagacatgtgcatggaaaaacctctgtgaagatgaaggcggagactgggggctgtgcttccaagccaaggaatggcagtgatgaccagcacagaccaggagaaagaacagacgcatggaacagaccccctcacagcctcagaaggagccggccctgcccacaccctgattccagacttccagcctcttgagataataaactcccgttttgttttattttgttaaagatggggtctcactctgtcaccgaggctggagtgcagtggcctgatctcagcttgctgcaatctctgcctcccgggttcaagcgattctcctgcctcagcctcccgagtaactgggattacaggcatctgccaccatgtgcggctagtttttgtatttttagtagagatggggttttaccatgttggccaggctggcctcaaactcctgacctcaagtgattggcccgacttggccttccaaagtgctgggattacaggcgtgagccaccatgcccagccaacttctgttgtttaatgcacgcagtttgtggtgctgttatagtggccctaccaaatgaatacacctgtcatgatttgtagtcatccacactcgcttagatatcagtgcatgtgagtgaggctcaaagagtaccagctaattgttaaatcctgtggcaagtcactctgtgacgtgagtcattactcactgacttttttgaaaccaaatgtttctgtcttagacctgctcaaaggaagaactggccaaaagctctggttcctcttattctgattatggagccagagttaagtgctgctgcccagagattctcatttctccacagcctcctttttctctcagccattttcctctagaagcagagcctgaggcaaggattaagatcaaggtgaggtagggcaggagaagcagcaatgaaatgagttgtcatgctggctgctgatgcatgacaagctgcaaataataacataataatcagaataaagagcaggggagcttagaaagcatgttcacttggctcatgggactcctccaggagggttctagaaaggaactatatgtggggggatccatagccatcatcaaggaggaggtttctgcccagcttcctcaaagccacagttcctactggtcaagtattactctgtggagagctaaactcccccaaacttctaggctgtatcatgcagccccttgtcatcattcatgaggccaaacttcctgcccaaattttaggatattcttgaggtaaggggaatacgcctgcaatgaccccaccaaaaccccattagcaacggcaaagcttaaataaatcagaagcttcatcaataaagtttagaactcttgttcttcaagatctctcttcctattctttctttctttctttttttttctggagatagagtctcactctattgcccaggctggagtgcactagcacgatcctggctcactgcagcctctgtctcctgagttcaagcgatcctcctgcctcagcctcccttagtagctcggattacaggcacatgccatcatacctggctaatttttatatttttagtagagacagggtttcgccatgttggccaggctgctcttgaactcctgggctcaagtgatctgcccacctcagcctcccaaagggctgagattgtaggcgtgagccactgcacctggccagtcttcaagatttttccaaacagaccaagaaggctgcagttggtgccaggactaagtcaatggacaaggacagcccgtgcctgaagaaacagcgactctgtagccttgctctttcttcccatcctgggccactgtgtcatgattcttacccactcctaatccaatccccacttgcaagacctcaacagacttggagttctaatgcactgtggccttcctgtccccctgagatgctccaaagctccatggagggtgtccccccagtgcagggagcaatgatgctatctggttttaccaaagggctgtgtcagctgtgctgggcaggcagctttctacagtgttttactgcatttaagagtcacaagaagaaactaacccaggcagaaaggctgtgaacaaacctcagtcaagcaaagaagagaagacaagtgaaagtaaacatcaaagaaaatggcccaggaactttgaatgcagttgatgctgtggttgtagactgcgctgggttagacagtgcccccactaattcatttcctttccagaacctcagaaggtgaccttatttggcaacagagtcattgcagatgtagtcacttaagttgaggtcgcagtggagtagggtgggctcttaatctcctttgactgctgtcactttaagaaaagaaaaagagacagacacacacagaggaaggccacaggatgatgaaggcagaggctgaagttacgcatctacgagccaaggaaccccagggtttgtgggcaactgccagaagctaggagggaggcctggaacagagccctcccagagccttcagagggagcatggtcctgctgacaccctgattccaacttccagcctccagaattgtgggaacaggaatccgggcagcttaggccatgcagcctgtggtgcctgtgtgacagcccctgaaactaacctgtgggccatgaaggcacggatgctgcagccgcatctggggaggtgtggcggaaacacgaggtgggcaggtggcactgcttgcggggctggggtgctgggctgacatggccgagggtgcacccccaccccatagagtgggcacctaacctgctggccccagagtgcgtgtgtccactgctagggaccacggaggccaaattcagtaccttttgagaaataaagctaaaattctaagcccctaaccaactgaaagaaccccctcttggccacggggaccccagaaaaaccttaaaactgagttcccggccataatgggatgagaggtcggatgtgcctcattacaccccctcccttgctaaccaccattaggcttccttccccaagggttaaatggaaacctgcccttttgaaagacttgctccattcctgagatcaaccagctgtctgatgctgccccttccttttgcaggttcgacacaaccgaccagcattccttcctgataagagacccctgaccatggagtggctctgactagcctatggaggctgcacacagacagtcttcgcatccttggcttcaccctctgacatatagggcctactgtaatccatttaaaggttaagtctccaccccagcgtgaacatggatgcatgctgcacacaattagccaattatgcatgtctatgcttcctctttgtgaatattcatagctcctcctataacctgttgaatatgtacatttggccacgctgttcagcataaatccctgtcttccactctcgcagtgcctgtttccagcatctggctagagactatgcttcccagcctgtcagaatggtgacctgctggctgcagcctttttaaagaagtgatcctttccaaatgtaggaaccttatcattcttcaactgacactttgctggtcactgagcaaggtgtgctgggaggagtgagggctctgaggtctcgcaggttttctggggagcttgattcttatggagtgacctacaaatagcacatgtattgaaaacacatcaaccagtctcagagcagccctgtctcttgggttttaggagttcgacctggagctgtaggggggtgagatagaaagtggcctccctcctggagaacccagtgaacaaaccaccatgccccacgccccatccccgactttagcattaagcgttgcagaggctgagaagtaggggttccagccacggttgggtcttgtgttgaccattttccagtgcaaccacaggctccctaagattcaagcagcactgtgggcttatgacctcacacatttaccattgcagaaattatgccaaagcatgatcaaattatctgcccacaatgtataggttgcttacaaaaataaccagccctcctctgttccttacttcaggctctaagatctgcctgatttctactactgtaagaacatagaaagtaatctcattacatgcatgatttttaccctatcttcattccagctatgttattctttatgcttttcccttagctaaaatttcgatttccgctttacatttttggcattttaaaataaaacattatatcacttctatcagcaccacgtttcttgtctttccaagtctgctgatgctttcaaaatccccacgtcccaaactcagcaccattaaattggagtgaggctggtggtggaatgggaggtgggtgcttagggattattccacttcctcctttcctcctgcactctgttccaaagccagagagctccgtgtccttttgctgtatctgaacaactgtgggaggaatcattttgtatgcatgcagtacacacaatgccatctttcctagaagtctcaggctctggggtatatatcaatatcacctgaggagcctgttaaaactttcgattccaagactcaggccattgagtcattcgcttcactggtttgtaaatatctttgtacattagggatattagtcctccatcaattcatcatctccttctggtctagcacgtgtttttcacgtttatattgttgttttgtttcattttctatttggagtgggaagctgtatggaagtggtcatcttgatgtcatcaatgataattgcctctgtcccttcacagtttctggacccggtcgggcttacatatgacccactgaaatccctgggtcagtatagccatcatcttgtattcagaagcatcagcccacattttagaaagcattgaaaaacaagttaagttgttggtgaattaatttcaaacaatttgctcagtgccttcaggcgccattctagaccctgagaaagctttgaataaaacagaattcctgtcctcagacagtttacactctggtggggagagacaggcaagtgaaccagtaaatagacagtatatcctgtggggaatcagtagtgtagatgcctgcaaggagattgctactactttacccagggtgtcaaaggaaggcctttctactaaggtgagtcctttcaggaaatctgaagaggtgtctggagaggctgcctgggagccagcggtgtgcttatattcccaacacacataatgcccctttcagggggtcatctcttctatccctctcccaccatcctacacagcacaagaactgggcttcaatctctggtatgacgctcccaaactctccaaaatcttctccaaccaaaactcaccttctagaatcttcccttcactcacctggacccccgttatgcatttctctcttagacattcttcattctttctaacaggaatgcatccagctctcctctacctcatcaatatagcaaagctctgagaatcaagcctgcaaactttgagagaaggcaagaaaggctgtggatatttatatcacaaacaaacatattttttgcaccttctagaaaggcctgacatcccaagatttagatattcaaatgttttggaggtacattacttaaaacacttaaagtttagttccacacggaaattattttggtgtgaccaagagccaggtgtggtggttcacacctaaatcccagcactttgggaggctgaggtgggaggatcgcttgagtacaggagcttgagactagcctgggcaatacactgagacccaatttctacaaaaagttaaaaaattaaccaggcatggtggtgtgcatctgcagttccacctattgcgggcaaagggcaggaggatcgcttgagcctgggaagttgaggctctgcagtgattctgccactgtactctggcctggatgacagagaccctgtctctaaatgaatgaaagaaagaaagaaagaaagaaagaaagaaagaaagaaagagagagagagagagagagagagagagagggagggagggagggagggagggagggagggagggagggagggaagggaagggaagggaagggaaggaaggaaaggaaggaaagaagggaagaaaggaaggaaggaagggaagcaaggaaggaaggaaggaaggaaagaaagaaggaaagaaagaaaggaaagaaaggaaggaaagaaaggaaaggaaagaaagaaggaaagaaagaaagaaagagaaagaaagagagagaaatgaccaaggagccacttttatctattttttcgtaaatggctagctggctatcccattattggtttatagatccctaagatctattccattaaagcagagtctcagcacctggactaaaagtggacttcggagttcaaccacctgacttcacattttggctttaccacttggtagctgtgtggcctttgttccacaacttaagccctcgtgcctcagtttctagtttggtaaacattgtacaaatagaagagttgctatgaagattgaaagaattacatacaatgcacttagaacacacacagacttttataaggagcaaaatttagcaacacgacattagatcattctggaggtcctgccttgctgactgtgtaagattctttttgcttttttaaaagactttaatcttattattggcagttcatgaacacacagacatgcactttcctttcctcatctccaaaggcaagatcaccctaaaccaacttgcaaaatcttttgaagctaaagattcactgttctggaagctcctgcagccactcagccacgtaataattcttgtggcacaaggtcagccaggtaaacatttcaggctttgtaggccatggggtctctgttgcacctgctcagttctgctgttgaagtgtggaagcggcaggagaggaacacacagatgggcgtgactgtgtctccatgacagctttgtttacaaaaagaggtggcacgccagattttgtcccggggctgattttgtcatttgctgactgctgcattagagggagagacggaaaagtggggcattgttttggttggggtgtttgactctgatcatcaaagggaagtaggtttgatattccatggtggctaggagtatgatgagaacgccagccacactacgaatcctcacgctactgtacctctgaccagaggcaaatgttagtgaaagactacggcaactccatacaggcagcctctgagaggtaagatccttccagaagaaaggtctggttctcttccctgggcaaaaaacaccagccagcctaggtacttgctggtcccaagatcagctgtggaatccagaaccatggtccccatctgtgttccccctcctgtcttagagtgtcttagaagattgaattacctctttttcctttttcatttctccctctgaaatgacagtgatcataattttcatcttcctgctttctttccccttaataatataaaacagtgtttatcggccaggcacagtggctcacacctgtaatcccagcactttgggaggctgaggcagatggatcacttgatgtgaggagtttgagaccagcctggccaacatggcgaaaccctgtctctactaaaaatacaaaaattagccaggtgtggtggcgggcgcctgtaatcccagctacacaggaggctgaggcatgagaatcgcttgaacccaggaggtggaggttgcagtgagccgagatctcgccattgcactccagcctggtgacagagtgagactccatttcaaaaaaacaaaaaagaaaaagaaagaaaacagtgcttatcaagctctggtgtatatcagtattacctgaggagcctgtcaacactttagattctatgtttgtcatgtaggccataaattataggacagaaagatgagatgcaaatagaacatgaggagaagtgggcattaccttgagacagaagactcagaaaacaggggatcatagccacatcctccttaatgtcaaggctggatgtgaggctgcatcgccctccatgggggaagcagcttacacaattgtatgtaggctcgttgggccacgtgtgatgagggcatccttgcgtgcatgcacacatgctggccaaggagggtgggatgccacagtcccctttggattgccaactggacctcttatcctggaacttcccgccctacctcctggttcttggtcattctgtttctcctgcgtgatcctaccccccaccccgccctgattgattcagggatcctaactgggctaatcagatatcctgcgacaaggcatttaggacagtaaatggagagagacacagactaggacttctctggatctcttggaaagatccacgaattcttgctgctgaggcctcagggccagtctggttccttcccttcctgagtcctgagggttcagctctttttggaattccgtaaatgcccccaaatccttccaacacattgtttgcttgttaaaaaagtggtcgtgtgaatataaaagaagagggacgaaaactggattcagaaaggctggaaatgtatcccttaatgccttttgtccagatttggttcaaaggcttctagcagccagtgcagacagaggaaatgcgctattacacgattaatgtctgctagagacaaaagcagtcccgttgatcagaagttcagctattcttggtaccaagaccagacagcaagttcctcccaggggccttgtgtaatgaacgaagtcttcatgacatccctccagtggacacagtggctttcacggggctgtttcttcccaagaccctccagatgggccgatggcattactcacaggctcaatttcatgaagttagttctagggcagtgggggagcaatctacagtctgggaaccctgatccaggaatagatttcaagtacggagaaaagcagacagattttgcctcctccaggccagcctcatgccaggcacaaatgaacggccatctggaaggagctcagggtgacctcccagtcaagtaacaccacagcacagagacctggagcttcgtgccttatcagccatagggctcggggagggatggcttctttcagggaaagccaaggagctggcctcactgattctcaagggcaccaacatgagcaattgccctggggaccaggcttgctctgttctgaactccccatcccagggggcttctctgaagaagccatgcccccaccccaacctaatcaatccttgcccttgtgagtagctgagagccatgtcatagccttcctgagcccggcccctggctgtctaccccgatggtgtaaccgggctgtaacaggctctgccttctccatagtacctgacaagccagaagagtgaacctggggattttctaccaaggacattgaagggccttggaaatactcaacagaaaaaggcagccgaaaggagccaggagtcaggcctgtcttcagtggccaacgtcccaccatgtccaccaacaataaagagctgcagtgcctgactccctgtgtcccaagggagggcccaggccccgggtacacacgggccccagcaggcagccccaggtcccgctcccttcgcagctgtctgcacttctgccataggaaaaaagcaattcacaggctcactgagctcacagaccacactcaggcctggaggaaggcgcagatggcaggcccagccggggcagtgcaggcaccctaggtgaggaagcagcagttttaagtttctggaatgagaggtagctgaggggctcatataccccagtgtgtggattaggggcacaggggtgtggagctatgagtggactgtgggcccctacccagcaatgaggccttcaggtacattgcagaggatgatcaggggcctcacagtctctgcttctgagccccagcctcatccccaggaccccttgggtgctggacactgccggggtgaggcctcccgaaggtacagcccccacattcctcagcccgcagctggagctcctgcagtacaggagatgggttgggggactcactctctgactccacctgcctgtctcggcccctggctttaaggaaagggtggaggggagtctgggagcttcctcctgtgcagaccacaggccccaatggaaggggccatggccaggttcagcatgggccccgaggtctagctcttcactgcggcagcaccccatgtggacaccagcagagtcatccccaggcctgtgcctgcgttccctcactgtgagcacagtgtctgctgggacccgctgagatccagaggggctgggagtcttggatccacctctgatagaggttgagtgtttcttccccgctctcaggttgaaattggatccccggtgttggaggtggggccccgtgggaggtgtttgggtcctgggggcagatgcctcatgaatggctgggttgcctccctgcggcagtgagtcctgctctcttagctgggtgctttaaagactccagtacctcccccctctctcttgctcccttgcgtgtgagctctgcataccccggctttccttcgccttcctccatgagtggaagcagcctgaagcccttgcaaacaccttggcagagatcacgacagcaggagaaggtccagcctggcccactccatcctgcatccagcctcacaggctggctggctttgctcattacctgggcggaggccaagctaacaaagggaggaatttagtttatagtttaatttgaaagcaaggatgataatagtacctccctgaaaccaactgttccttgctcagggactgaaaaccagctttgtgagatgaatgaaagaccacagattaggattatgggaggggcctgaaccgggctaacatgcaggtgtagtttctatgatctcgtactgctctggggtcatggagccagaggtcacaagacttgcaacttccccagttgctcctgtagatagtatcactatttaacacctaagattggtcttttgagataattttttagacttgaattctggcaaccaatggaccccacccagacccatgactcatgactcagctgaccctgtggccctcacctagaggccgactcagtgctggaggcccgtttccacaccactgtgatctcatccccaaccaatcagcagtgcccgttccctagccccctgcccatcaaattgtccataaaaaccctaagctctgagcctttggggagactgatttgagtgatagctccatctcccatgtggctggcctcacattaaacattttactacaataccaagatctcggtgaattggttttatctgtgcagtgggcatgaggctcccactggatggctgtgccctccccagaagcagatgctggcaccatgcctctgtgcagcctgcagaaccatgagccaaataaacctcttccctttataaatgacccagcctcaggtactcctttatagcaatgcaaaatggagcaacaccgcctcccatcctggacctccacactcagccatctgtaggttctccccatgccttctccaagccctgctacatcccagcattccccagctagcccttaaggctgagcacggggccttggctgtccccaggcattcctggtggctcaactctttcttctgctgttaccaacacccgcaacttctgttccacatctcgccaccgccccaaagctcaggtctgggagcttgacatttttttcaagatgtattcatttttaattaccaataagtgaagctagtctcaaaaaattggaatatcagataaagcaacattttccttccacccatccactcctaattcttcacttagaagctaccactagcagtccaatgcatgtccttttaaaaaataaaaaaggtatatatgtgtgtacacacatacatatatgcacatacatacacacatacatctatacaaatccaaaacacacacacacacacccatatatgctgtgttcaaattattatatgcatatgctttcttcccccataaatgctttccttacagtcccttctagctttgattatctgtctgtctgcaattctgtcagttactgaaagaaaacagttgaaagagattgaaaatctaaacataaataacaatgaaagatagtgaaaaggaggaatactttaagaaattgatatggtttcaaaaagagatttttccagacccagtttctaaaagaacagctcatttcccaggctgaacagtggacagcaccaaacctcccaccaaatgctgtactgagctgcagcctaggccctgaggactgaacaacttctcctgcacctcctggtgccactgctgggctcccaaagggaccctctgcctgcagggaccctcctcctcctctccccgctcctccctctcaccctctcctcccacccccatggagggctctgtgcaggagaatgatgtagagggaggcggagggtgatggttcctgccagagcttcaagaccttcccatgggagccagctcacagctcctacactcctttgggcacccttccgatcatcaggttccctgtgctgctctccgccccgctcagaaagcctgccctgtcctaactgagcacaggcagtaccatggagacaatctcgtcctttcttctgaagcctgcttgcctctgactaggagcccttgaaggcaggaatcctgtcttttcatccaccaattccagcacattcaatctacacaacatcgcaagttccccaacaaggcaaactgcgcacacatcctccttctctttgacaaatcccacctgtgtgacgtggagccctcacgcagctttcccatcaggacgggcctgatttccttcctctgtacagcactttgatccctcatctctagacgatgtttatacaaggagatggggaaagaaaggggcaccttaaggctaaagtgcacaaacttaaaggaaattgtgacaaccccacagccttgagtgaggggtgtgtgtagagcatggtcaggacctgccccccacaacacacacacaacccacaggcgggagcaccttcatttgttttatgtagaaagacgaagtgcaaaatctgtccaagagatagatctgctccactcacacagaatacggccaccatcccctccacctccaaggtggtggatgaagtagtgaggctgacagagacctggcttctcgtcctacagccactgctgcctgatggaagagttcgaagtcagaaacaccgaaattcccctcttgctgccgcctggccttgcagatataaagcgttgctctaacacacagtattgccagtctttctgagtaaaagtcagcctggagagaaaggtgaactatcccaggcctctgatggtcaaggacaaatttgttttccacatcactatcttccccaatacaaatgttctaagtcagtagaaagaactggaaagaatagacaaaggaaaggagaaagtaaacgccataaactttctagttcgtggtatatttcatattatcatcgacggcgctcaaatgaaaataccttatcctcagatcacaaacactaatgaacctacggaactctttcttaaacactcacatttcctccttccatttccccagcaaatccctcctagcttccattccctgctgcccagagccccaaacagaaaaagttaggatttgccagaaacaggtgtagtcaaaccctcaaataccaaaccacagagagtggaagccatatcaggctgaccaaagcagtatggtcccgtggccccgggtgagggcctaagcttggctccatgcctgcagtttccagagaaggctggaggcaagtgtgtcatctgattgtccatacaagctgtactgtgagtatcaggatgtttacagttaacccaaggaccttgctggaccagaaggattacgctttgatagattagcatgggaagaaagtgacaggtggaaactgatgttctggagagagatttgtttagggggaagtgggggtggggagaaacagatacaggcactcagcaccaagctgctcacagccacctggcagcttcggtgccaccgtggatgtgtggctgcagaagagacccccagcaccccagcacccacctgaaacaatagcatcaaggtcttactttttctggagcgggagaaaaacctgatgcccccgggcgaggtagcagggttggagttgggggaagactctttggaggaggagcggaagatcccactgaagctcatgcgtcgaggggagcgtggcggggactcctggtaggagaacgggaacacggttttgggagagccggggctggtcttgggcctcacaggtgcagacatggggctggagggccggggctgggggcctctggagaagaaccctttggaggggctgcccgggccgaaggggctgtccacctgcagaaaaacagacgaatggatgcagtcactccacgctctggacacgctgcctcctgccctgtatgaaacttatcattgtcctctctcacatgcgggccccccatagtaccctcccagagaaacagccctaagctcttccacagaggtagccactgaatggtctgcaggtagcacctgccccaaggatggcccctcacaggctggcagcaccacgtcctggaggtccactgaccatcctgtcccactccttagaaggggcttccaggaggtagaggggaggaagggaagcggagctcaaaatgagcgtctccctcctttattatgggcctgcctgccttcacctctcaagacctcacgtccatccaagttctgaccacacaggactgcagtcctcttgcctgcctataagatccctatgttccagaacagagcgggcctggagctccatcctgagacctcagtcctaggtgatgatgaatttttcacctccaagctgcttcagcatttgaaagactgaggttgccaacagaagtcaggagaaaagttcacaaagccagccgggtacggtgactcacgcctgtaatcccagcattttggaaggccgaggcgggtggatcaactgaggtcaggagtttgaaaccagcctggccaacatggtgaaaccccatctctactaaaaataaaaaaataaaaaaaaaattagctgggcatggtggcgggcgcctgtaatcccagctactcaggaggctgaggcaggagaatctcttgaaccccgaaggcggaggttgcagtgagccgagatggcgccattgcactccagcctgggcaacaaaacgagactccatttcaagagaaaggaaagaaaggaaggaaggaaggaaggaaggaaggaaggaaggaaggaaggagggagggagggagggagggagggagggagggaaggaaagaaggaaggaaggaaggaaggaaggaaggaaggaaggaaggaaggaaagaaagaaggaaagaaggaagttaacaaagccccaaacctctgagactcacttcaccaatgatttaaaattctagtcatggcttaaaaaattatcagaccccataactttaagccaaggcacagagctcatagcagactttgagaaatatctcacgtgcccgcagccgtgttcctgctggatgcgtggaggagctcctgccctgcctctgggtgccggtatttggcccctgctctgccacctgctgagccaacctgggcatgttacttggtctcaccgagcctcagctccctcatctgtaaaatgaggatggccgtgccctcacctcaagggctgcttgaacgtcagatgaagccgcgtgaggccaggaagcacacggtgcgtggtaaacagctcttgtcctaccacttgggaaacttgcaagcaacactgagtggaaaggacctcagagatgacccagttcagaagcaagaagggcgagtaactcgtccgcagcgctcgcggggagccaggaccagggcagacgcgggaaatactgccctcgggcggccgcgctgtgctgaaaagggaacacaggacaccccacaggcagcctcggtgccacttcggggtctctctgtcccaccacggggtgcgctgtccggaccgcggcctggggacgttcttccgccactagagggcggcccaagccccgagcccgcggccccgggaggataggatgcccgtggcgtggacccgcgcagcacagcctccccgcgcggcctctccagccgaaagagccggcgccgccacgtggaggtgtaggtccggcctggcgcggacaccttcgtgagtgggcccggcaggaagaagagtgtggtgctataggaccttgtaactcaagctaagttttgagtttttctttttttgtgtagttctgttttttgtttttgagacagggtctccctctgtcgctcaaggctgcagtgcactggcgcaatctcagctcattgcaacctccacctcccgggctcaagcaatcctcctacctcagcctcctgagtagctgggattacagttgtccatgcccagctgattttttttttttgaccatttaatatgaaaagcatttagattctctgtttatagaatatcccagttagccactattccacctaactatgggaatcaggacaaatcctgagaataaatttacaaacaagagagtcttcaggcagggggtggtgtctcacacctgtaatcccagcactttgggaggccgaggtgggtggatcacctgagctcgaccagcctgggcaacatggcaaaaccctgtctctacaaaaaatacagaaattagccaggtgtggtggcctgtagtcccagctactcaagcagctgaggtgggaggatcacttgagccccagagatggaggtggaggttgcagtgagcaaggtgacactactgtactccagccagcttgggtacagagcaagaccctgtctcaaaaaaaaaaaaaaaaaaaaaaaaaaagaggttcttcttcaagtggtgggtgctgtgtgtgcaggtctagggtgggatgggggctgagagaagccagtaggaacaacacacacaggcaccagggtggtcctatcacaaggtgacataagctggtcctgggtggaggcccgggtttggtcacagctcagtttcccgcaatgtggacaacgacttggttgtccaagcctcgttcccagggctgagacaatcacgacagcagcctcgagggtgtgaaccggaagaggagccgaggccacatgggaggaccggagggaggggtgggattttggagctgctggaaaggtgagcccggacctggtgcatggacgtgctctgtttacagcatagggagcttgctggggagccgggggagagggccgagccaatgcaaatgtccagtcctacagggaaacagagacacataggggagcggggccccaggagagcttgcagagtgcccacaaggccgaagcaccataagcaccatgcagatggataaatggcccggagctgaaacctgccccttaacagaggccctgacccagaggaggccctgacagctggctaggcttcagagacgcagtgacagggccggggaggtgtccagtgcccagagacagaggagaaggggtttgaagcacagagacagagggccggccattcacttgggccaccatgagggtgggggtcacgggggaagttgagccatgagcccctggagaaccagtcatgaaaggccagtttaaccatatttgatgagcaagggggaccccaggattatcctgaatggggttccattctgtattctgaatccaggccagtggagtcgggcatccagggatcaggcctgaggagggagccctaggaagcagccctgccagtcctgtctctggaaaatggccgaagcatgctggatgctgggccctgtctgacccctctcaccgggaaccttgggggccagatcacactcccagacggtgggaaagccaggcggagggacaggcctgctggggtgggctgcgtggcggtgcagataacaggcgccagctgaagccaccagggacagggcctcaggccttgctcttgggcaagctatagccaaatgatatgttggtgaatgcaaccggatgattccccgggtattgacaagactcccaagtgtgtgcctggctccgcagagctaatggagagcaggcattcagccgtctgcggagcagagctctgcctatggggccatttgtcatgcagctgccagagaggaagctggggccagggcctggctgtggcccctgtgtctctcccacactctcagatcttccgtgcaaggttttcactggaaagaagggttttgcagagtcaaacaggaggaagacgacccagtgcccgcggggctggtcccacagccttgcacggggttggtggccccttcctgccactccactctctgctggcccagaagctcaaggccattccctggcagtctttgctggatgggccacgagagctgctaataaggttgcttgttcagggcagggtggggagggcactggcaccagtggagccccacaggccgacaccaatttgattcagttgtgtgtaattcaaatgcttaaagaggagatttgctttttccagcatgggaactcctgccttcatcccaggctagccggcacccagaacccatcccagaccctgtacgtagcccccagatcactagctctgtctgctgtcacctgccggaggggtctgtgggtggcagaatgccaggaagcacgtcccctaccaggcctccacccacccttacttcctggctgcaggagaaacctgcaagcagcctggacctctgcgccctgccacggccacctcgaccctcacctgatgctgtggctccctctccagagccccccaccccaccccacactctttctggccacctgaccctacacagtcaacaacctcctcgagacactagtttcctaatgggagggaaattcaccagtgcaggagggacggcgaggagctaaagagaggaaaggaaaagtggaaagagagaaaaaggcgtgtggagagggtgcaacacgaggtggaaggagagagcccagcgctgggggtgggcgctggtgggcagcagggcaaagtcctgccagtcgaactcagcccaaagaccacagatggtcggcagtgaccgataccttccaccgggcttagctcactgctcatcttcctccactgcctctgcccatgttaggggggtctagtgggccacagtcagtgccacgtgaggagaagaaaaaggggtgaagcccaggaggctctctagtgggatagcccggccgatacgccaggcttggccatgcgaggtgagctgtcgcaggatgggctcggttacggccaggtgtgcaagcggacatgcgggtgggcgtgagggtgaacacacaggtggaagtgggctcaggctctgcctgcctccgtggcacctcaagtgagctgtgagaaacttctggaaaggaggtcttacctttcgagaggaatgctttccggaaccctccaggtctccgtccaggagcggcatggcgaaggagctcaggtcctagggtggacagagagcacgtggtcagtgacagtggccctcgggcccaggggctgcatggaactctacgtgggtgtcacctcccccttcctgagaccttatccttcaaatccaccatgaagaagggatgtggacgtgtttgctacacccagcccccaaagcccctgaccaccatgcacatccgcttccagaacgtgcagtcaaacttccaggagcagccatgacctcccaacaccccagggaaggaggaaagaagaaatggctgggactaaaggagtcaggaaggcaggcagaaagggtggagggaggagagcccgtctcaggctattctgctgatggacatgattttaccccacagcacggaacatgggtccagggacatgtgtctgcctaggaagatgatgggacagggatggggagggtgacactggggtggcggctgaggcaaaactattagcagagtctaatgacatcgtggccaaaacagagtctaaaatagatttggggaaagtagctcaccacacacttactgtgtctgaaacagccctgccccttcttcctcttgaatcttgcctccacaccaggcagaatcctgcccagtcatcctcaaatcgggcacagctgcatccctaacctttctttttcattttaaagtttttagttgtggtaaaatacacataacataaaatttgccatctcaaccattttaagtgtgcggtttggtggcatgaagcacattgacactgctgtgtagccgtcaccactgtcatctctagaacctttccatcttctcaaaccaaaacgctgttcccatcaaacactaactccccctccccctccccctagtgcttggcaaccaccctcctatctctttgaatctgaccactctaggtacctcatataagtagcatcaggcagtatttgtgactgtctgactccacttagcataatgtcttcaaggctcctccaggtggtagtgtgtgccacagttcccttccttttgaaggctgaataatattccattgtatgagtagaccacattccgcttacgcattcatcagttgatggacatttgggttgcttctaccttctgactattgtgaataacgctgctatgagtgttatggtatgaattgtgtctcccttcccaccaaaaaaaatctatatgttgaagtcctgccccccaggacctcagaatgtgactgtatttggagatagggtctttaagcaggcaattaatttaaaatgaggtcattaaggtgggccctagtccaatatgactggtgtccttcaaggaagagattaggacacaggcacctacaagacagagaccacacatagagacacagggagaagacagctaccaacccaaagagaggggccccagaaaaaccaaccctgctgatattttgatcttagacttctagcctccagaatcatgagaaaacatatttctgttgtttaagccaccccacttaatctgtagtgctttgctatggcagcctagcaaaccaatataataggtgtacgaatatctcttcaggaccctgctttcaattctttccagttatccccagaagtggaactgctggacatcaggtcatcctactgtcaattttttgaggagccactaaactgttttctgcagcagccaccccattttactttcccacccacagtacacagggtttcaatttctccacatcctcatcaacacttgttatctttggtctttgttttctgtgacagccatcttaagtgggcgtgagctggtatctcattgtggttttgatttgcatttcttggataattagtgatgttgaatatcttttcatctgcttatcggccacttgtctatcatctttggagaaatgtctattcaggccatttgtctgacttgtttggagaaatgtccattcaggccatttgtctatcttgtttggagaaatgtctattcaactcctttgcccattttttaattgggttgattgtggttgaattgtttatatattctggttattaaccccttatcagatacatgacttgcaaatattttcctccattctgtgggttgcctttttactctgctgtgtcctttgatgtacagaagtctttgatttatctaatttgccttttgttgcctgtgcttttggtgttgtattcaagaaatcactgccaaattcagtgtcatgaagcttttcccgtatgttttcttctaagagttttatattttatggttttagctcttatatttaggtctttgacctatgtaaatttttgtatatggtataaacgtaagggtgcaatttcattcttttacatgtagatagccagttttcccagcactatttgttgaaaagatggtcctttcccagttgaatagtcttggcatgactgtggaacgtcatttgactttatctctgagagtttatttctgggctctccattccattccattggtctatatgtctgtattttatggtagtattacactgttttgattattgtggccttatagtaagtttaaaattgggaaatgtgagacctccaactttgttcttctttttttcaagactattttccctatttagggtcccttaagattccacatgaattttaggatagactaattgttctgtttttggaaaaaaatgccactgggattttgatagggattgcactgaatctatagaccactttgggtagtcctgacctcttaacaatatcgcctcccaatccataaacataggatgtgttttcatttatttgcgtgtcttctttcatttccacctttcatttccttctgtagtgttctgtgcacttaacctttctttaacccattcccttctctccacgtccttgccctgggggtccaggcctacacccactctcacccagttccctcttgggccacctaattattgtccaaattgttcagccttccctgtttggatctgtgctccaagtctctgcttaaagagcaacccctgaaagggtgagcctcatcacgtcagccccctgctaaggccccagccactcgtaccgtcacctcagcaatggcttccaggcctggctgactgagacacgccagtgagatctcagatgtgcagattccagactcagcctttctggtggtgtttatctccaaagttctcagccctggctgcacactgacatcacctggggagcatgggtagagtgcactggcctgcggtacagcgagggcatttggaaattccaccacagaccagatggagagctgcgtgcctcccaaggaggagtctcaggagtctcagacacagtcaggagctcccagccggccctgcaggctgcaacccaagccccatagatgaactgacctccgcagccttatttctgatgttctctgttccggtctcctcctttcagcaacagcccaggcagagggtttgtcattttccaaacacagctatgcatccatggacatcccacctggaatgctgtcttaactcctcagacacttctgttcatggctaccatccacccctcctgtgaactgctctcattttgcttcagccactcagggacagctccagggtcccatccccagcccccagcatgaagcccggcccatagcaatgcaggaatcaccctggtgccattcaccaaacaccccaagccctttccttcctctgagctctctttccttcctcttgctcttcctgctccgtgtccccaaatcctggctcacagagtaaactcctatgtgtcctgcaaagcccaagtcaaacacactctctggctgagagtcaccctcagacagaattaattatctcttattaattatcctagactgtgtcccacagtactttagatacacctttattaccagactgataatcccgtattatactcatctatcagtttatttctctaactagactttgaatccatccctggcaagaggaaagctacccacctctctattcttggcctcatactgtacccggcaggcagcaggttccagatgtgtttgaattaactccccgaccaagcaccctcttgcgcctgcagcaagcatggggccgcagagtctgtgccgctgggccagtgaaccatcaggccacacgcagttgcaattcactaggaagtgacgagggaccagggtgggtctcttatcgcccattttaatgagcacattcctctctggtttcaaattctcattaccctctaacatttgttcagcaccagcagtttccacatgcagaagctttttcacaaatcctcacttgctcctcatgcaaccctaagcagcatcctgctctaacaactgaggccgaggaggttcaaagggactcacgtcaagatggtgtaaaagagctgagggccggatgtgaggcctgctgctagctcaggctgcccgtggaccccaggcggctgcccggagtggtggaggcaggtcccacgcaggtgtctcgggctggagtgagtatgaaagcatcaagtcaagcccaacatcgtggcctgctgcgtggctgctggactcaggtgtgtgtgcctgcctggtcatgcagcccaacagggaagtcccctggcacagatggcaggctttgctggaaggctccccacccccaatcccacctcccagcaagtcccagtattctaatcttggctctcatctccagagctcaccaggaaacatcacgcatcttggggccggtgtgggaaaatctctaactgcaactatggcaactagagtcttggcttgtagaatacttaggacctggtgtctcgggtgacatgccagaaggcccaggctcctggatgtgccccattcccgtgatttctaaatttaaaactcctgccagagctttgggccttccccaccactggtctctactcccagtccagtccctcacttcctcttcccgtctgccggccactcaggccctcacaggactgggaggacatttagggggcaacgctgaggcaccaagagatgctgaagccctgatttccgccaagagacagctttagcactctgattttcatccgctgcacaaaatgtaagtcagaccttgaccacatgtgttggagataaaaaggtgaattttcaggatttggactgataaagtcacctgtcagaaaagcatcaggaccaaagagaaaagccctaaatctgagagaattcctgagatgtaagctgaccttaaaagcaactcattcatccatctcgctgccttagaaatccaggcaaaagccaaaagtctatcacaaaaaaagtgaagtattaacgacagagccaacattaatctgacattagtatgtccttctgaaatctcccaactgttgcctcatttggtccttacagcaacccacacaagtaggaaagacaagtggtatcatccccgactatagatgaagatactgagggtcagagaggttaagtcatttgcccaatgccagagaatcagacagtagcaagcatgtcctgtaaccaggtccacctgctcctagctcagaactctttctatgaaactttaccacctccttggagtggttcagttccagtaatagaaaaacaatttggtatcagaggctataaaaagagagcttttcttcctaaaacaagtatccttggcacagtgtgacctcaggggaaggaaggaaggatacataaggatttgtatagtcctgtgattcattccccaggcaacttaccatactaactttctcttcaagttcttcttaactaaaagtaactcaagctggtgttgcaaggaacaggaaagtctaaaaaatcccaccaccaaatgcaatcacttcacattcttgcactatccacatttggagtcacatacagctcctcctgcccccggcccgctacttatcccaatatttccccataggataatagactttctaatgtttgcaatcaactaatttgtgtattcttgaaggatgggggcagttttactcacatcttagccctgacagcaggtgctaagtgtatatcgatcagatgcagttccgaccttccagcgtttctgatgttttgtcttacagagctcctttgttgatgcagctgggataccccagaaagaagacagacaagagtgcaaatacaggacaaatagaaaggctgccagtagcaggggcccacgatggcccccacctcagggcaaactcgaggtttacaatatcagggtcacgatacaacattcctgtttgattccaaccgaggaagcaacacatcgagaatgatttgcattctccgctcctgctgagcggaccccagcacagagagcaccatctggagctgctgggccttgcgtccgccgaggccagggcccctcccggccatattcaagcccccgtgtccctcaggcccacaagaacacagcctgcagcagggagggagccgggggctgagccggagccccagctctgtgatctgcgatctggggaatcttggacatatccggacttcagtttttcatctgtcaaatgagagggttgaactagagaacctgtgaagatgccttgtagctcgcacgttctctgtttttacccactgaagcggacaacaataggcgagatcaggaacattgtaaaggactcccattagactcagaataagatgcatgttctcatctcctatcttcatcatcaaaataatttcctcctactctcaaacgaccaaagactctccactgctctcagagccacagggtgtttggacggagtctcggggcgtgcaccgccggggaaggaaggagcttcctctgccttcacaacgctatctaggtgagacggccaggacccagcagcatttctgcctttccatcttaacctgtgtcttgatacgcttcttaggttctaacccttaaggtttctcaactgattgttcagctccctcaatcctaagggcctgggctgtgggatccagcaccaggcgggttctatcagacgcccagtgaccccgggaaagctgcgtgtggcatctccagctacaggcccgaggcccgcggttcccacctggaccccgtcctgcccaccttgcctgccctcagtcactgcccggggagtggctcataggttctgaccacggctgagtggtgactgtggcctggatctcgccccaagtggtgacggccttggcaggcccctctgctgggaggcacgggggaggtgcctctggacaggccggccttgcgcaatccccaaaaccaccaaacgggcaattcttggtactgatgggcggcaggaggtgaccagagccaggtcaattggagcctttgaaaaacattcatgttatataaccactctcagaaaaataaggaacaaatattgaatcactggaaccaggcagcaggggagggccagtggccaaatccgggaaggcctaagctccactctcagagaagttccagagccatttactttccacagaggacaccgtagtttctcactacagcctaagcaacttcctgatgtcaaaagaaacatccaactgtttttcactcctatggccacccttcctccctggctccctcacctggtggtcctggttcccacaaccgcctcggggctccccttccccgccccccaaggccaaggaccctggcctggcagcctgagcctcccctggctttgaggaagtcccctgctccaccgtattcccagttcctcgtctggcccgaggccacccggggcttccctagctccatatcagcaccagacatgaaactctttttgctcaaaaccaagtagctgcagaatccctggcccggagtgcccaggagacctcgaccctccccgcagttctgcattcacgtcttatgtggagcacgccctttaaaatccaggaacctccactttccagtgtgtaaaaggaggccatcatccttcttatcacgggctggtgggaaacgagaccagaggacgtcatcaaaggcccttcccgcggtgtgagcccccgtggcactgggcatggcgagggccgctggccgagggcacactggggcctgatgatgaaggctgtggggagcaacaaaggcatcatcaccagggcagccaggcccctcatgcggctcccgcggaagccagggcagttgctcacactcaaccaaggcctgagatcgggtttcagaggcttctgcaaagacactggctgtcccccttataattagagagctgtctttatcccgttcccaaggtgaaagccaagatgattcatgacttgtgcacggcagttctaaagaggatcacagcatggccgctgccagagtctccggctctgtcctcgtgcaaagggcagccgagcctttccttgcccactccgggcagcctttacttgaccagagctccatggaagcttggagggaccccactggcctcctcacgttgtggtggaggatgctctgcaggggccaacagtgcctcttctgaccagctgggggtggccatcctgaccgtcctgacctcaggggcttgtgctgtgggattcctgagagccccttcctagttcagggccccagggcagcctcttacaggcagctgctcccaggccaggttgagtccagcctctgctcatcacacatgcttgtcttcttccagcctgtctgagatcccccagaaggagggagagtggggggcaggggcagcacctagagggacaggttgggtggaggctacaggagtctgggtcagctcccagttcatgaggaaggaggcaagtacctgggaggccccgggacatgcaggttggggggcgcatttgcatggtctgtgcagccgtctcctcgaggaccagcagcaggcagcctcccagctcccttccaagggtgtggcctgggctgcaggttgccgcctccatccggagtagctgcggtcttcacaggtggcactgcgggccccagccagggggcaggggaggggatgttatgggacagggagcgctgggctccactgaccacatcccatcgtggagtcagtaacggttaatttgatgtgtcagcctggcgaggccatagcacccactgattcaatcaaataccaagcaggtggctgccgtgggcgtatttgcagacgtggatgacatctacagtcagtgacttgaagtgaagcagatcatgctgaatgatgtgggtgggcctcccccaatccgcagcaggcctgaagagggaaaacagagggttctggaaggggaaattctgcttcatgattgcagcatcgactgcctgagcttctagtccgtctgcccagtggattcgggactttccagttccgaccaacgcatgagtcaattctttcaaacaaatctcatatatatatatatatatatatatatatatatatatatatatatcacgataatatgtatatgtaatcatgttatatacattatatagagttaatatattatgtgattatatctcaatatacatattaagaaaaatatgtatattaaggagatataatcacataatatattaacttaatatattttcttagtatacatatattaagaaaaataggagatctatatgcttggatctctagtcttggttctccttctctgcagacccctcctaacacagagccctaggccccctcacccgagctggtggggacagacatggggagagtccagggtaaaagcaggccgctgtttggaagctctcagccttcgctgcatagacggatgggtctgctcagtcatcgggtgggctctccgcccacactgtggctctctgtccacactatggaaccctcactttgcccagggcccagtgagacacccacaggccccagctggacgagaggacaaagacggatgtgaagggccgttgtcctggcagtgcttagagaacaacaggaaatggccaaatgtcctcctttgactgtcagggaacattcacagtacgtgaagggcaatcacaggtttagaaaagcaccacgatcacctcctagcctcgtctctgagccttggcagcagagtggggcaatcctcttgccttcgcacgctgggtaacagtcgtgcaagtgtctgtcatggcatcttgtcaccctgtcctgtcactgagggcctgtctcctgccacacccagttggagctcggcaaggaccgcgtctttttcacccctgagtcaccggctcctcccagggctggattccatgagcctctgtccttccccttcgcagagctgacacggggagagtggtcataagctggggcgtaaatgactgaggacggcccgggggccagtaaacaccaagacctcgggataagggaatgacatcctgatgcgccacctccagcccctgtacggagggaacagcccttcatttctaggactgtcttcagctctgacattatgattctaccaagacagggtgtgaaaaggccagctctggggttctggggaggttttattggctcgcaaataaaatgccaaaccaccagccaataccagcatagagccctccgtgggcactaccgactcaagggaaaggccccgaggccccacacccggcccggccagccagctgcagacacaccctccagtcatcggccacccagacttcagagaggaaaaaaccagccacgaggtgaaagtgagatggccccggcctgacctctgctgcagaggcccaaatggccctggtcagatctgacgcttcccccacagtcagcttcttgccaccccccccaccccccaccgccgcctggtgctccccaccgggtacacacccagcggttttggttagtgcttgaagacaaactgcaggagggacaccatgaactacaataaaattgggcaccctggggacatttttgtaaggtcaccgagttgctggctggctctgagacacaccctcctctacgtagaggaccttgtgtgagagaggacacctctgaacgagggctcagagacctcatttctgctcccaaacagctacccaagatgtggctttgggctttggcccagagctgaggcctgcaaaggctgccacctcagtgcttccagaatctcaactgtccatatttacagagccatacatcaaaagattcttccccaacactttctacgggtacccaaggactccttctactccatcttgtttcacccacctgctctgtgccaggcacattatagatcaaaaggtacagggagttcagaggaaggaggaaataccatggacttaaaaagcaagccagggcttcccaagccaagcatagtgaatagaggagctttcatttgtctcctcacttccatcccggggtgagccggccactcccgcagcatctggccacggctcttcacactgacagtcccaacttgtcagtggattatgaaatcaatttagtggattgcacaaccaccaaaaactgaattacaataagaatgtatctcatggttgcatgaagcctgtgtctcaatgattcacacacacatagaataaaatgtactttgtttgtttgtttgttttttcccctgagacagagtcttgctctgtcatccaggctggaatgcaatggcacaatctcggctcactgcaacctccgcctcctgggttcaagtgattctcctgcctcagcctctgagtagctgagattacaggcgcccgccaccacgcctggctaatttttgtatatttagtagagatggggtttcaccatgttggccaggctggtctcaaactcctgacctcatgatccacctactttggcctcccaaagtgttgtgattagaggtgtgagctaccgtgtccggcctgtttttttgtttgttcgttttttgttttttgagatggagtctcactctgtcgcccaggctggagtgtagtagcgcaatcttggctcacttcaacctccgcctcccgggttcaagcgattctcatgcctcagtctcccaagtagctgggattacaggtgtgagccaccacgcccggctaatttttctatttttagtagagatggcgttttcccatgttgtccaggctggtcttgaactcctgggctcaagggatatacctgccttggcctcccagagtgttgagattacaggcatgagccgctgtacccagcctgaataaaatgtacttcctattgtgttgtgggtgaaaaagtctgaaaaattctgcattagataagctttgaaatcatgcaggtagatttcagggaacagagaagagctgaccttctgtccccgaggtgtcaccagaagtgtggagcaaggggtaccatctgtcctcctctcctggctgaagccctctgacccctctccgtactttatgcccagaaatacacatggagttaagaacacagaacatcacatctctttattaccacaagggtgtggtgattccctccctcctcacctctcaccaccacccccatctgctcctcccctggccctttgacatgcagggtagcttggcctcatccccaggccaccgctagacccagaacagcaattacacctttggggacaaccaccagccccagccccctgccgagcggtgcctgtcagcttctgttcccaactggcccgggcctgctgcgggtgccctcacctctagcgcctaaacccagagaactgggcagtcacagggtgttaggatggaaatggcctcagaaattctccaaggcccttctgttacaggtggggtaacagatgtccagagattcaagcaagttgctcagagccacatggtagagccgtgactcagccagaaccaaatcctggtcttgcaacttctaaccaaggtcccttttgatcatgtcatgctcttatagctgcttctgactttctagcttgtgtttccactacataagctggtaacagtaactcttacaggattgcaacgggctggccatccctcgcacgggcctggctatactgggcacatagcaaatgttctaattctatgaagccacttgggttctgcgggcacctttgcatcttgtctccagcgacagcacaaagcccgtgctccaactccctttctggtgtcatttattgtacatgaatctgtgacttccccagagcccttcagtctgtgatcccagccacgcaggcggcagccgctccaggaacttcccaggaaccatggaacctgtcgtgtcctccagactgacgggcgcggacactctgcatggaggggctccagatgccaccggccagcatctagcatctagccagcagcgatgcataaagaccagccaggtcaggagaaggtgtctgctactccccattccaggccacaccgccagggccacgctgcaggcagctaccagataggacatgaaggtgcctgggaggtatgccgccccctccagaacctcacaccggccaaaatccctcacgggtgggctaacaacactcacaacaaccacactgctagctcttttaaaattttactttttagtctttttataagtttaattcttgtttaaaaagataaattgaacctctaccccctcagtgaggcaggcctggatctagatttctgcctaaccagctgtgtcatttgaaagtcgcctcacgggccgggtgcggtggctcatgcctgtaatcccagcactttgggaggccgaggtgggcggatcatgaggtcaggagatcgagaccatcctggctaacatggtgaaaccctgtctctactaaaaaatacaaaaaattagccaggtgtggtggcgggcacctgtagtccaagctactcgggaggctgaggcaggagaatggcgtgaacccgggaggcggagcttgcagtgagctgagatcacgccactgcactccagcctgggcgacagagcgagactctgtctcaaaaaaaaaaaaaaaaagaaagtcgcctcccatctctggtcgtcagtttcctcctctgagacaggaggtgtctagactcaacccctccagctcctccaaggccttcccaaaacaaattctgttccaggccatcccacctcccagcaccgcaatgacactcctccttcgaacacatccaggtgggccccagggccacgctggtcactgccacctggtgggtacagcctgtgttcaggccccaaggcatgagcagttccaggacagaggcaggacaaccaccaaaggatgtgatggcagccagggcttgggtgagggagggagggaagggcaggtggtgcacaggggatttctagggcggtggaaccgctctgcatgagagtgtaatagtggacacacaacatcacacacacgacatcacacatttgtcaaaacccacagaatgtacaccaccaagagtgagccctaatgtcagctatggacttcggttaacaataaggtatcaacagaagctcaatggtaacagaggtgccacagtaatgccagacgcagacaacaggggagattggcatgggggctgcagggtcagggaggggcagatgggcaccctctgaactttccgcttcaggttctgtaaacctaaaactgctcacaagtaaaatccactaaatttttaaaaagcaatagcagcaaatggccagagatggcctcaatttcatctgccaaacaactgcccatcacgccaggcctggaccacccacccagctcctcagagatgctggaggtcataggttccccaggaaatgggaactggagaggtcaattcttcctgtatccacggctccaggtccttctagaacacagagaaaggtgcatgccatgctcccaggctcagggtcagaagattagtgggatccagtctgaggctcagcgctcagaccaagaagataaatgagaccagagacactcagagattaaataccttgctggggctgggcagcaaggaagctgggagaagggtctgagaacccaggtccccatctctcaggcccaggcccttggcccccaggctggggcaatgaggaccaagtacagagggctccagatggaggccagggaccagctgcaggcaccaggcagcctcagaatgtctggagctgggggacccctcacagggctcgctgggcagctggttcatcggggagactacgtggtgcagaaaagcttgagtttcttggttggggactcaaggctgcaaaccacggcgctaatgaacctaaacaagggaatttgctaggttttcttatttttggtgttttgttgccaacaaactcattctgttctagaggggcttgttatataaggaggagagggaagaaaactgctgagatgtgaggccaaagtcaccagaggaggagagacttccagatcagctgctgcgccagctgggagtcaggtacaaaaaacagggggttgtttgcgtctttgttttttcaaacaagaaaaagcaaaaagcctgcatcgcatgtcctaggaatggggttaaaagtcgtcgtctcttgggacagagtttggacgcctctgtgagcagggcctggtcactgaggtgtccctgactcgtgtcctgtgtgcaggatggagtctccatgcagcccaagcctctctgcagggcctggtggctgctgagaggcagaaggaaacccctccctgagtgtggcctctgcgtgtgtcacctacacctgtcagaagggtttgggatctttctttctcatggagaaagtgcagaagattctgggtcaggccctgtgggacatccctagagccagaggaccgtcccctttgtgtagtttgtccctggcattgccagtgcttctggtttcactcttggttctcagcagtggatcctagaagccccctggatcatgaacttctgccctttgcactcatgaggcccagggacacctccctctgcttgtgcaacacgaggctgccacgtctcaggtcttcgtgcccaaagtgagtggactctgaccttccaggatggccgagggtgccaacgtttcccaaagatctgttttcagactaatctgggagacagcctttggagaggtccgtgaagaagaaaggggaactccacaggtggaggggaaaccgaagctacctgagggatactccccacggcccacctggccccctcttagtctgcactgccctattttcatggcttaaagggcagaatcaaaagatcacagtaggtcagttctccccaggctatctgtgtgcccagcctagagaaaggaatgaacattgaacagggacctgctggctgaaaccttcagtggttgcttcctgcctgcagaaggtgtcggactctgcctggcattcagtgcaccccaggacacagccctggcctcagcctctcctttctcccacaccgctcttctgcagcagccacctgacctacacgctgtcctgggacaccctctactcctctttaatccccccgtgccagcattcctcaaaaaagggggctcaggactcccacaaggttaaagttatcatagacatatatatgatatatatataagcaatatgatatatatatatatttttttttttttgagacagggtctcgctctgttgctcaggctggagcgcagtggtgtgatctcagctcactgcaaccttcacctcctgggttcaagtgattctcctgcctcagcctccagagtagctgggattacaggtatgtaccaccatgcccagctaatttttgtatttttagtagagatggggtttcaccatgttggccaggttggtctcgaactcctgacctcaagggatctgcctgcctcagccttccaaagttctgggattatggatgtgagccactgtgcctgacctagataagtgattttaaaggtaatagctggggagccggaattccttgattctgatgatttgcgattaaaacactttgtataggaatttaaggcgatctttatcatattggggttcaaggacagccatcagtaagaaattttctcccttcaaagggaggcttgttacaaaatttgagcagcagtggctcacaccattccttcctacctcgagtgtcctgaccctttttctctcacccatttatatcctactcattcttcaaaaactagctgattcccacaaatttacaccaacttttctgagcagtccagttgaaaatgatatcctactccattgcattttaatgcctaagaatttaaaatcagtcacgtattacccatttgctatttacatataaattgtatctctgtatagattgtgaggactctgagagcaacggctatattatccagcttgtttttttttttttaagaagtaaattcatccagcttggccaacatggtgaaatcccatctctactaaatatacaaaaattagctgggcatggtggtgggcgcctatagtcccagcaactcaggaggctgaggcaggagaatcatttgaacctgggaggcagaggttgcagtgagttgagatcgcgccactgcactccagactgggcagcagtgcgagactatgtctcaaaaaaaaaaaaaaaaaaagtaaattaataggattcaaaagtcaaaacataacaacctgtaattgaagagtcatacccttggcccagccatgccatgtccccagaggaaccacttttagttgcgtagacagctagggttgctttatgcaaatgcaaatatgaaggctgttccctgtctcttatctgttttgctcgtgtcttactgcctcgcctatctgggagatctttcaatatcagcacgtagggatttgggggtatccacgtcatatgcttttgtctggaatgctctagtttaaccagtcccctgtaggtgacgcaggctgctttcaatctttggcaattacagagaattaatacaataaaaacttggtccatacttcatatttccagcataagttcccagaagtgtggctgctgcttgcaggtcagtgcatttattatttctgccacgtgcagacagggggaagggccccttataaaaccaacagatctcgtgagaactcactatcacagaacagcatgggggaaaccacccccatgattgaattacctccacctgctctctcccttgacatgtgggaattacaattcaagaggagatttgggtggggacacggatgtcaccacgagccctcctcagcattggacagtttgctctcctaactatgatgtaggagagtctatttcccgcactgactcaccaacaggctattttgttcaacacctggacttttgctgggttggtaagacgtggcatctgtgtaacccaaattgacatttgttttctttattccgtggtgttccatcgcggcacagagtcggcacttgaggtggcatcctgtggaactgcttctcaaactgcacgtaggacataggtcataaaatccactcaggacacacaggttttgttgcggctgctgttcatagaacaaaaccagagctccaggagttttctgggatgtctatatccaataggtcatgatgtgaagttcctcgccgtggctcactgtcaaagtctgaaagccgctgcggaagtggctcaacgcatggcaggcacaggggctccatggggtaagtagcccacaggacagccactaggaatgtggtccctccctgcatacatgtgctgtctcctgttgagtgggcgaatctgttcctccatccttgagttggggcagctgtgctcaacagaaatgcagcagaaaccacaccacctgacttctgggttaggtgagaaggaacctcgcagttcctcctggatctcttgtaatgtctgccgcgggtgaaaccagctgccacgttaggaatctgcaccaagaccaccatgttatgaggaagctcaagccagccacgtggagaggctgcacggatggagaaacagctgcacggccagccccagggagtgatgtgagagtgaaggagcctctaggatgtgccaggctcagctgccacctgacttttcaaataggaggaacccccagtgagaactcagctgagccagatgactcctaaatccatgaaagatgatttcaaatcatatttttaagttttggggtggtttgttatgtagcaataggtgatcttgtgactatgtaaccctgggaaagttacttcatttctctgttttttaatctaaaaactgggaatcatgggagttcctactggaaaatgagttaacatatagaagtatagaaccacatatgagttaacaaagacatggctgtgatgcctgggactcatttggaaaacatgagttatcactttaaaatgcttcactgagtttagaggcaatatactatgattactgaacccagggacactacagattcttccttctcagagctttgatgagaggaaagaggcagattccaccttaccttcaggtttgccaagatccttccccaacgtacaagtgaaagggagctcaggaaggcagaatgaagggacacatcaaatccttggtgacaaagtttaggacaggctgggcacagtggctcacgcctatagtccaagcattttgggaggccaaggcaggctgatcacctgaggtcaggagttctagaccagcctggccaaacctgtctctactaaaaatacaaaaattagctgggcgtggtggtggccgcctgtagtcccagctactcaggaggctgaagcaggagaatcgcttgaacccgggaagcggaggttgcagtgagccaggatcccaccactgcaccccagcttgggcgacagagcgagactccgtctcaacaactatgacaacaacaaacagtttgggacagagaaaaatccctgtaaacttcaagccttttggggtgctcttgggtgaactcctaaattgctcaagggctaacttcctcatttattattaaaagaaaaaagaaaaaggcagaggccagtggtgaaggctggcgatttctggtctagggtgagagataacagaaagtaacaatggaggctctcgcagtgctcgcaggcactcaaggaacggaaaggaaattgcacatttcacccgtgactgcataggcaaacgagaacagcaagtctctgctttcagctggaatgttatcaacttcggtcacgctgattatctcaggctgatcaggaaggctggtaccaggagtgagtgactaaatgaagaaattactaattaacaaatgcttgggtggacaatccttcaaaatttaggatcaatgggaggagacagaaggagtcttgggaggatttttaaaatatgccagagctggctgggtacagtggctcacacctgtaacctgaggactttgaggtggagacgggcagaccacctgagctcaggagctcaagaccagcctgggcaacatggcaaaaccctgtctctactaacactataaaaagttagctgggcgtgttggtgcatgctgtagtcccagctactcaggaggctgagccacgagaatcgcttgaacctgggagatggaggttgaagtgagccaagatcgcaccattgcactccagcctggggaaaaaaaaaagccaggcctcctaatgtactcatttaaacatcacttgtgtccacctgggttcagaattgcgctggacatgggatacacaaaggtaagacatggacccaccctcaagtctgaaggtggaggtggggaagggcagaggctgtaaagggtcagagggaccttgtggagtggtggaaatgttccagatcacactgtggcggtggtcacatgactgtgcacacttacgacaacccatctaattgtatactgtcagtcaaagggcattatatgtaaatcacacctcaataaagctgaccaaaaagtggccagtcagccaccagcagacccatgggataggggaagaaaaacaagcaatctacagaacgtgggaaaatgcctatattaagaatcctggaatactccatgtgctttttcatgcagcgggagtggaattttcaggaagcagctgtgctgtgggtgacggtcatactttattctctaaaactctccagtttcaattggcctcttggtgccaaagcaccatggcgtgttacacctatcagatcgggcacactgccccttcttcccaacctacgagctgaaatggccagcactgcgccttccagaacccagcgtagatgcacagctgccacggaggtaggaagaatgattcgtttgccaccaaaagcccagtttctccaacaggtaagtcccagcagggtgcgatgtcccaaacctacacaaccgtttccactgcctattcccgggcccctcacttgggtcaaggcagcatttcagaggaagccaggagcgagaactcgtgcatccgaacccttctctgacttggcgggttattggattagctactctcagaagacccaaaaggcataggggagagaagagataaatctggatgcggtggagacaacggccaaacagaaaaaccgcttggagaataaaagtcgggggaagcctgtagtggggacgctagactcaagggaaggctctggaggaaggaagaggctaaaggcatagtttcgtaacccctccctacaaactaccccctttccctctgcccaagtgagcacagggaccgccccgcagcaagacgacggcagatatttaaaatgtgaggaaccccggccacagcgggcggggctccccacccatcacctagtgtcctcactcactgcactccagactttgtcaaagtggtggcagctgagtccagcaccagagattggtgatgctcgggttgatttcattgtcaagtgcatctggcaggactctagtttgtcgacagtattccagacaaggtgtagctggctgaaccgcagtgcctcggcatttgggaccattgaaaaatactctggattctttttttttcttttgcaattgcacaaggatttacttatctctcttcatgggtgaaactgatttggggggaaactgctagactcaatgaccagttggactgtaggcaagaaggcccatgattttgttcctcagataaaagagcagcagggaaacaggaggcctctctcctgcaaagctggtccaaagtgcacacaaggcatggctgagcgcctggtgatgcacagtcagcagacgggcgagacccaggaacgtgtactgtaacaagagagtctagtgcaggttgttgggggggcttgaggctatccgctgacatcttttctccccagtcaggagacagtaggggagatggttctcatagatcaagtcgggctttgagaaggaaggtgaacaggagaaaaaaaaaaatagaggcctcagaaagcccctccctcccaagtctctcctcacaggcgaaccacgacagatggctgcgcggcctgagggccggcctccaggcagccagggaggagcagctgcaagtcctgcagtctgtgagacccccgaagggtctgggccagcatccaaggctaaagccttggctatcctaacgccgcagtggggcacttaaagctcctcacgcccaagcccaggcctggtgggagcacggttctctcccgcgctccccctcctccccactccacggccacccttccttccaatcgtccccctggagttcgtgttggaagatgccagtgagcacgtctcagggctctacgccttgcacggatgagtatggggtgactcagagggaaggggtggtggcagatgcctgcagctggctcccagccaggtttggccatcctgcgtaaatgcctgccttgggtcttggcctaatactaagggcaaatcccaagaggggtgagtgggcttctggaatctgagcaattctgctttcaaaacaggtgaatccctaggccagcccggccccttcccacacacccctaccccgagacgggtgcagaatcagcagcggggatcatccagagactctcgcagtccacggcaggtgtcggagtgggcctcattccagagttgtggtggccgctccacctggcgagcttcgaggggactccggcaggcgctcgctgtggggtcctcccaccagtcttctcagcacaggaacggtgccttcacattggtcttccggggcttaaaagcatatcattcctgcttgctcttcagatgcaaactccccctccaaggatacctccaggttccctgccagctcacttgactcacatggcaatggtcaccgggctgcctgagcccaaatcaagcaccgtttattagggggaagctccgttatccagaaagctcatctttgaagagctacccatttcctgccaaagttgtggcgggaaggccttaggtactagaaaaccttggggaatggcaattaaaggattatcattcttacttatttgtttggataagcagcaatcacccttcggatgcttattggtgagaatatttctaaaagtgtcctgcacatttccctgctttgatgaatggaacggcagggcaggatttaactgtctgatggctacggttttgggaaagtgccagaacctccacgtcagccaccccagagccacaggcagggtatgagccacagcaatgggccccaagaaagagccccacacccaccatggtccacggaagacgctgcttactggccccgggttacctggagtcatgtgcattctccttacatcaagtgaagataatattttgtttccttcccactttttctctaacacaagccaccccagttctcccttctgacaacaggcaagtggaccctagtagaccttccagaaaagccttagagagcacccccaaatgctcacatttgtcagctgtaattccaccctcagttaaaacctgattctcaatgtgacttggccaacgcagcttgcaaagcaagaacgtcttcatctaaggttgaaaacatcagttgtttgggttgtgagaaaagaaaagcccacaaggtttccgaggcttggtgctgtttctcactgtcctcagctcctgattctgcagctggttctctctccaagcactagcaaaaccctgccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacctaagtctggctttgcttttcttctgctctctccctacctcccctgggtcagagcacagggggagaggtgcacggggcaccgagaaggaaatttacgatcgaggaagaccatacggacatgcccagtgaccttcagaaggtggcagtagcagaaccaccatgggaccccaggtggcggagagggcagaccctgtccatgtgtgacaggtggggcagaaccaccagctaggacaggtgggattggaagaacaaaggaacgacagggaccctgcagaacccacagccctctcgcctcagtcgcctgatgaatagtcaaagtgctaagacctggagaattccatcaaaaactcagttgctcccactgctttggaaggtgttctgctgggctctgccaggacaggccacggctgacggctcacctgaagagagggacctgctatttatgaagcatctattatgtgctggcagctgccccttactcctgcaaggcaggtactgtctccattcttagaagaaaaatcaggctcaggagaaggaaataatttgcccgtggtagccagggggtgaacagcagaatgctctgccaggcccaggccacgaggcctctggggtgaagaaggaacaccccccagttcttgggcatcaggtgcttgtgattccattctatttttctcttaactcataattcagtaattgaggctagagctttgccatctcacattaaacccttttaggactccagggccttaactcacacttgtgggaaggatgtttggttcaggccaatgaaaggcttggctggaaagcccacaaagctgacaggtgtgcagggctgatgacaggtcagtgcactgtcccactggtgccgggctgctgaggcttcaggacaagcctgcccactaggaagggagggaaggtattgagccttgaacgagccacttacctgtaggtccaacctaggtttcctgctacgtcaccagcccccaacaagagctaaaggtaggttttcactaccggacattcaccatgtggctcataagtacagttggagggacaactttggagttgtccgagggcccgagtttgagctctagtttgccatttactggttatgcaatctcagtaaattattcaaattcatggagcctcaatttccttgtgtaaaagggaaatctcccaggatcatcatgaaaattataataattaacattcatgaaactgccacacatggtgccagatgcctaataatcaatcaatcaatatttaccaaaatatgcaatacagacagctaacagcagtgtaagaggtaacgtagagacagatccttctaagaaattaagacccctacctgactgcattaggagtcatcaattgaatctaccgacaagaattgaacacaatttaatacaaagtaatgcataaaacaaaagtacaggcattcaccttcattaggcctgggctgagtctgagaggaggtaagggggtttgttagaagggggtgtggtgagactggtctgtggggcatctctggggaggagagacctgaatacttttaaaggaagaaaaagatctatagtttgaaagagcgctgtgaaggagttggataaatccaagatggattccattagttaacagctgagctgaaagaagaacacaaaattagaagccgcagttccagggacccctggttatccaacactatgaagtgaggaggtcaagaccaagcatcttcctcttgttggaaaggccaatgcctgggacacaggactcaagagtttgttttgctaaagtgctgatgtttaatttcaccctgggacaggacctgaagagaagccagagctgggtaacaaacacgaagaccaggcttagggactgggtccacccaacctcagtccaccagcctccgttcccctccaccacccaccccactcccagcttcaaaagaacaggctggaccgcaggacacctggcttctctttccagctgaatccctttgtgactttaggcaaagaagattaaatattttagattttcaattatgttcactgaatttaaccactgaaccctcagtttcctcattataagcgtgtgtctctcaaggcctactactgctgggctgaaaaaaaaaaaaccacacacacacacctgagatttatctagtccttggaagtttccatgcaagttggggaagcagctggaaggtgagaaacccccagacctaagaggcccacagtgaggcccctcgggtgagtcggagcctgcccagggtgtgtggagccccagggtgccggctcactctgactgcgtcccagggagcttccccctctcacttactctcaactattcacacctagcagtccccgaattctcgatttatgttttggggcctcctgcctgcatcctggttgtatccctaggcctctccccatcttccaacacctacaatccgtaacgccatcaacgctggattccctgctagcccagccttcttcaattgtttactatcacctttgctctccacctgggttgaaaattcagatgcacagaatcaagcctccccccaggaggggggtcaagcgacccccaggtcactcctaatcaccagcactcaaggaccccgaatcacagacttgaagcagacagacagcctctggcttacggaaggcgattgtaaggaaaaaaaaaaaaaaggacatggcttactcaaagtgccatgcatcaatgtcacagaagggcgacaagagggatgctgggtgagctccgaatctagtactttccagcctgcagctctacttgttgctgcaaattcactcaacagtcagggcttctggttctcagcctccccctcctcctctccaccagacagcggtgacagcccacggttcagccactgaggaggccatctacgatcttctcttccttcccttcctctctcccccactcccctcccatctgctgcttctttggattccccacaacttcagcaagcaagtaagcgttgggctccacgctccgcaggaggccaagatacccttcaatgtatatggggtcaagagagtccccagaaaactgtgggccatccccaaagcccccacatcatccccagtcttttctgtttgggccaaaggtaataagtgatgactcaggaagggcaaggccaggcaaagaatgacaacttcgctaagatttcagctccagtaagggaagttcaagccagggtgggaaggcagggaggagaccctgtacccaggacccagtgtgtgaggcagctctgctcagcctggcaggggaggagagacagactcagagaggaatggagctgaacacgcccacacacataccaccttcactagtgatgctctttaaatcaccaagaaaaagttatgtaaggagaaaacatacagcttccgtggagagaaggaacattttgctcagccttggggtatctgatttaataagaggctcttggagaacaaagccacaattcagcatcagtcttacacaccaaggagacaaagcatcgtgagggggaaaaccgcacacccagggacgcacaatcactatgcatttagaaagccagctcccgcaggtctgcttactcagccccaaggggtcctggaggtcttctcttccagatgctaataagcagtgcaggcttgtaagctgctggatggcaggatgcgagtgacggggacgggcggcactcccagctctgacaaatcctgctgcctcactcgaaaggtccatcagagaaggggtttcccagccccttcagcacaggcaatttctagggttcggctgtgctccgagctgctgccactgcatgtctgcaacagatggggaccggggctgggtgtgttcccagtccccaaggcagcgcaacaagcggctggcagacagcatgggctggcctaagacagcgcaggcaacggtcttggtggctggagctgctttgctgctcaaaatgcaggcagagctcgggcagattcccccattgacgggactgcagcaaactgtcattcccacctgtgtcaggcgctgctggggaggaaactccttaccacacagcaagccagcaggagggagggctggaccggagcttttaaaaagacaggcagcaggatggagggaggcaggagcagaggccgatgatgcagcagtggacagctctgggctccaggtcctctggccagcacaacccctgcactgttcccatctaacttcaggcaaaggcttcagaaatctgaactccctggggattcctgtccttggagcacaaagattgtgggggtttttttcccctctggccagaaggatgggtatggctttccaaaaggctctggcagtgaaatccccatttacactccattcccccaactccaaccagacagcctgcaaacatcatccaggagacaacatggtctctgcctatatcagccatgtctctgattttctgtattctgatgctttgacacctggggccttgctgatcctggagggactgccctcccagggctgggcaattcctggagatagtaagcaactcatctgtgagcttgcttttcctatgcaagccaacccacacagacccttcccctcctcacctcctcctgggggctctcacaccccaggccatcacccactacccaaatcaccccagggcaggtaccagacagctagggacagcccctgtacccacagtcccctaaaattattcacagaaaccacaataaagtctcttgcctgcatctcccccttgctccctctgcctcctgcccaaccccgtgcttccccacgtggcagtggtgtgcctagcctcctgcttccagggatctgtgagtatcatcagttccttccttcgtgacactcattcctgagtctgcatgtcttcctgtacctgattacaacaaatcccaggtgccctgaaaacaggctgtggggcagaaaatgaacttgaattgttaggagaaaatgagggtccccatttcagaaccccgccgtgtccctcattaaataaaacttgctcaggacttgaacttctcagcagtggaggaattgcttccaaagatattgagtgatctgttgctgcaggtattcaagaaaaggaggcttcttccacgagcctgtgactcaaaggctatgatttagtgggcaaatgtgttattcaggtaaggttgatggcaacacaaggtggaaaaagattaatgtggatgacgtattcaggaaggcttcctagaggggacagaagggcgttgcatggccatctactaaggcccacggacaaaaaggcggctgagtcagctgggactttggggggcctctgtaggggttggaagtccgtggctttcttaaagtcactttcagcccaggagggtaccaggcaatccagctgtccactcagagacctgacaaatcacaggcctggcgtgctgtggccagatagctctaagaactcacaagcctgagctctgcacttgcctacctgagcaggccattttaagcggaaactgttttttgttttttttttgtccgtagaatgagccatgtgttatgggatgttcctcaaggtccctttcagaccagagcattaatattctgtgtcaacaacccaggtccaagtcctggatcagtcatttctctgaacctcagttcttcctttgaaaaaccaagctgagtggaaacacttgctctgcacacctcccagggctgctgttgggatcatggatgaacacgcatcaggacagaaataagcatcatcctgggatgtgcgggattattctggaaccagagggcagtgctagcataaacctgaggtttagcagaaagctggcgccatttggcgaagatcgaagggccaaacctcctgcagcctgcagccagccccccgggcaccgatgcaagtggtcgaccagagatccggccaatctcaatattttctcctgctggttctggaactagccttgctgggtgagctgggcctgttttattttctgtgtgctttattccaaagcatacatacgagcctgaggaaaaaagcctaattggttttccttggaaaagctggaaatgtcagagaaatgggctccgtcgtctaaaggattcagaggtttgctacgcttggagaccagcgtttgagagtgacttatggggtgtgatgatgctgtagttctcacggcagcaattccacgtctcagggacccaggatcactcattagagattaaggaacataaacaactccactcctgcttgcaagctgcccaccgcaagcacggtcactgtcttcacctgcatttctcctcgcttccagaacctccactgcactccgcatgcaggtggctctgagctttccacctactctccctggagggcggagtcagctgtcttgaacaacagagcctagtagatcacagatacttagcaaagcctgaagaccattttggtgcatggggctggtgtcagaatcagaagtgaaaaggcaatgccttcctgaagcacatcccctcggactcacccgctctaattcatcctcctaaactctgtttttcaggcattactcttagcaccctcaccagacaaagcaataacaaaacagaaccagaaaaccttcactagctccatgccatctacagaacaaaccccacttcttcagcatgggctgccaggcccacaggagcctggcccacggtcatccttccacacccccaggcttcccaaggctgtcaggcctcatgacccttgggccccgcatgcaggcaccctcctgaccctagagcttggcatccctagaaagcctagccctgcccctaaagcccctccctggcacctgtaggttatcaccagggccctctcctggaactcatgttttgagtctattttaagtgctgagtattttacatatcctctctcaacctgcacaaaatactgtccattttatcgataaggaaattgaggcccagagaagtggagtcacaaaggttacagaacacacaagctgcaaatccaggattcgatcaaagtgatgttcccctccccagcctggctccgtacagcacatcctaacagggccactgtccctttattcatttttgtttatttttatcatctagtttttctgtggctcatgcttgtttattacttgcataattaagaataagaggaagatactcacacaccacaagttgagagtccccctttacaggtccagcctataacatctgaaataaacaaagtctgcagcaatacggaaaggatcaggtaccacctgagtgtgcagaaatgggatattgtcaagtatgttctgatagagccagacattggggccttatgatattacataacaagtcaaaacagtgacttcaaagaatgacaaatggcaaatgtgacaggaaaatctcaaatgatgcatggtactgcctgagctgtgtaagtggcctagaaaactagacatgcatgagcacacatgtgtaaaaggcgtgtctccagcccccaccccccaacccctgaataacagacctgggttagatttctcagcatcccagaaatctagcacaaatctttgccaaatcccatgccgccctcagcccttcacctaaaagtcaaatgctgcatgccaagctcacgtccctgcgatgaggcattgctatgcaggactacaccactgcaccccagaaccctgtgtccagagccaatctcggcaccaggccggcagggcagcttgcagagggagtatctgcaaaagggctgatggcaactgccctgggcagagacgctgaccaataaagcccatattctaccccccttttatgtgccaatgctgtccctgccctcactgtcctgcaagatctgtgcaggggaaagccagaggccagggcagctgaaagaagagggaaccccctgggctcaaggcccagcctcattgaccacacttttatttcacttgggagctggcagctggggattcggggcacggcatgccactggctggggccagcatttgagattgactgggcctggtgggatgtagacggtgtggcattttactttggaacctcattcctatgacagcttgaggccagtgccctgtactcatgaactctgtgcaatatgccaggtcctgtggttgcttctgaaatatcccaattgggaaccaatgtgccaaagagggctgctctgcgccgtgaacatccttgttgaaattcacagcagagggcttgtcaatcagctccctggcgaaatgagtggtgtgcagagtgagtcaggaggatggcacaggctgcagcccccttggataaagagacagagaatctggccggcccgcagcccacccagccccggtgacctggacgctattggtcttcatcctccacctccgaggacccagctgctgcatctgctgttagctagaccagtcctgccggtcctaacacctctgggtcctgctcggagtgcatctgccagagggcagcgctgagacttcctctgagctacaagaacaggttggacctgccgcctaaaatcgcctatagggatttggcaaaccctgctctaggatttccttttgttgtcataggccaccagtcccaaggctgtcagggggacacgcagcctcacccacctccagtcgctagagactgccaatatttaccaaagtaaccagatgtttgctgagtggctgtgctgagattagattagctgagaatagttcgcccccctgcccctccctgggtacctccatccaggtagaactaatagttctaaaactgcaggattgcaaagacatttggagtcattaagaccttgtgtcctgattttaatggagtctaaacaaaaacaaaccaacccccgcaaaggataacagtttctctatctttcaaggccatgttctgaccacctgaaggtcttgagatacttgggctactgcctggagccttacgggtgaaaaccggtcccctgagcctcaaatgtgggatggggccccagagccctctgtccaaagaagtgccgtgtgtactgagtgtgcatgcagctcctgcggtggctgacttgtgtttggagcatgtcacctgcccaatcagggacccacctctaccaaataagccagcaggtctataaacgctaagtcatatgtgatcaatcagtttaagtgacgtgcccaaggtcacatggctgtgtccttagagggccaaggctaagaccaggtgttcctgattttatgccagcacctgataaggaagagatatgcctatccactggaaaaccggctgagactttgtcccgtgaccccacagtgacttgtctaactccagtctgaacaagctcgatgtgtgcagggagcagaagtgagaggaggaaggactcgctattcacgccggcagctggaacctttttctaaaaaatggtgcatgccaaaaggagctgatgggcttagcataaattcaagagggacaggcttaagcatctgtcagagcttcactccttccaagaacttctctgacctcgctcctacccccatcacgattactcctccacacccactgccgtgggctcctttgacttccgtcattttgatgcttggggcccggcccctgtggcttctgcagggcacactctactcggaacaccgctccgtggcctggcccctgtggcttctgcagggcacactctactcggaacaccgctccgtggcctggcccctgtggcttctgcagggcacactctactcggaacaccgctccgtggcctggcccctgtggcttctgcagggcacactctactcggaacaccgctccgtggcctggcccctctggctactgcagggcacactctactctgaacaccgctccgtggtctccaacttcacgtctcccacagggtcaatgtccagtcaaggcaagagctcctcagacctgataagcaggagccactgtctggagatgagcgccaccttcaacagaaggaacttggcacttgggaagccccattttctttcctcttccattttttaaacaacaataagccgggcttctctcctaaccctgaggcccaccctgccctagcagctctcagtggcccatcaccactcccgctctctctctcggcaccccgtctcccagtcaatggatattcttaggaccccccccagccaggtacctgcctcatgctgcattgctgggacccaagaaaagtagaagagagagcctccaaccccacggacctcagtcccggccagaaggaaagctgtggagacagggaacaagcaggctgagagtccacacaacatcgtgtgtggcacagacagcagccaccatcatagaagtttccagaaggaaggggctactttggaagaaagtcttaaaaaataacttcatgaaaggagtaagactgaagctaagataagcaagatcaggtaaaaatcagaggcactgaagggtccttgcattttgtaaggccccagagcatcctcctcctttgttccctagacacactgtcaaggctctggaaggctctagaaggctgtggaaggctcatggcaactcgatctttcttttaagctgggaaccaggattgggcccaggcttggcacacacagaaggccaacaggctgtagcacaagcctggctagtctcaggcaggtgctccggggctgaatgtctgtgacctaaaacagcctcaatggcactgctgagcagaaggccccgggctgcccaggtggtagaaggccaagctgtcgtttagcatgcacaaggctccccaatttaattgaaatcaacataaaccacactgcacaaaaccattttttttctacaaattgccctctataacaatgcccctaagcaagtcctctctaagacacattggattcctcgtcctgagcacaccatgaaggagaaaaatgcctctactcaccctttgaaacggatgctctttttctacaggttcaaattccagctttgctttgccagtgctgggacgttggctaagtcatttagcctctctatgcctcagtttcctcatttgtaaagtggagttaataataattatgcccaccccacagggttactgtgaggattaaatccgtatgtatgtatgtacatgcacacacatacacacacgcgcacatatgcacatctgtaggctgagttttacggaggcgaacagggcctgagagctgctgggagccaaggatctgggaggcaccccagtgcgttccagtgccgcgtgactcaggtgtcagagaagcccatttaaagacctcaccccatgacaactgccactggggacagatacagagactctgaaccttaaggcaaggtaggaaatggcagaaagtaaataatagaatgttccagaaacagacacctgcagcctcctctgggtgggatgatgttctggccagggctggggccagagcacaactgccaccgccctaggaggcctcgagcccaggaacgaggtgggttcaggagggcagcaggccagggtcaagggcggggggtgactttactgtcagcaggccagggtcaagggcggggggtgactttactgtccccaaggcctcctttaatcaactgaccacgatgtacccagcgctgcctgggtgaaggcgctgtgggagtaaaaaggagcaaaaggcagatgcggccctgaagaccctctgagccagtcttgggacatgtctcagagcacgcggcggcccaggtccaggggctcccttggggctgggctgcacagctgagactgtgaaaagccaagggccaggaggcgaggggaaggctgagaggaacggtgagccggccccgctgcccaggcttgggcacctggggcagctggcctgtgagatggtgctgcttccagtggtggcaggtggacagcgtcttcccaagctctgacagacacgcttagtgcaatggccttggctgtgtggagccagggtcaggggtgcagacccatgtggacgccacctgcaccctgggtcaggtgacagggacctgcctccacacctccacgtcacactccctccctccccacaaaaggttgcccaatgaatccacaacacagaatgttcagccctgattcaaaaatgaaacaaacaagaaaacaacctccagcgactaatcagcctggggaagctgagtggccgccaagcccggctctatcacttgaaaatctagggctcctagaattcctcccagcgacctggttttcagaccccaccccaccccaccccacagcggaaaacgcaagctcaactgcagaacctgctccctgacccctggcttgtcacagcagcaggggccaggccacagccggactctgccaggcgtggcccctctcagcacagccgcctggggacactctctatgaagctcaggaagaacaggaaaaatgtgtatccagttttgttggctacagggattttgtatcaacatttttttttccaaaaattgaataaacactaaaacttaagctgaaacttcttaaatgttttaatgattttaaaagaaatatctcagaatgcattatactctgctgttatgggttaaagtgcttgcacccgcaaaaaagacattggagtcttcactcccagaacctcagaatgtgaccttatttggaaataggggctgttgaatttggccccatttgtgagtggtcacatgggccaggcaccgtggtgggtgcagacccctctcctaagtcagtccagggacaagagagtagatcccaaggagatggaacctcactcaccctctgcctaaccagtcctggcctactgggccatctgggggcctcatctctgattaaaatgtcaaactccacatcagaggctagggagagacgtgggaagagatgacaccctccatctgtttctggaaacttccacagcctgatcctatgatcctttaccagggctgggcccagggatgtggggcccagagtcattcctggtggatgggggctggaaaggaggtaaagtccacccctggctaaatcattcgtctacctggagagaaaattagaacctctggggagttttcaaaaactagatcccaattaagaactactgaatcaaaattgctggggctgagaactgggtgattgaaatattctgctaagtaagaaccactgatagcacccacccacctcactgtaaagacggggaaacaggcatagagagaaaatggtgtgtgggaggcccccagttattcttggtataacttatggaggcagaacccaaggaacctctgagaagggaactgtgaagtcggaaatctgagctttccctttaagaaggaatcagcttttgatttaaagtaaactgagaggcaattccttggacttcagggactcaagggcatgccgtaaatcgcccttggttcagaatattcataatattctatgacttggaaagcttcttagctggaagcttcgtaattggttcaggtcaaagatcccagttcagcttgtgttttgctcccctcggcttttccccacttcctgtcatcctgcctggttcctgacttccacattctaagaagatacagaagtgattggattatgctgcttgtgttaacatcaaggtttgtggaaggtagtgcagatagttgccggaactcctaagccgcggtgaatggtatcgactgatactttaaatcgtgatgagattgtaatgagatcctagtagcctctgtgtggagcccctccctctaggagggttattatccccactacccccaccacacttggctgtgtgccttgcatttcccagaagtgatgggtgccacttcccagtggaagcttttggagctgtctgacacctctctcctgctcctctcacagcaagcacccagacaggaactgctccttcagcctgcggttcccaaaattaacaggacacaaagcagagccccagctgtcggtgatgcatgtacagcagtagcgagaaatgcacttctgtcctggcttgctgctgaggacgtggggccacttactaccccagcggaactcagccgacactcgtgcgctttctcctgcccccttccctctctttcttctgagtctattccctaatcctaaataaactcagtgtaacttatagcgcttaagaaggtcatctaggcggggcacggtggctcatgcctgcagccctagcacttcgggagactgaggcgggcggatcacgaggtcaggagttcgagaccagcctggccaacatggtgaaaccccgtctctactaaaaatacaaaaaaattagctgggtgtggtggcaggcgcgtgtaatctcagctactcaggaggctgaggcaggagaatggcttgaacccaggaggtagaggttgcagtgagctgagatcgtgccattgtactccagcctgagtgacagagccagactctgtctccaaaaaaaacagaaggtcatttgttggcttctttgccctggcattgctatttgaatcaaattcgaattaaagggcctttgagaatgtagtcctaaacccaaataggacacgattctttgtttttcttcattaaattcactttatattattctctgattatgaagactttgagtatatgattcgtaccctcaatgataccttaaaatgatgtgaggatgggagtctttttgtataataaatgctcccaaccctgacatagagccagacacccaacgcatgcttcctctggcccagatttaacatgcactggccgctccccatgcacctggcaccctaggtgacaggggtaccagatgaagcacaagtctccgccctccagggaactcccagcacagtgggaagaatacatttgaagcctgttttttcccctttcatgttaaaacagagaacttcctgccctgtttgtctctgggacgctcctcaggcccacatctcctttcacgtcccatcccctgagctggacatttgttcagcaagtcctttcctgagcacaaatgcatcgagcgaagggatgcccagcattacagacaccagagcataaagctgtgtggctcagagctaggtcaagcttcccatcccagcctaaggcttcttcactccctttcctggccccaattgcctccaaacaaaaatcagcaagcaagccgccagtaggtccttggccagcatccagggtgaccaattagtctcggtttacccaggactgtgtgggtttaaaacaggaagtcccacatttgaagaagcccctccatcccagagaactggagcagctgtcaccctaacaggtagagtaccttttccccagttggtatgcaaagctgtgcacccaccaccgccctgccctaaacacccccacccatccattctctctttctccatctctcctgacttccagttccacttttttttttgttgttgtttttttttgacagagtcttgctctgtcgcctaggctggagtgcagtggcgtgacctcggctcactgcaacttccacctcctaggttcaagtgattctcccacctcagcctcccgagtagctgggattacaggcaccgaccaccacgcctggctaatttttttgtatttttagtagagacagggtttcaccttgttggacaggctggtctcgaactcctgatcttaggtgatccacttgccttggcctcccaaagtgctgggattacagatgtgagccaccgcgcctggctcagttccattaatttcacccatttcctctttccatttccagctcttcataaggaggaaattccctctcaccttcccttcctctctctttcctttatgaggtgaaaatgtaccctaatcattgaaaaagaaaagagctagggatttgtatgctatcaagaaaaagtaatgactgtaagtgaaaataaatgttctaaagggacattaaacaaatactagacgtgatacatcctcaaatacacggagccctcttccaacattctccatttatttttttccttccactgatcaaacttgtttttcacaaaataccacttttgagttaaataaaacaccattgcaattccattttctctcctgcttcctaattgctctattcacttgtttattcacccaacagaatgtgtttctgtattgcacacatacatcacggcagagactgtggtcaggaaaggctgtattgagaaaaaaaaggccacctttctacaagccagtgaaaatcaggtttggagaaaatttaacatggaaggctggaaccagagaacacagctgtgtaggatggaacactacagataagtcatatatttgggtccagacttcctgcagaccactggctctcaaccttggatggacacagaaatcatctctggagttcaaaacaacaaccacaaaaaccccaatgcctggtctcagagtttctcatttaatccatctggggtccagtgggaactgggatttttatttattttcatttatttattcattcatttatttttgagacagggtctcactctgttgcctaggctggagtgcagtggcgcaatctcagctcactgcaacctctgcctcccaggttcaagtgattctcctacttcagcctctggagtagccaggattacaggtgcctgccaccacacccagctaatgtttgtatttttagtagagacagggtttcaccatgttggccaggctggtctcgaactcctgacctcaagggatccgcccaccttggcctcccaaagtgctgggattacaggtgtgagccactgcacccagccggaactggggtttattaaatgtccctcaggtgattctaacatgcagccaaaataggtaggtagacctagagaaaggaacacagtgggttccaggacgctcattttacataaagagaaatatgctttttaccaggaaaaggtcctgggtagaggcacagcttttccaaacacatattccagtaggaatttcttgaggtggccttaggtaaaaaaaaaaaaaaaaaaaaaaaaaaaaactgccttgctgtagcctgtcgtggtatgacttccaatgccagagcctacgtgcctccaagggcagccccaggaggaccacgtggcctccgtcttggtgctgttgttcctgatattgtaatagtggatgtgggcgcttccctgggttccagcttcgcagcagatgccatgggctccccatcatgtcgcttcctctcccttcccatccagtccagaaaaactcccagggtgattattcaggtcaacatgagcctggggtgtgatctcaccttggaacaaaggaggaatcccaagtggatccaggtgcactgggccacccattcacccagcaagcacacagcaaacgcctgctacccaggggagccccgaccccaggctggccctggaatgagtgcaactctttgtccaggggtctccacgcttttgtgaggaagagctacctctccttcccacagagcctggagataggtccctggtcacagtggcattctgggggttttcagagagtcctgtaatggatatcaaatcctagcccaacaaggggtgacggcaggactctccccggattcaggtctatgttgtattcatctctgcacagttcctgatagacagtgcatgctcagtaaatatttgtttaaagagagaatgaacagtttaatgcatgaagaaaaagaatgaccctaaaagccatctcacagaggtgacactgctataaaggctagcaaagcaaacttaggagagaaaggaagaaattttcatagtcttagaagcctacaaactgaccgtggctttgtctcatctcttcttccctccttttaagggcctttcactcaccacgatatcaatataaaactgccaatacttgggcctggcatggtggctcacacctgtaactctcagcactttgggaggccaaaatgggaggactgcttgagctcgggagtttgagaccagactggacaacacagcgagaccctgtctttacaaaaaaaaaaaaaactttaaaagtcagtggggcatggtggctactgaggaggctgaggtggaaggatcacttaagctcaggagtttgaggctgcagtgagctatgatcacaccaatgtactccagcctgggcaataaagagagaacctgtctctaaaaagcaaaacagaacaataaaaaataactgcttatacttgtgtttatttgacgtgttctcaatgtgttagaaggcttcttaaatgggataccgaaagcataggtaacaaaagaaaaaacaaaagcaactggacctcatcaaaatgaaaacttctgtgcttcaaagcacaccatcaagaagatggaaagacaacccaaagaatgaatcatatatctgatagggacttgtattcacaatacataaagaactgttcaactcaatagtaaaaagacaacccaatttaaacacaggaaaaggatctgaaagtcatttctccaagaaagattcacgaatgatcaataagtatatgaacataagctcaacattagttatcagggaaatgaaaatcaaaaccacaatgagacaccacttcacacccactgggacagctagaacataagagagacaattacaagtgttgacaaggatacaaagaaattgcaatcctcatattgctgggaattgctggtgggaatgtaaaacggtgctgccagtttggaaaactgcctggcagtgcctcaaaagttaaatgtaaagtcacaatatgacccagcaactccactcctaggtatattctcaagagaaataaaaacgtatttccatacagaaatttgtacacaaatgtttgtagcagcattattgataatagccaaaaggcggaaacaacccaaatttcctttaactgatgaatgaataaacagaacacggtatattcatacaatggaatattatccagcccatagaaaggaaggactgatacatggtacaacatggatgaaacttaaaaacatttcgttacgtgaaagaagtcataaaagaccaaatatcatacaattccttccggggaccctgcagcgggggagggcataagaggacggggttgacggggggaagccaggcaggagagtcctggagggggacggtggccccgtgtacagcctgcgcagctgccagagttcctgaggagaccgaggcgcagacacccccctgaggccatctgacaatgagcctgcctccattggtcattagtgatgtcagctggggaggggcctggacagaaccacactttctgcgttatagaatccaaggttattgaggatttcattctagatggagaaatgggatggaatggcttctgttccaatgtcgaggactgttccacctggttttttttttttttttttaccatgctcacgaggggacacctggggtcgctgatagaagttcagcggtttgccattcgccattctcaggcttgaaactctgtgcctggcccaggccgagaggaacctatctgtccgcaggctgaccgggagccacccttcccgccacctgcacgggccagagccaagtcccgccacctgcactgtgctgtgtgggccacggaaaggccaagtggcccagggtgcacctctttcctctccagggcgccctgagatgcagggagcaggcagagaagagagaggccgaggagagaaataagccaagcccggggtctgagcaggctgcacctggcatccgtcagcatctcactctcctttgaggtaacacacggagctggaaggactgggggacggaaactctgagccctgaaaggcccctacagtgtgacctgagaagatctctcagagaagcttccagaaatccatctgtgcctccccggccctcccgcgatgggactcatgaggggcagcaaagagccccgggggcggggggaagaggaaccagagcctggcctgaggcctcctgcgggatggtggacagctgaggctgctctggaaaactccctctggccaaacttccctcttttatgcttcttaggatgggggcggggcgggggggggttgtgatgagagggaggagcgtggtcccttctttcactatttattctacacatgttgtgctctctcacctggagtgacttcgagtcatccaatgtcactaaaaatcctttcttttaggtgaaggagtttccctcacttaattctcccaagaaagattcacgaatgaccaataagtatatgaagataagctcaacattagttatcagggaaatgaaaatcaaaaccacaatgagacaccacttcacacccactaggacagctagaacataagagagacaattacaagtgttgacaaggatacaaataaattgcaatcctcatattgctgggaattgctggtgggaatgtaaaagggtgctgccagcttggaaaactgcctggcagtgcctcagaagttaaatataaagtcacaatatgacccagcaactccactcctaggtatattctcaagagaaataaaaacatatttccatacagaaatttgtacacaaatgtttatagcaacattattcataatagccaaaaggtggaaacaacccaaatttcctttgatgaatgagcaaaacatggtatattcatacaatggaatattatccagcccataaaaaggaaggactgacgcatggtacaacatggacgaaccttaaaaatatttcgttacgtgaaagaagtcataaaagacttcttttaggtgaaggagtttccctcacttaattctcccaagaggtggcccattaaagtggtttctggtcatcacaccttagtgagttaatggctatggtcagcggagttctgggccaatccttacagcaggtttaggcaaacacgtgcccttgtttcactgatgtggcaggaaaacgtgttctgatattcatttgtatgttcccccccttgcacgccctgcctcctcctccaagctggtctcgggtcctggcctcgccccctggagggagttctgtgtgcccgacaggtgctgtgtcccaggcaggagctgtgtcccggtcaggtgctgtgtccctggcctgcctgcaccgaggctggggcatcctggcaggatcagaggccgctagggaggtgacagagtggggagcagaggacacttccccagaaccgagacgggagagaggggccagatctcagagcggggtggctgctgcatccaccagaacaaactcacacactggggcctccactcggcaaagaatctcaaactcaggcctggctgctgcacgaaatctccaagatggaggaatctcaggagtctggactagaagggtacaggggccaccagatgcctggaacccagactcttctgaggcctgggggaaggggaggaaggtccctcccagaatgcttgaaattgaatttccccccaacccaatagggtggacactagtgactgattagagggaggaagaggaggggaggagggaaggagaggaggagggaaggaagggaggagggaaggaagggaggagggaaggaagggaggagggagggaataaatctgagtctttgccccacagagtttgtggacaccagttcacaccaaggagacctgcttgttgggggcgaagcagaagctccgacttctgggcagtgttcacagtgccttcccaggcagccagcagaccctccatagacacctgcccactgtgggaggcgtgggaggctgtcagaggttaggtccacgagaaagggaggagggtcagggcggctgaacaccccctcagaggaaggagcctaggggttctccccccttcccctggggctggtctgctgggcactgaggcatctctggggggggggtcccagcacagcccaccctgggtcccttccacagcgtgagccccccgtgcctgcaaaggaacgcaggatccatgtccactcctgaggggccgctctcgggtactctccaggtgctacctgggactgaggcgacaaaagctcagagcccacctctgaggcccatcctcagaccttccctccctcttctctaggtaataaatgggcagcctcccagagacccctatcccaggcgagcagttaggacggtggccatttccagggaggccccgtgccctgaccccacgttgcaggacccgctccggactagcctggtgttcctcccaggacacccacactgtcccctgaaaagtgggggacatcttggaggaggtgggcagatcaggtgtctgaggttgctggcactcactcgtttatggtgcaccagccctggaagattcaggaacagaaagacagacagcgtccatcacgaagctggctttccagtggagaggcgcatgtcaaaataaaaagctaatttcattccggtaagaactgtaagagaatcaggtgtgatcagtgcaacagagagcgcgtgagtcttttgattagatggtcacggaaggcctcgtggagatctgtggggtggacctgagaaagggaactgaccattggaagctgggacagagcaccccgggcaggagggtagccagtgcaaaggccctgaggcagggctcgggagtgtgcagcgggaagggttctcatccctgctcatccctgagcaggacagggtgtgacgaatgatgttcaaaggctgttccagctgctgagcggaggaggccctggaaaggagagggtggaagcggcagggagggccctggggaagtctgcagggatggtgcgggtgagagacagccctgtgggtgccgccctcacctgcgctctgctatagagaggagagccagagcggggcggcaggagtgtctgtctcggctcttaagccgatggacgctccagaaacccatctggtccccagccccagcaccagccaagatccttctaactccagcgggcttttcagttgttccaggggtgggggatagtttggagaaataacacttcccctgtgattaacacattcagaaaggggcaaaggggaggttggcacgaggcaagcccagaatccaactggcataaaaaataagtccttaatgaggaaaggttcacagcctccccgctgtgcctcccccagatggcgggagggggtgtgttctgtggggtgcccagtgcactggcacacaagcacactgcccccgctgggagcctgaggccacagccagcatttccacctcaccgtccatctctccttcctctaggagaaggcccggcccatggcgggggccaggcagggataacagaatagtgaatctacttaaaaagttacctttgctaaatactcaccttactgccagtttctggaggaaaaaaaaaatagaaaatggcagcaggtggatcattccccgacagcagttaaatgcaccttggaaagaacaaggtttctgcccagcagcccccaacagggctgaccctgaaaacttaaggacaaattcaaacaaggtgtcaactcaagtcacagaatttggtgatcatgatttgtcttaaactgactcccacttctaagggaatgagaaagtacacccaagatgacctgagccacaatttttggtaaattaagtcctgtaaccaggtacaggtgattcccgttactcaaggtggttttgctccacaaagtcgccaggcacactgagttagcaaatgctgagccattgttttcaggggaggtgcagggttagcttcctgggagcctctggccacgtttttgtcaaccaatcagtacatcacgttgtttgatgtgggtttctgtttaaataaaggcacgggtgtccctgtttgcaccgcacagcgcaccctcaggtgagagtcttccgggctgaacatcccatctccacatagtgggaggaggaacacccagcactacccctacttgctggaatgtggaccatctggggtcggaagggaccctggaaagcatctgatgaggtgcagagaggtttaagcccccaccccaggaacggagtggagggagtgtggagggctacggcgcagtgccgcccctccccatcgctgtgggtgagtctcctggggggctttgaacaacagaaacgcaccatctcccagttccggagcccggaagtccgagatcaaggtgtcggcagggctgggtctctctgaggctgagagggagaatctgtccaggcctttctgccagctacgggtggctgccggccatctttggggtttcctggcttgtagaagcatcaccttgatctccaccttcatcctcaccagaggtctctccgggcatatctgtgtccagaatccccctcatacgcagatgccagccatgtggaaaagggccagcctgctccaatgtggcctcatcaaaactcatcacatcggaaacgaccctgtttccaaaagaggtcacattcacaggtacagagggttaggatttggacacatcttttaggagacacacaattcaactcataacagggtgcccttagaaaggttttatgttcatttgtttttagggtcagggtcttgctgttttccaggctggagtgccatgacacacacgatcttggctcactgcagccttgacctcctgggctcaagtgatcctccaggtaatatttttattttttattatttttattatttttaattttttgtagagacgggtctccctatgttgcccaggctggtctcgaactccttggctcaagtgatcctcccacctcggccccacaaagtgctgggattacaggcattaaccaccacactcgacacccttagaaagttttcagaaattgctcttgtctgcctgcttacccttccgaggcatctaacagcatcctccctggcctaagcctgggagccttcctaaaggcgtaagctcgcctttaggaaccactctcgttgtggttttaaattgtcatcacttgccagataaggagaggttgctgtatggacagacacacaaggagactgacccaggtcctgttgcaggacagtcacccagcatcctggccccaccctgggcttccattggtctggatcggacatcccgggggctctcgtgggcagcctggtgatgccaggaggaagggcccactgtgatggcagattgctggctgctcaccgtgatgaaagtgcatctgtcccacaaagggcagcctttccgtattcaagagtggggtgcagctcagggaggcatcggagatggggactgtgacgaggccaatccacgggcattgattgctccatggaccagcgtgtctgagctccctgtgaatgtatctaatttgtgggacttgcaggacccaggacccagtgcacatcctgagtctaactcaccccgacattttttggttttaaaccagtgagatgtgattacaatgaatattcatgaccgcttcccatatcctgagttttgtcttcggccgtgtctttggagcattccttcccctatagcatgatttctcttttatgttttgtctgtcatctcttccccaggagactgagagactcgggggagcaggggctgcgtcaggaccccctttctgccacccccagcaccagcccgagacagactgtggtctgactgcaggctgacacacctgggtccacaggctggattctcaagaggggcgagagaatggggtggtggctgccccaggccagctggtccaggcagcttccctgatcaccgcagtgacgctcctgctcaagctgggagaaccagggtcaagtcccttcactcagtcaccaaaacaagaaacaaaaacaacaacaacaacaaaggcaaggtggacccatcgctggctcctctgcctccaggggatcagaacttgcccccttcccagtgtgaattcccctccgatggggtgtggaggctggggtagtctctaggctgtcccagctgtgcctctggcctcctgtctgggtgcagccttagcggggcacaggagggcgtgtatgcgggtcctccagggtcctcaggccacagctcctgggctggagaactgtgaggtaggacctagcccctcgggtcccctgccctctcctcctggcaggttctctggctttaggcattaatgtcctgtgacaaattcacttaggactaagaagccactgagaatattcagttcttggatcatccacaacagcggaagcagaacagagtgagcactccagacgcgaaagggcccggcccagccagcttgcggggacccccgagacgaggtccctgccagactgccaatgtttatttgaggctatttgtttaaattcaacttgaaccccggttacctccagctcagccctgccctgggcgctgcgaggaaaacaaagccacaccacaccgtgcacagccgtcttcacatctctggaagacatcaccgtacaggagcggtggggagacagaccgaatcccataaagtgtgacctcctgccactgccacagccagggcagagtgcccttcggggctacacagctccccccaccaccccaatcattacaggagaaagcaaattggtgagacctggtatttttcattaaacagataaagtttattttcttcaaatagtatcagaaatattttgaaatgaccctcaattccacattggggtcaattatgggggagggaaagggggaaagtggacaggaagataaggtggaagaagagggagagaaagaggcagtgctggcccacggggatggcagctgggggtgaatccgggcgaccctccctccatccaaccgtcggcgctcgcagggcgttgagagtgcttcacacaaacggagagaaatggttgatattagtatagtcatggttaatataaaccttaaatacctttttaaagattagaagctgagctgggaacggggcaatcaggcagcctcgaggggggactgcagggagcaggggagaggcttagagagttctgaatgccacacgcgaggcacttttctcagggggctcttaagccctaacacctttataatttccccttaagatgctaatgatctattaatcactgtttctggctgacttccctttacaccagtgccttcagaagctcccctaccgagtgggcctgtcttagggaggaattacttcctacagctaatccagagttcccgccccctgcaacaaaacccacagcagcttctcctccggtaaagccgggatctgagcagacagtcactcctgtgggcagcgctggctggaaaggacactggagcaggccgcgcctgggccttggagacacgcacaggaccctggaggaggccacacctgggcctcgggaacgcgcacaggaccccggaggaggccacacctgggcctcgggaacaggcaccagcagaggcaggactggaaaggacaggagaggctgggcccacatttaatctctgttccctctccctccacagtggtgcctttatttctagaagcaacgaaggaaacacagtagactcagagccagaagaggaagaggaggccagctcccactgctgcagcactcagctggggtcagcggggctgtggcgttgcaccactccatgaagggcctggtgtcccttgacttggacaccctcgaccctgccaggctcggccccacagccttgctcaatcccctcagcaccctcgtctccagcagacgggtatcctggacatgtctcacctgatttgacacaagaccaccaagacaaggggcaggtgggtgcagtggctcacatctataatcccagcactttgggaggctgaagcaggaagattgcttgagcccaggggttggagatcaccctgggcaacatggtaaaacccgtctctacaaaaaatacaaaaattagccaggtgtggtggtgcatgcctgtggtctcagctactcaggaggctgaggtgggaggaccgctggagccagggaagtcgaggctgcagtgagctgtgtttgctccactgcactccagccagggagataaagcaagaccctgtttcaaaaaaaaaaaaaaaaaagtaaagaaggccaggcacagtggctcacaccggtaatcccaacactttgggcggctgagacaggcagaccccttgagttcaggagttagagacaagcctggccaacatggtgaaaccccatctctactaaaaatacaaaaattagccaggcgtgttggctcatgcctgtagttccagctactcgagaggcttagacagaagaatcgcttgaacccggaaggcagaggttgtagtgtgcagagactgagccattgcactccaggctgggcaacagagtgagactgtctcaaaaaaaaaaaaaaaaaaatagaaaaggggcagcttcctctgaagccagctctgcagactggcagctgcctgacacctcagccgggccatttcctgaacggctaggcaggggcacgttgggctttaactgccctcagccccaccccaaccagggctcgctgcaccagaagcttcctagaaaaccacatcttttctgctaagaatcagaaaagtcgtgatattctcagacatcagccaactacagactggcctgcagaaggaaggaaagtagaaggaggaagtcaagtgatgctggggcaaggcagcgtggccgggcaccgcggtcggaactctcgtgctggtttgcagctcagaagcggtccgcagcccctgccgtccagccctaaccctgacctctttaggcctcagtttccccacctagacaaggatgatggtccatgagtctgctatttttcattgagcaaccttgtactcagtgcctgttcggaatgagaatagcaatgtctacagttccaatgctttcgccacaccttactcatgtcttgtatttaaatccggtctgatgatttacataatgcttcacccacgagaattccttcagcagggaatgagggtgtcatggagacgccgcctcgggcctcggtaaccactagggaagaaacgccagggacacctggtcctgacttgggatctggtgctccaggctctagctctgtccatagcccaagggtgctgagccccaagtggtcacacctgcaatgtcactgagcttgggtagtggtccatccagggccagccagcccaacgtagcaggggcccgccttccccagggacaccgtgtggcccaggagccacagcagaggaagctgagcagggcggcagaggaagctgagcagggtggcagctccctgggaggccacacctgtaccccaggggttcttggacaattgggggcagggctcaagagggagatcagatatccccctaacaaagagagtgggggctggagcggtgaatttggacactgaaagaggagtgactgtatttgtaccctgagtgtgtgcgccagtccttgagggcattacattttacattacgtttgtaatcagaaaagtagactttcaaaagaagacatcatctaagttacttgttaggagtggcagattcatctccccggagctggtgacagtagggaggcatttgaaaaggtgcctggacagcacaggccttgagggaggacaggtcctccatgcccagaatgcaactggctggctaaggtgccttcgaggttccccaggctgcctgtgtagagaaagcagcagctggcccagcagcccagctgcaaagggccctcaccatgcaccagttagttactcattcattcatttagatgaggtctcgctctgtcatccaggctcaatcatagctgggtggggcaatcatagctcactgcagcctcaacttcctggcctcaattgatcctcccatctcagcctcctgcctctgtgcacctgtcccgaggccccaacctgcagtcctgagactacagatgcatctggcccccggacctgcactgtgtggatgtggcttctgtcagttcactgcctcaggagcaagagtaggaatgggaggtcctcccaagatggaagttcactgttctgtgaaacatgaaccccccggacctccgtcgccagagtggtccagcagggtgcacaggggctccggccccaagccggcctgcttctgatggaggggtttacaccggagcgaggagctgcccacccgagtctcaggctcctcattcatcaactgtggatgttgttagtttaagaatataaagtgctgccgggcacggtggcacctacagtcccagctacttgcgacgctggggcaggaagatcactggagcccaggtgttcaagtccagcctatgagacagagtgagaccccatctgattgactgattgattggttaattgattaattgattggttgagacaggatctcactctgttacccagcctgaagtgcagtggtgcgatctcagctcactgcacccttggcctcctggattcaaacaattctctcaccctgcctcctgagtagctgggactacaggtgcctgccaccacaccaagctaatttttttattttttgtagagacagggtttccctatgttgccatggctggtctcggactgctgggcttaagtgatcctcccatctcagcctcccaaagttctgggattacaggcatgagccaccgtagtgagggtagcagtggtggtagtaacagtaggtagtgatggtagtgatgttagtgatggtaggtagtaatgatagtgatggtaggtagtgatggtaggtaatgatggtagtgatagtaggtagtgatggtagtgatggtaggtagggatggtagtgatagtaggtagggatggtagtgatagtagtgatggtaggtaatgatgatggtagtgatggtaggttgggatggtagtgatggtagggatggtagggatggtagtgatagtaggtagggatggtagtgatggtaggtagtgatggtagtgatggtaggtagtgatgggtagtgatagtaggtagggatggtagtgatagtagtgatggtaggtagtgatgatggtagtgatggtaggtagggatggtagtgatggtagtgatggtaggtggggatggtagtgatggtaggtagtgatgatggtagtgatagtaggtagtaatggtagtgatggtaggtagtgatgatggtagtgatagtaggtagtaatagtagtgatggtaggttgtgatggtagtgatggtaggtagtgatgggtagtgatggtaggtagggatggtagtgatagtagtgatggtaggtagtgatgatggtagtgatggtaggtagtcatggtagtgttggtaggtagtgatggtagtgatggtaggtagggatggtagtgatggtacgtagtgatggtaggtagggatggtagtgatggtaggtagggatggtagtgatggtagtgatggtaggtagggatggtagtgatggtaggtagtgatgatggtagtgatggtaggtagggatggtagtgatggtaggtggggatggtagtgatggtaggtggggatggtagtgatggtagtgatggtaggtagtgatgatggtagcaatggtaggtagggatggtagtgatggtaggtagtgatgatggtagcaatggtaggtagggatggtagtgatggtaggtagtgatgatggtagcaatggtaggtagggatggtagtgatggtggggatggtagtgatggtaggtagtgatgatggtagcaatggtaggtagggatggtagtgatggtaggtggggatggtagtgatggtaggtggggatggtagtgatggtaggtggggatggtagtgatggtaggtggggatggtagtgatggtaggtagtgatgatggtagcgatggtaggtagggatggtagggatggtagtgatggtaggtagtgatgatggtagtgatggtaggtagtgatggtagtgatggtaggtagtgatggtagtgatggtaggtagggatggtagtgatggtaggtagtgatgatggtagcgatggtagggatggtagtgatagtagtgagggtaggtagtgatgatggtagtgatggtaggtagggatgatggtagcgatggtaggtagtgatggttgtgatagtagtgatggtaggtagtgatgggtagtgatggtaggtagtgatagtaagtagcggtggtagcatggggatgctgccgtgaagcagaggaggcttcacaattctgattgtgaaggcttcagaactctgatcttctcaattcaggtggaaacgtgtctttaggatagaaaacaagtaaactgcaggattcccttcaaggtctagttcttccctgtccctactttgggacactgctgaacaggctccatctgagttcaagaatctgggtgtatctgtgcaggccaacaagccaatacagcaggcatttgaaagacacacatacacgcaggccatgcttttagtcatgcaaacacacagtgtctatatatctatgtgcacagatttctgggcatgaatatatgtgttccaagccccagtgtacctacaagttttgatataaacctacacacagacgtgcagcatatgtacacagataatacttaagtgtccacatgtctagaacctggaacaaagctgcatataaaagcagatggaacacagcagcagggctatgtctcacgttgtcgtttcctgaagctgatgtacatgagacacttcattctagttctgtggtttctgcaaggaactggtgggccaaccattcctaaggaatatggtgttgacaagctgaagacaggctgcaccatcacgcggctacagctgttgttctgaatttcaaatctggtggcttcattgttgttttcccaaaagtttcatgaattatgtcaccaaaaaactcactgatttatggagtaaagttgaagcaatatctagttggtgtgttttcaaagagaataaatggatttctgcttgcacttctattcccagagctgagtatttgagtgtttgttctaggatctggtatcacacagccttatctctatccccactggggtgaggccccccaaggaagtttaggctggaacttgagaccacttatcaccaaattaataaaatagattcatttggaatcagctgactcaaagcaggaagacttggacccaattcaaacatctagaccaaaacctacactctgtttggttaagatcggatagaaattcttcctcttcacatctcacatccatggacatgtcatggcagaaggctccatcgtcctcagagcccagccagggaaggtgagcaggaggcagcacatggctgcccacctctgtagaattccaaggaacagaagctttttaaaaattcagattccaaggcctcagcctgggcctcctgactcctggccagggtttggagatgtagaaggaggtagaaggaggagatagaaggagatggagaagaaggcatgagtcagtttcctcccacactccaggcctttcccaggggttggggaagcccttgggaagctctcctcttttgctgcagagatagagaaagagcgtggctctgaagttgtggcagtgtccctcagagactggtcactcactactacagaccacaggcaggccagtgctccctctgggcctcagtgtactcttctgtaaaatgggaagatcatactgggtgacctcatccctaacacctcgtctctagctctcaacttctaccactccgcgaagtcgtgtgggctggaagtcagagcggcttcctcaaagaggcggaagaggacccatcacatgaaggggctggtttggcgaggcagaggtgggaaggaacgggggtaaaaaccctcccacctgggtgagcgtgtccatcggagcagtggttctcaaatgagaagcccttccccatgagcgaatcacaaagttattttaggtaggtcatacgaaatagaaagagatacgaaacgtagaacagacaataactcagtgcctggcaaacagtgagcactatgcaaacacgagttattatttctatcgtgagtcatggtccaaaagtttgaaatacactaactttctgtggctcactgtctctatttcgtcaccagcatgtgacctccatgagtgagggatttttgacagttctgttcactcttaaagccccgtgtctaaaacagtgcccggcacaaagtaaaggctcagtaagtatttactggatgaataaatcggtatcattccatgcaattgttgtcacatacatatattccctcttgggctagaccgcctgggtctgagtctggcagatgaattctgtgctccccagcccggcaaacctccctgggacacggggacgtcacagctcctcttctcggtgctgttgaaaagagtgtatgcggagctccagggatggcggcaggcagcctccgccccgcacaagggtgctgggagacatctgtccctccccacctgcccctgttcccagctgccccccacatctcaaccccacagttccctttcctggcaggatcactgctcggcatccctctcctggcagcgacaaaaatggccctcttcaccccgacagcctcttctcctcgtctgtggcctgcttgagccaggatgggactcatttccttctcaggtgaagacgttgttagtggagaaaatgaatcttgggctaatgagctgatcagaaccttgagctgcaagagggctccggctctcttcaactcctggcccagtggtcctcagagcgtggttcccggaccagcagcgtccttgtcaacctaggaacttgctagaaaagcacattcatgaacccgcctcagacctactgaacggaaaactcggcggtggggcccagcctccaggtgaccccagagcttgctcaagtttgagaaccaccagcctaactattgttgaggagggaggaagcggtggtggccccacttggaagtctgggccctggcagcatcaggactgactcgtgggggaggcgctgggaagggaaaggcggtggctgccgttttcagatgcctgcctcccttcccaacctcgtcatcctcacaaggggaggtggctgccaagtcacctaaatgctgagggcggcaggtagtgggagccgcatttcccaaaacactgcgggggcgggaaaggccccacctaggagatcagagctcttcccaaacaccaacggcaaccccagctcatcggagccaccaggaataattcttgccattagccccagagtctgccgctccctcagggtccctctcccggcatctgggggctggattttcacacacacagtgtgtatggtcccggaacacagacgggtgctgtcctcagatcgggggctagcagggtctggaggagccctcctcaacagatgagtccctgtgacatgactttccagagccagacctcccggcctgatcagtgctcgcccctacttgcggtgtgtgagctgacacgatttaccctgatgggcagctgtttatttttacaatttatggtgaaccatgttagaagttttccatttcttctagtcttagaaagtttcttttaaaaataaatgtaaggccgggcgcggtggttcacagttgtaatcccagcactttgggggtgggcagatcacttgaggtcaggagttcgagaccagtctggccaacatagcgaaaccccgtctctactaaaaatacaaaacttagctgggtgtggtggcgcacgcctgtaatcccagctactcaggaggctgaggcaggagaatcacttgaaaccggtaggcagaggttgcggtgagccaagatcgcaccactgcactccagcctgacgacagaaactccgtctcaaaaaaatttaaaaataaaaaaataaaaataagcttaaaaattgcacttggatataaaaattgtgcaggtgtgaatggctgcaatttggaactaccctatcccacaacgccacctctgtttctgagggacaccgtaacttaggacgctggcaggaggtggtatatgagaccctttgtgcatgtatgtctgtatgtgtaggtgtgtatgcgtgtgcatgtggatgagtgtttggacgtgtagataaagtgagtattcttctggttatctttgtatctttgtaaaatgaatccccctcttataaccaccatagggcttcataaatgccatgtcctacagtattcttctgtagttggattctaggacgtttgcatgactgttctaaaaagcttggtcatatttgaagaggaggacagtccactaacacgcacagctgggaatgagatccagttttgcaaagggatttgtgttttaatgacacaaatgtgagtcctcatctgcttcttaaactgtcagcaagatcaccaaggctgttactaatgtaagtgtgtatgggggtaagcggctgggtgagggactgctaggtaaatgctctcggccttgtacctgtgcaaagcccatgcttgacgggggatgcccgagagggaaatggttctggaatctcccagtgaaaccgcctggactttgcaggaagactgcagccttaggctggggtccctgatgtctagtgttattctgggtacacagcagtgtccacacagcagataccagcttaactgtgtggccgagatggtacagtgaagaatattcctcttggccaagcatccaaagggagcccctgagctgccggtaattttcctctggccaagggttagcaggctggggcgacaggagcctactgagagtgaattaggcaggtggctcttagctgacttttccttctatgatcagctctgttccttttctcaagccacatcctcacggacgctggccttgagctcttgtccccgagcctctctctctaggaacttgtccttcccacaggacatcgacacctgagaccctgtgaagcaccccactgaggctgtaccccctggccttcccagccccatcactcatcctggggcactgctcatcttctgaaggctcagagcccttttccttccaacacgacgatgagctaacctggtatataaccacgcggcaaagcaccgacaagctccgctggggctgctccagcccttgctcccagcctgggcacctgagtctttcgaactggctctttcttccagacacaatgcttctgtcctctggggtttcaggtgtagagaaaaggaggccaccctgtgaggttggcgcccggaagcatccgtttaggcaggtgaagctggcagctcacacgggctccccggagcagactgggggtgtctttccccagctccattaactgaggccatgtggaaatcttccatggtgggaacatttacaccacagcagtcaggaaacactatgaatcagagctgcttttctaaagagtcagttgctaaagagtgcccgtggcccagcggcttttaaactacgccacccctccctcctgcactgtgaagtcagattgcagagacgaggctgaggacttcagctttcaggatgggagcagatgaaacctttggataaatactgctatggtttgaatgtttgtgcctcctacaaaattcatgctgaaacttaatccctcatgcaacaatattaagaagtgggcttgggggtggttaggtcatgaggacagggccctcagaaatgggttactactcttagaaaagagctggaaggaaccagtgaggcctacttttgtccatgtgaagtcacagtgtgcaaggtgccaccttggaagcagagaccaggccctcacccaacaccgaacctcctggcaccaccctcgtctcggactttccagcctccagaactggaaataaatttctattcttcagaaatcacccagtctcgggtattttgttatagcagtacaaacagatgaagaaaatactgcatgtctttttttttttttttttttttttttttttgagatggagcttcgctcttgttgcccaggctggagggcagtggcgcaatcttggctcattgcaacctccacctcccatgttcaagcaattctcctgcctcagcctcctgagtagctgggattacaggcccccgccaccacccctggctaattttcatattcttagcagagacagggtttcaccatgttggccaggctggtctcaaactcctgacctcaggtgatcttcctgcctcggcctcccaaagtgctgggatcacaggcgtgagccaccgcacccagcctactgcatgtcttttgatctacctaaaaataagaaaatgataataaggataataaataactttaaaaattaaattggacttccgtcagcagacatcatctcatttgatcttcacagcccgcaggtgaggagagttggggaggccagccaccgagccgtacgggttggctcaggcaggcccaggacctgggtactgctccacggttcctctcccaatggctcctgcagggtgttctgaacgaaaatgggttcccatttaggaagttctttgtgatcctggaatacaggggcgtggtggagacctcgagaattctaaccgtgttggggaaacgaagacgcagaggcagtgccccctgcctggcagccgcaggccctgagacacaggctgcctggggaaaggggcctccgatgcaccgtgctttggagaaagtttctggcagggccctgctccctcccacacggggcggtctggccatgccagctaggctctgttttctggaacttggcccttcccttccgcaggagtccaagcgatgtcaggatgatggtggggaagttcttagtcaagaatctccgtgcctcagtttctccatgtccctattagtctctgtgtctagatggacaggagaccaaaggatggagggtgacaagaaacaccaagtcctgctgtattcatttctggcggctgctgtaacaacatacacacacggggtcttagaacaacagaaacggattctctcagagttctgcaggcctgaagtccaagatcaaggggtgggcagggccgcgccctctctgaagcctgtgggggacccttccgtgcctcttcctagttctgagggtcactggctctccctggggatccttggtagccaccagcgcactcctgtctcggcctctgctgtcccatggcctgctccccacgggcctgtgtcttccatcttcttgggaggctgcagttatgctggattaagggcccaccctgctctaggatgacctcatcttcgctaagtacatctgccagagacgccatatccacacaaggtcacatttacaggtgctgggggttaggacctctctatatattttgggggacataattcaatccgtgccacttgtgcatgctgggcgtgttcccacctggggaagctgctcctgcccagcccgcagcacgtttgccattttccggagcgtgctgtagctaggcacagagaggctctgctgggctgcagggggagcgagacacaccagggaggctgagaacccacaccgcctaaaccgaggggccgtgcacacaggtggctcagtgtctgcagaaagaagcgggaggggggtgcaggggaaccgtagcaccaattacccatagtgggcacatcaaatgattacacagggacagtgggtgtgaaccgggtgggcccaggagaaacctggaggtacagtcccctcacctagaacgcttcttgagtgtttaatggaaagacgcctgtccagaaggtttctcctggaaggagggatcaaatctgtctaagctccgaagtaaccctgctcagctaataggttatttcctcatcttagaaaggaagaaatgaacaggaggcagaagggcaacctgtcccatgctctgcctcgaagcacacgtcatctggtgggcagccctgccattgtggaggtgggcaaaccgaggttcagagatggcattggccatgctcatcaaagcagcccaagctcacactcagccaaggagccccgagcctggattggaacccagatggaccaattccaaaatcctcaagttctacactccttcccgcctgccccacctccatcgtcctgtgtccaggaacatggcccttgtgccccaccagcatccacccgccccaccggcttctgccagagggaggagtcagaggtgagagtctggtgctctgagcgctgcctcgcagttgtgcaaatcagttcagctcagtgagttttaattcagtgtctactttgatgctgaagatctagtccctccccccacagtcactgatggtgtcactgaaagccgagtctgacaacacggaataagaagtcctcgatgagccgccgcaatgtgaccttaggccagtcacttgagctccaaggcacggcccacaggggtacccctgctccccaacccgcaaatgggtggtgagacctgagggactctcaaattcctccagcgatcccgccgtctctgtgcctggccctctttatctgggatcgagccactcacacccttgctgccatctaacttttcttaatggcctggtagggaaatatcacaaaacaaacacacacaactcaaagaaaaaagaaacgtcgcccatgccagagttcagcgtggctctgacattacattggtgcctcttgctgggagaggccaaaaccacaactttccggaactggagtgagctttcctgccatgagagctcactggagcattttgctaagaacgggttttcccagtttgagactggcgagtttggggcctctggcaaaaaaaaaaaagaaaaaaaaaaatcacttctgcttttgccaagcagcttccctttttctggaaactgcccgatccccacctcgctgtgggcaactctgccagcaacagctactcctggctggcccaggctggtgcggggatctgagacgtggagtcgcaatggccagtgtgggcaagcagctcttgtgaagttggccacgcacgtctctccagagtcggctacagatggaaatttccatatgcccctgttcagccaaaatcacaggcttttggtttcattatcattgtcaaaccattaaccactaacccctggcacctaggggagagcgctcctggggccccactctgcatgctggtgagctcgaatgtcttagaagtggatgcttctggaaggaaggatgggaagcctccctcctcatgggtccccctccacagctcacgtccaaaatgccttactctgtatcatcatcgtctatgaaatgtgcacgtcctcactcccatcactgctaaaacactgctcagactcaacttccccaggggagttcacaggagagggagccggggcttcctgctctggtgaagggcttccctccactccctctcagctggagggcagggggcagtgaggggaggagcaagactgaaaacgggtggcaagctctcgcctgtcccgtgcctgctccgtcccatgtctggaagaatgccagcctcaaagcaaaccctcaacagtgctgcttactgagtgacaggacggacgcacaggaacccaggctcctacgcaagcctgtgccctgtgtaaggtgccagctcagaccgaggcactggtcgggggtccctggggctaggggggacagaaccctcaagaatgtaagccctggcggggcacagaaactcgtgcctgtaatcccagcactttgggaggtgggcagatcacctgaggtcaggagttcaagaccagcctggccaacatggcgaaaccccgtctttactgaaaatacaaaaattaaccgggcatggtagcacacgcatgtaatcccagatactcgggaggctgaggcaggagaattgcttgaacccagggggtggaggttgcagtgagtcaagatcgcaccactgcactccagcctgggcgacagagtgagactccatctcaaaaaaagaaagtaaaccctacgagggcagcagcctcatgtgccctccactgctacatcctcagtgtagaccacagacctgtaggggggcatgtggtaagcaccccattgttaatggggccctgagaagccacaggacaggctgagaccatatgaagaaccgccccaggaccacagagatgccaaccccacacgcctgagggtcctataggaacacaatgacctggaagtgctcccatcctacagagagaccggagaggccaggggtgtgcacggagcttctgcccagagccctgcactccacgagaattagcttagatcttgacctcctcctccctccctggggccccgcctctctcctatctcacagcctgcacggccccataaggggtcaggagggaagaatacctgctctttcatatgtgacccacctggcagggccgcagctcaacgggcaaccccaggactggctgttgcagcttggactaaatttaatttcaccctccaaaggtaggggcggctgccttgaatggattccaaggattccaagggtaaacctagtgtctctggactcagccctaagtcactttttactgtgtccctcggagagctcgggacccaggagatgctacaacacttgctcttaaactttttaaaagtaggtgacgattgtgacaaggccaacaaggactggatgcgtgagtgtgctgtcccataggcgcagcaccctggaggaggaggaggggctgcagctgggtcgacacagcaagattccagaaaagagaggagaaagtcggtttcagaaaaggggaaaaaagtcaaaatgacaggtttgtcagaaaaataacttacattctgaaaactcagctgcttaaaaataatttacgtatatgtttttcagatgacaattttgacaattttatatggttgatgggtcagatattacgttgaactctgtgagatgatcatttttgaggttagaaaatagtcaaatatggctcacgcctgtaatcccagcaatttgggaggccaaggtgggtggatcacgaggtcaggagattgagaccatcttggctaacacagtgaaatgccagctctactaaaaaatacaagaaaattagccaggcgtggtggcgggtgcctgtagtcccagctactccggaggctgaggcaggagaatggcgtgaacccgggaggtggagcttgcagtgagctgagatcatgccactgcagtccagcctgggcaacacagtgagactccgtctcaaaaaaaaaaaaaaaaaaagtcaaatattggctattccacgcagtttaacctaatattatcacctgctcttcactgctgaggaacctgggcacaggctgagaaaggatgatttgggctcaaaataagaccttctgaccccaaaccgaggctcctcctatgaaatcatgctgcttcccaccgaaaaaccaaaaacaaatagaatccaggccccctttattctacagacaaggataaccttggtgttgaggtcaggcctgtccacccgctggggacagctgggtcattcaccagcagcccaaaggcaaagcccactcctgtcaccccagccagcccttgctctgcagtgccagcaggcagtgcccatcacgggccagagagaagaagcctccaccccgactgctgttgtttatttctctaaaaaatcacattagaaatgagcctccaaggagcttgacttgaacctggaactttctaaaatgcagagtatctatgcatctctatctacatgcatgcctcccttccccccacacacatgcacacacacgaacacacgtgcacatgcacacacacgtgtgcacacataacccttctggacttagcagcacacggaccagctggatgcttgtggggcctgagggtggacagctcctccacgccatcagggctgctgtctgagacctgcccccaagagcctctggccaggacgcagccttcccccacacatcacaggcacagggaggcatttggagcgcccgaggatagggctgtgtgacatccctggcaagggccaggcagcgggaatccagccgccaaactcgagggcctcatggaatgctaatggctacggacagcactgccacaggcttgagtgacatcacctcagtttgcacaattgggctgagactggagctcagccttcctggctcccactccttgagctcagggcatgagtacggccacagaatcagggtgcctggtccttagggcgcgcctcctgtgattctcacacaacggcctcaagaagggaggcagcgggggagtcacggaaggagggctcagtcaaagaaaggacacatctgagcagagggatggcctcgcagcccagttccaggatggctgagggctccatactccagggctggagctggggaaagcacacacaccactttacacacacaccaccctccaccactctccacataccaccctccacacacaccatgctccacacacaccatgctccacacacaccaccctccacacacaccatgctccacacacaccgccctccacacacaccatcctccacacacaccatcctccacacacaccatcctccacacacaccaccctacacacacaccatcctccacacacaccaccctacacacacaccatcctccacacacaccaccctccacacacaccaccctccacacacaccaccctccacacacaccacgctccacacacaccgccctccacacacaccaccctccacacacaccaccctccacacacaccaccctccacacaccaccctccacacacaccaccctcccacacaccgccctccacacacaccatgctccacacacaccgccctccacacacaccgccctccacacacaccatccacacaccaccctccacatacaccatgctccacacacaccgccctccacacacaccatcctccacacacaccatgctccacacaccaccctccacacaccaccctccacacacaccgccctccacacaccgccctccacacacaccactttacacacacgccaccctccacacaccaccctacacacacaccaccctccacacacgccaccctccacacacaccacactccacacaccaccttccacacataccactgcagacactgggatgtttttgccaagcagagaggctgcaggcagagaggcatgggctgtgccataggggaaaagtgggtgggtgggggcaggcagaggggtgggggcggcaggaaccacagggatgggtagaggctcagagccacacctgctccagaccatatggacctcacagatgagtctgtgtcctcgcttaggcgaaagctgagctccatgatgctatgtgcaccctgtctccatttccaaaaggatgcttgcaatgcagttacataaaataccttgaaaggaggaaaaacagtagccacaggaagataaagtaaggcggtctctggagagaggttaagacacaaaaacccgtaagtcctacacactcgccagacacaggccacacattctgcccttggggtttctccagcaaatgaagaaagaagatttcttaaaaattatagcatactcaagtttgctacatggcatatcatggcaaacctacatagggtatcatttaattctcatggccacctgcaggcaggtattcttattgctgtttcactaacaaagcaacttaggttcagggccatcagggagcctgtccaaggtcacacagccaatgagaggtgtggcaggagggaaaccaggtccccaaagtcctggctccccgtggcgatctttccaaggcccgcgcagccgaggacgcaagcacaggtgccacgagcacgctggagtggccccgaggcgggcccctgcggaggcttgcagctccctggaaggtattttgccttcttcattgccccaaattaggatgtagggggagacgaaaagacgtcctgcagggaagggcgtggattttggagacagccacaccgggttcaattggcctcgccgtggcccttaggcaaacaactcattctatctgagcctccgtttctccaactgtaaaaaccgggtgaatactaggaacaggcagagttgctgatgagttaaatggcaaaatatgtgaaagacgttaagtctggcacccacaccgaatataactcagtgaatgcccgcatctgaaaaacaagaccagccacacacacggtcacggcgtccccaccggagcacggtcacctgtgcctcatcagccacgtggccgccacagggaagagaactggatcgcaaggcaggtgtttcaagtctggtgaaacccagctctaaggaaacaagataaaggaggagaagatacaggacagcaggcagaagacaacaagaagggcggagagaaaacggagcagagaaagaggaaagaaacagaaaacggtgacaaaagaaactactggactgcagcccaaagtctactgctttcagctttgtgtaaaaggtggtatcttttagggctccagagacactaaccagtgtaatttttgcaggcaacattaaaacaaaaaaacaatcctaagacccatctatttgcaattaggcaagggctgatcattgctggaaaaaaaaaaaaaaaaagcccacagggagtataagggatgggcacagaacgcgcagcatcctgcggaagacggtgtgggagatgagagccagaaaaggtcagtgctttttgctgggtgacattcaggacctttctgctcctgccagctcccagctcccagatcactgagccctacagagttctgcacaaatgaggaatgaggccgatgcccaggtccgcctgtgagagggggctgtgcccaaggtggacccatcagcaactggaagtaccaaaaaaaaaaaaaaaaagacttcatataaatgcatctatagtcagcctataaaaatggttggaaagcaacagcccactcctctccacgcattttctcgggttgcatgctgccttccggcaccatctgtctgttcagcacagcggttgtgtgtgggctcaggcgccagacggctccggcttgatgcccggctgtgccaccccctgccaacggcctctgctgtgcagattttcccatctgtagaatggggacaatagcagcaccagcacacagctgtgtggggatgaagtcagctgccacccacgcatgctgaggacctgctggcttgggagcgctcgctctctttgtggtcactgttgctcttcttttcccttcaggtctgaactgaaaagtcatctgaaccaggtgccacctcgctggagcatcagaaggcgggcatacaatttctaacaccttctatacaatcccaaacggtgatttcctgtcactaggaaggaatggggcataggagacaaagaattgcgggttttactcctttggctgctccctaaggggtacagggtgctgggacttgcctctcccatctctctttgggaatgaagcgctcctttcccccactgctggtggtgctgtggcccctcggctgccagccccttatggggacagcccaggctggaggagccaccttcccaaggccccagcctcttccacagtcagctacatccaccaatgattgtccccagcccctgctgctacccagcaaggctcagaagggtgggctgaggccctagctgagactgtggggcagcccagcctctcctgcaccgtgcctacccctcccctcccctcccttacactcccctctcctccccagtactcagcagcaccctgccagcctcggccacagctgtccccagctggcccattgaagagcccaatctgtaccacttggtgggaaggtgactgaagctactggctccttggagctttaagcagtatggagattatttttatttttgtttatgcataccttgtgtcactttcggtatccaggtgtcataaagatacgtgtcagggattggactaggtaagcctcagtggatagttaaatacccatatctcccacaccccattattcccctccactattcacctgcccacacacacacaccacccctgtgctacaggaagagagagtcacagggaaagggaagtcctgcctcctcaatggtcctggaccatggccatgcctgacaccattgctgctggaagaaggggtgacatcgtcattcacttcggccgtttctcggcttcctgtgatttgaaagttttccagtgctgagatgggtttggtttgagcccccaatccaaagatgctttgctggtagctaggaggtattcagcaagcacctgctatgcagaatgcacagtgtggagcacttggagggaccataaagatgaacggaacacgaattctgcccccaggagtcttgatggagctgacgggcaccctaggccttgtctcgcccctaggaggcccctcttcctgctcctctgcaaggctggcatcgacagcaggtccagccccatccctggcctcagtgactcaaggggagttttcagaaacttctcagatcaaggaaagctcagaaaatccagtgtctcctgaggagaagccagaccctggccaggtgtctctggagtctgtcacagaacagattcaggaaaaacaggtcgctggggcctccagcaaacagccgataccacatctgtgtgcatcgtcctgtgatgcccagggaatgggcttcgagggtgctgcacagctgtggcaccagagaacactccgcggggaacggcgtcagacggggcggggcgaggtgaggcccgcaagccagtccctgctgcacacggtagcgaaggcggaaagctgcggcaacaccttcccaccatctctgtgaggtctgtgggtggagagggtgggatgcgactgccagccccgtggaaaggtatgattctccaaagaagacaaaggtgctggccaggaatcatggtcttcagagtgagggcagcgcccagcacatctctccgtgttcactgagacacagctaagacacacacttaaagggccatgggattagcgaatagggaagacttcccaggggcgaggactgtgagagtggaggtgagtaatctggcggcagctgcctgaggctgtgtgcccaagcccggctgggtctgctgccagccacagcccacagtgccagagctgtcccttggcgccatcagaagctgagtggccttggataccttcagctccccttctgctctcatcagccacttgccagccatcctcttgtcccagtgagagctgcaggttaaggcaccgaggatgtatctccatctctgtccagtgccaagcagttgaatgatctggtaaacagctgtccctcactcccatttaggcagtagtcatctcagggtatcagctggaaatccaaggccatgggagtcacctgagtccatgccgctggagggacgcagggttgcaggacacgagtgcccatcttctgatgtagtccaagattccctctccgccacctgcaggtgggactgtgggctgggctgacggaggtggccgggcacctggagctgtagcaggtatcacagaagcctagaatgctggacccggaggggcccttccagtcactaacagggctccatctgcctatcggatgctttcatccaccttccattaagcacattaaccagcagctatgatatgcccagccactgccccttctccagcctccgtggagcccctcctgctggaggcagggcagaaagggggcaccaggacaggccctcggacaggcaagaccacaggctgggcatgctttgcgccatttgcagcagagagaaccagaacttcttgcaaacatctcactcctccaataccacacacggccacctgcatctctacattgcttgtccttgcccaccccctctcctccctggcatccacgcctgtactggtggacaatcagagacacgcactgatgggtgccatctgtggtgcccaaggcctcgcctgtggaagggggtgtgggtttcatctcccattgggaatgaaccaaccacaagacagagagagagagcacggcccccagctcacccaccccacccgaggcccactgcagactggaaggagatgacttgggagcctgagtgttctctaaaagccccatatttattttctggagtcaaggtgcaaagtccccatgagttccccattagacagcaaatgccccaaggagaagaggacaaaaagcatattaacctgatgaactgattcccaaggatgcctgctgtgccctacctctcctagagggcactgttctcgcccagggaacactgtctccccttgtctgcccacctgtcttccatgccatgaccctactggggtcacgttaggcttgtggtagagggaggtgcaggcagacgagactccaaggaccctaaagtcccagtattctgcttctaggtagagcttgccaggttagatttctgcccgccacctcaactctctgcagccccaccccaagactttgccttcaagttcctggcacgtggaccaaggccaagcccatttctaagccttctcactctcagttaagggctcagtaccttcagccctgggggctcaagctggcttcactctggggtcaggaccttggcctgtctcagtgtgaataaggagacctattgaacaaatttgcaaattattcagccaaagcctaatgagggattaaaaaggaaatctcgttcaaattacaatcaaagaatcacctgcaggacgggcatggtagctcatgcctgtaatcccagcactttgggaggctgaggcgggtgcatcacttgaggccaggagttcaagaccagcctgaacatggcaaaacttcatctctactaaaaatacaaaacctggccggtcatggtggtgcatgcttgtaatcccagctactggggaggctgacacataagaattggttgaacccgggaggctgaggttgcagtgagccaagatggtgtcactgcattccagcctgggtgacagaataagactctgtctccaaaaaaaaaaaaaaaaaaaagaatcacctccattgaaaagaataaaattatctgaagctggggacatccccagaaaacctgggatgggatggtggccacagctacattcttagggtcggtcctcccatgggcggcttgttagggagagggaggcaacccttctagacacagacatcctgctctttactgtggcatctcagtcatgctcccccaagtcctgtgaggtggggattatattctgtattttaccggtgaggaaactgaggcttagattgtgccagtgaactgcccaataggacacagggggcaatcattgacaccggggttgcgaccttggcctctggcacccaaactcatgctccctccctagcagccactcttccattggcaagataaaaaccatcccatcttcctgctcacacacaggactctgttcttgagaatctagtatgagggacggctaggtccatgcccgtcccctcagtggacggatgctccctcctccaatggcaccaggaaatagagaggtccctgaaggggatgaggcccgaggcactggcatctggcccccgggctctgcattgcatgaaggtctaggcgcccggcccgtctccaggcagaggaccatcccgccatggcagatgcctcctgccagacacaggatgctgtactagtcaatcagcctgagccaaagcccaagtaactttcccaagtgggaggtgaaggaaaaaaacaaataacacagtaatgtgcctaaaatctgccccttttttttctggccagtagattggatggaaaaaaaaatgcctctttttgaaaccaacaagacatgatttgtctgaaaatgttctctttgaggtatgtggctcccacaagatttgtaaaaaacgggttcactcagatttttctaaattgggtcgtcgagttaactaagcatttccattctcaaagacggcccccattttctttctttccccctctgttagttaagcttctgcatgtcctcaccatcatcatcatcattgtcaacattcaggtcggctgtgtgagaggtggcttcctcagggctgggacatgacaaagtgtagacgcatgccatctttaaaggagcttatggtttaattaaggagacaggctggatacttcgaaagaaaaatcgtgagattttatgagaaagggacgcggtgccgtggatgccgtggtgtggctcccggatccccaggcgcagggagcactggtaggtccccaagtgcagggggcactggtaggtccctgggtacagggagcactgttaggtccctgagtgcagggagcactggtagatccctgggttcagagggcactggtaggtctctgggtgcagggagcactggtagatccctgggttcagagggcactggtaggcctctgggtgcagggagcactggtagatctccgggtgcagggggcactggtaggtcctggggtgcagggggtgctggtagaccccaggtgcagggggcacttgtaggtcctggggtgcagggggcgctggtagatccctgggtgcagggggcgctggtaggtccccgggtgcagggaccactggtaggtccccgggtacagggggcactggtagaccccagggtacagggggcgctggtagatccccgggtgcagggggtgctggtaggtccccgggtagaggcagcactggtaaatccccaggtacagggggcactggtaagtccccgggtacagggagcactggtagccactggtactcagctgagtgcctggctgagacttgccctcacccgacgggatccgcctcacccaagttcacatccccttcccagggacagtgtgggagccctttgcctcaatctgggacaactctgaagggtcatcccagttccagaatgctccaaggggtcagctgaggcctttggtgtgaatgcttcatcgcccttcccctctgctcagtccagcttgcttccctctttcaccactgagtggccaaagctagaggcacagactcaccagctgagcataaccttcaggtgaaggtgacaaaggccactggagggcagaccatcatttaacaaggaatagaaccaaatatgaggccagcacggtggctcacgcctgcaatcttagcactttggaaggccaccgcaggaggactgcttgagcccaggagtgtaagagcagcctggcaagatgatgaagccccttctctatgaaaaatcaaaaaattagccgggcttggtggcacctgcggtcccggctactgagcaggctgaggtaagaggatcgcttgagctcaggagttccaggcagcagtgttcgcaccaccgcactccagcctggactacagagcaaaaccctgtctcaaaaaaaaaaaaaaggaaccaagaaccaaatatgtccacctgcctttatgctgtattttatcacagtagtaaactctatgcctgcatgcctctcctacagaacatcgctttgagcctttcctgagaactgatattgccacatctagaggagaggagagaggagggaggtgatagagaatggagtctggagcccacagcccttgtcttgaaatagcacgaaacaagcactgctgtgaactggcttcctgacctccagcctcaagagcaggcatctcaggcagaaagccacagggccggcagatggcaatgctggctcccagaagcccttccctgaccgtagccacagcagctgaccagccagggtgggactcctctcctcccaacacgcctccagtgcaaaggcccaggttcaatccttgcttcgccactggccagccatgcgacgtggcaggtcacttaacctcttggggctgtttcctcattatacggcggtccagggtgcagcttcctgtttcccttctcccaggggctaccatgcatcctctgcgccacttccacacctggcaggtaccctgcaaccctagaggggaggtctcctggcccagttccttccccagaccaggttggtatcgctgcccagcatttccctctgtctttgaaaatactctattacctatgccccaaggtcatgtcagaaatctcaaaatacacctaacatgcaaagcagagtggtgaggagacaagcgacctctctgttctcctggcgctggcagctccccaggggtgaaatatctcctcggacactcactcatcttcagtggtgcaaatgggagggctcaggtgacactcttaaaagtccagctttggaaggacccaggccccatcactgctctgcacgcccctcacccacagccccttaaagccacttgtccccaggacaaagcagtttccatacagccgtggtgcttgagccaaacggagacttaggctccagccctctttttcaaagtgtatatatgtatattacatattacacatattacatataggatatactttaaatagcatatgattagataacaattttatataatactaattatataatatatgaatgtattatatatgtaaacagatctagacaggttaagtgactggttccgctcaaatccttctggcccctgtgcacatgaccttgctttccatccacaggcagagtctgtccctccatcccttgagtctcagccgtgtgacttgccatggccaaggggcctgaggagcccctgagcttcaggctggccctcttgctgctgcctagacggcctgctggacacacggcccagttgtccccgcggctcggctggcatggagccgactgggcgatgggcagacatgcaggcgaggctgtcctggggcccagctgctggctgaccccagagatcggccaagccagccccaaccacgagaacttcccagctgacagagagaacagtgagaaagaataaattctgtggctttcagtccctatgtttttggtgttttggtagcagcagacgtgaactgacagggtgacggcatgccccaggttaagccttgtgaggggagagaggggcccatgtggatcacagtgagacccctgtgcctggcacacaacaggctgcggtcaatactggatgactcagtgagaagaagcccctagacaggtgacagaggcgccaggcagggcttcctgattccgagtgtagtgttcattctaatctccattatttaagaagcaaaaacaacaaactgagaaagaagaaccagagactggaacctatgaaagtggagaagaggccgggcgcagtggctcacgcctgtaatcccagcactttgggaggccaaggcgggcggatcatgaggtcaggagattgagaccatcctggctaacacggtgaaaccccgtctctattaaaaaatacaaaaaattagctgggtgtggtggcgggcgcccgtagacccagctactcgggaggctgaggcaggagaatggtgtgaacctgggaggcggagcttgcagtgagcggagatcgcaccactgcactccagcttgggtgacagagcaagactctgtctcaaaaaaaaaaaaaaaagaaaaagaaaagaaagtggagaagacaggttatttatttttgagataagaagggtaaagaataaccttcaatgaccttcatctagaaaggggccaagtgaagcgtatggagacctgacacacacagggcaaaccgaagggaggcagcagacgccgccctctctgggcccaccgtccagcctcagcctgaccgtccagcctcatcccctaccccagggaggccttggctgctcgtggggcatctgggccatagccaagcagagatatcaaaaacctgacaagacacaacagagacttttctcagcaggttgggctagaatggttgtgaaccttacactgtcttttctacattaaggataataagactaataacaatactaatatttcacatattactttagagataaagagagacggctcatataaaagcacacgtctggcatataacaagtgcttcagcaatattagctcaatctgttgaaaaccatgccaccccagatggtatctgatacaatcaagaatattgatcggtcatcagcaccatgaatgcaactccccatcaagcgtatctaggttgcatggaggaagaaggctctctggggtgcttattacaacatatgctatagatgaggatggggcccaggtgatgtatgcttcaagcccaccaccccatggctgctggcatggctgaggtggtgagcagggtggagctgagtaaatggtttccacattagcccaataggcaaatggctgtgtggagcctgcctgcctgcccgtcttctggaagttgagcaggtgacagagctgtcctcccacccccacccctcgcacacacctctgcacccctggccccaggaggctaagtcttggtggccacccaggaggggagagcaggcaaagaggaagtgctctggacagagggagcaggcctgggtcccagagctgccacaccagcctctgtcacgttacgttggttttctcacagcccctccacactagaacttccagcagtgggaggaggggacgcaaggaaagacccagaccttggaagggagtgtcaaagtgctgtgggcagtgggacgctgggaccccttcctggggccttggccacctctccaggccatgccatggagcccctcagtgcaagcccctgccctacagctctatcggacggaggctgtggctgcgctgtgctttgagggcagggccctgttggattaggttcctgggctgtgataatgcggcaccacatactgggggctttaaaacagaatggattctctcattgctctagaggccagaggtctgaaatcaaggtgctgtgagagccacacgccctccgaaacctccgggaggatccttccttgcctcttccacccttcagcggcccatattccgaggctcgtggcagcagctctgcaatctctgcctccgccctcacaggccttcttgcctgtgcctctggatgcaacttccctcttcttagaaggactccaggcatagtggatgagggccggtcctaatggcctcatcctaatctatatgttaatcacatctgcaaaaaccccatctcaaagaaggtcccattcacaggtatggggtgcagagggtgtgggacttcgaccttttttttggagaatccaattccatcgcactgttcatctttgtgtcctcgacacccagcccagtccctggaaagcacacagaaacgagttgactggtttctggtcccagcactaaccctgcgtaaacatagttcttagcaatggctctctatttctttattcacaagtggagaatttgcatcctattttctcaaattctcccctcaccctgttgcatccttcttcttcccctccccagcacagtggaggtcactgcagggccacccccagcaatgaactcccctggaagaaggccagcagagctgcagggcacccccctccaggaccaggcctttggctcatggaaaagacgctgggagcctggggttacggagcaaactggtctttgtcgtgcattcatcagcagcttcactgccaggtcagagtatatcaaaacacagaggccctggcagacgccccaaagcctggtgatagccgattggtccgtgaccagccatgggttggcagagagggcttcctgtcaacaggaagtaaaggacagggattaaattattttcaaagtaggtagtggaagaaagagatgagtgagattccaattaaccattccaaggcagggctaaaatacagttccaccaaatcaccttcttctactggggaagctcagctcgttaatagctaaccccttcctctggtctgggggcataagccatgcaatgagtaacagtgggggcttctaagaactccgtatggttaagcccgaaggacgcagctgaactctcaggtggcccctctgctcatctcagagcgagtcacggttaaagaaccaagcaaagtcaccactctgtttcaacgtcacagctcagctgcccatcggcctttgtttgttgcgcattttaaacgacgttgacagaactgtggggttatcaggatgggctggttcaccgtcctgaaaggacggcagacagctggtgcttcatcggtgatcacgttcattggtcccattttggccgaagggagggcggagggaggagaacgggtgagccacattctcactcggctcctgtcagtgtctgtggctctactcggtaaccttagcagcccccataaatgtaaaaaggtgcctagaaacagaaagacactggccatgagctgaatacaccaaaatcagctcttataggaaaacagggagagcaaaagaaaataaacagccaagaaacaggaatatttaagagcacatgtatttgcctgaaggttttagaagatacaaactgatttacaaattacgtaagcgaagtctgagtagatgaagaggcgttggcaaataaaaagtgcttccaaatgatttctttcgccagtctagtgttcagcacagtccaaattgcaaaccctgagtgcaaactagcaatattgttctgagaggttttattggggggggcagttcaaagaaaagaggcaggaaaagacactagcaatgcactgagactcctaacaagtttgtgacatgtgaaaagatgcaatatcgattgaacccaccaactctgctggctgctgcttctgtttatgttaattcagtactcgagctgggaaatcatgatccaggatttaactctttgcattcatcagtaggctgctcctctgcagtatgtagagcctcgtttatataagaatcttggaaccctccacaaagaggtaccaggaccaagcgcgaatagggcagcgggggctagatgagggcagagatgcatatttcacctccactgtaattaaccctgtcatctaccatgtaatgatgaacaggctttttctcagctgggcatttgtgaagtagggataagaggacgaggcagctccaaggtgactcccgcaaggcactgagcatgtgactctgcaggcccatgggtttgtgcaggctccgcactattcccccatgtgagctgctctgtgggtgtccctgcgccctctgtgtggtagagtctttgaggaagtgatcacgcatcactgtctagctgcccgttccctccaggaccagcactgggccgtgctcaagcggcattgggccaatgtgccgtgccccactgaggacgaccctcgctgatcagccctctcacacccagcgtgctgcagagcggcaaccaagcttcatcaaaaaccctggagccacaggccagtctgaggaccccatcaccaagaagcttgactactgaaggttcccatagcatactctgggccctattggagcttacggcagggcatctaagatgcatgaagccactgaagggctgagtcaagaaagcttgcagcgtggcctaacgggctggcccacacaggcagctctggctacaggctggtttgggcattcatctttatttggaagccaaatgttgaattgcctttgttgaatagtcaaaagtcaaggatatctcttctcaatgacagctgaaaaggtgcagatgatagatagatagatagatagatagatagatagatagatagataggcaggcaggcaggcaggcaggcaggcaggcaggcaggcaggcagacagaggaataactcatgggggcagaagaaatggaacagtattacaccagggaagctattaatagtacccagttgtttttaagccccagtaggtacaagaatcaccggagaacttaagaaaaatgcaaactcatgggtcccaccctcaggcattctgattcagtaagtctgggctacgaagcagaattttatattctaaacaaacactgggagcttctacataagctagtccatgaaccacactttgttaaacattgccctaaaccctaatccagcaaatcttgctcaggatggtacaaactggccaaggtcaaagctgacacgtccactgtgccacacagcatcccccttccctttgcggaggcttccatccggagcgtttcagtggtgtgaggggcacaaagcactgtcacggttcgatcctccagccccggggcaggacggggctccccttcccaccctcatcctggagttcccaaactggctcattccagccggatagaggctatggggcaggagctgggtgcaaaggtcccaggccatcaccagctcggagggtgcgtggccttctcgcagcgcggggcttcccttgaggccacgcggcggggggaggcaccgctggcaacaggcccgcccaagcccagccccatctctgcaaacgttgtgactgcccagctccctggctctacttttagtttgtctccagcgactgtgcaggctttctggagcacctctccccagagggccagcgacatgtacattctgacagaaatgccccactcagcagcaaccatctgaactcctccagcctgcctcagtgtccccaaagacttctgccttgggtccatctctctgacgtcttccctctccctgggtctccagctctgtcattggcttgaaacagttccagagacacacgacatggcagccagccttgattaaagcatgtctatggggtctatgaactttagcactaatagggaagctgctttttcttagaccgacataagggagaaagagcacgcttgctaccaaagtctcggcagaacaccacgcacagctacgcttccagtgagttacttcctaaaaccattcccatcaccttcataatcagccatgccttacaagaggcatggaggctcagagcagggagccaaggcgggatgccaacaggccaggactctgacctctacggccctttgctactttgaaaggccagcatggcctcaggatagaatgtgccgtcagtccttccccttcctctccattgcatcctccccctcctcctccaagaccctggagctgtgcccataaaggtgacccaaaatgcccaagaaaggctgaagccaagcaaggcgacaccttcgttaggtccaagggccacgttcccttccccagtacacagccatcaaccgaattcaattgataaattacttagtagttctaggtctccaccaccgtccactacccactggccctaggctgtcccctaaaatggattcttccttcctggtgtcccaaagcctagatgggctgttgacaggaagcgggcagtggggacattcaaaatcatcagagcccgagagaggaggtttgcaacaattgcctccaacaccctaggccacggttctgtttatgatatgggctggaggctgaggtccccaaaacgactcaatccaattcaatgaagagacaagctgcttgggcactaggggtccgaggaggccaccaaatgaccccagtcacaggccagccagggccacagtgtctttcaagagttattactcctcagaatccaagatgtccttggcagtggcagtccctgcacaccacagtcctctgaggctggggtgaggaagcaaatgtgattccccatggacgtgctgccctctgctgagacacacccgggctatgaccagactcatcatttcccccaagaaccggccccttatcccaaatacctccacatcagttcctgccacctcaaccccttgccatccactaggctggccttctcacgtcccacgtctgcccttctgcattctctcatcacagctgcagttcaggccctcggacccttaccctgggggggggcttttgccaaagtacttgagttggtttccttgacaccagcccgtttcccatcactccactctgtacacttttccaggctgattcccatggaatgctgttttctttacctttaatggcttcttagttcaggtccccccagaaaagacactcagacaggaacttaggttcaggagtttatcccagggagtgcagacaagggaatggggaaactgaggcaggaactggccagaagggccagtaaggtgcattaacgagtgggttacactgtggatccccaccctgctagggatcccctgaggcatcctgcagaacccaggtcagaacttcccactgagcagcagggcggctgggccattggccaccaactggacccctcctgggttgagggttgcccctcagggcataatcccagcacttccaggggttcctgcactaggctgagcaagctgccagggtctgagaggattccttcaggtggggagggagacacgagtaagaggcagtccaccaaggctgcaggtgagggtgggctgggccccaggcaccaggaggaggctatccacagcgtccaccgcagcttcttcacgccttcaggagggggtcctcacgccttaggcctggtcttcaaggcagcattgccagatcaaatacaggacgcccccattaatctgggatttcacatcaacaatggatactttttagtatttcccaaatattgtatggcgcatacctatgctaaaacatgattcattgtctacctgaaatctagattcaactaggcatcttgtatttttagttactacagctggcaaccctatgtccaggtccttcctgatccagtctcaaagcatttcctatgactctagctctcaaaccctttcgccaggaggcgtggctcttcacctggaagcagccatcccctcccgcccgattctgtggggtgctcccactggttccttagtgggagtatcacccccacttctacgtgactcctgcctgccatctctgggtgtaaagtctctctaaacacatcaggccactgtcatcgctccttctgcctctagaaacaggtgtggtctgcactggccatcgtatgaccctggatcatttgctagcctttgtctgaaagcctcattttcccagcgaggttataactgccacctagcctggcacaatgatccataggtaatgaccattaggcagatgaggggacctccctggtacccaaagcaactgcaagccctgtgaggacttgggcagatcttccccagatctcaccctaaccagagcctgggcacgtggtcaccctcagccactgtggaataactgaatgaatactactttcgcggtgggctggctcatgccaagaacgttatgaaaagctgccaaagtcaccactggcagcaagaagggtggtccgaggaccccaactataacatggtttttcaacgttcacggcctggcctcacagtcctttttctggttctggattttgtctcacactatcgctggcaccaccccacgggcacgcccacacatcactcacaccctgcatttggaaccagcctcagcatgtggctgccacacaaaatggcccaaccactggacaatggcatgttcttgtttctctctatatatttttttaaaaaactaggtgtctgatgtatatgtatatgtatatgatgtatatgtatatgtatatgatgtatatgtataagtatatgtatatgatgtatatgtatatgatgtatatgtatgtatatgtatatgtatatgatgtatatgtatatgtatatgatgtatatgtatatgatgtatatgtatatgtatatgatgtatatgtatatatgtatatgtatatgatgtatatgtatatgatgtatatgtatatgtatatgtatatgatgtatatgtatatgtatatgatgtatatgtatatgatgtatatgtatatgtatatgatgtatatgtatatgtatatgatatatatgtatatgtatatgatgtatatgtatatgtatatgatgtatatgtatatgatgtatatgtatatgtatatgatgtatatgtatatgtatatgatgtatatgtatatgatgtatatgtatatgtatatgatgtatatgtatatgtatatgatgtatatgtatatgtatatgatgtatatgtatatgtatatgatgtatatgtatatgatgtatatgtatatgatgtatatgtatatgtatatgatgtatatgtatatgtatatgtatatgtataagccatacatttataggacactttacacttgtcaagagttttcccgggatgggtgtgatggctcacgcctgtaatcccagcactttgagaggtcaaggtgggcgggtcactcgagcccagctcatgtggaccagctttgggcaacatggtaaaacctcatgtctacaaaaaaaataaataaattagatgggtgtggtggcacatgcctgtagtcccagttactcaggaggctgaggtgggaggatcacttgagcctggggaggttgaggctgcagtgagccatgattgcaccactgcattcccacctggggagcagagtgacaccctgactcaaaacaaaaaaaacaataaaaaagagttttcccatgaattactttatttcaatatccgtataaagcaggaaaaatgggtattatttcctgcatttgacaaatgggagaaacagtagttacacggttagctcaagtgatcactgtttaagaggtttgtggcagcaacatctaacttttaactcacgaacatggttttaaatgtcttacatgagagatgtaaacaagaatgtttcattttcaaatagaacacttattcctgcataatcgagtcaccaccgtgggggccacacagcagccaggggtccaagtttccagccccagagctttccagccagggagggctggcccagggcccctgtggggctacttggcatcaggtgtctggagacccgcccctggactccaccctcttcacccaagcgttaggcacgtgtgggccggagtttacacaggaggaccttagcggggcgtctaaaagaagggtggctcagcaaacacggggcagtgcgccctgggattcacagtgggaagtgagtggcctgcctcggccatgccagctgcgcctgaccctgtcgggaaggattagctttaatgaggggtccggacagcccattcactgcgcactcccaccctgccccgggagagcaaaataactttctctacggagcactctggtgtgtgtgtgtgtgtgtgtgtgtgtgtgtgtgtgtgtgtgtgtgtgtgtgtacacaaacatttacttggttggctgaggcggagggtgtgacccagtgggccacacctcccaccgccctaccccgctacgtggaggcgaggaacagtggccgcgggctaccggggcgccttccgaaaagagaaccactacgcggcccgccgcccctctggctggacaaagtgaagccgcaggcagatccgagtcgccaatgtcctcccgggcggctggcgcggacggggctgaagttcaatgcagcctgcacggattagggagctccgagcccccaaataccacagagacccaaagtacactcccggggcgggggaagggaacggcggcagaggagacccccgctccaggcccagaaacgcccggagagaaactggagcggagggggtgcattggaagacgcagctacacagctccccccaacccccgccccgctgctttccccacccaccgcccctcccctctcctccctcccctcccctctctccgtctccagcagccgagcgcgggctccacctccccggagcgcagtccacaccgtcccttttcagcaaaacaacacaacgcaccgccccccgcacccgcacccggctggataccgggctacgcccagccgcccacccgccgcgcccggcgccccctctagtctgcagccgcccagcccccgccccaggcggagccccagccctggctgcacgcgggcagagagagagattgagccccggctccgccagcccagctcgggccctgtccctctaccctttccccaagccgcccgaagtgacaggaggggcacgcacggcgcgcgcggggcgtccagcgttaaccgcttcggcgccggggacgggagcgacaggagggctggggagcaggggaccgagtgctgggactcaccggaatgtgcacgcgcagcgaacgcctcttctggctggcatttttcttgccgccgctcccgccggggctggaaacatcttttttcttcttggtgtccataaccgcgcttcccataactctaaccagaagttgattctgcgaaactcctcgggggttcggtcccctccttccctcccccggccgctgccttcggactggagccgcgcgctctgttacaccctgaagccacctcgtggggacttccgcggagagggagggtgagcagggaactcgcgcggccgccgccgccgccgaagcgccgaattcaagcgtcctttcctacggaaccctcgtaggcaaatcagtcaaagcccgtcccggttctggtgtctccccgggttactcgtggctgaggtctcccgctgggtgacaaagttttcttccttttgcaaagctaagaaacattttccaccctctcggctcctcccacagattcccagaggtaatctgaaaggcaggtgcaattaaaaccagcaatttggaaaacaagcctcctatgcctgtgcccaagtggggaatctggaaccagtaagcccgttcgtgcataaatgtaatcctcggccgcagaataaaccagctcggagcctgcagctgggtccgtcctcctttctgggcgagagggagggcggcgggggaagaggaggtgcaaggcgagccctctgcgcaattaggctacgggcggccgc

SEQ ID NO: 492 - DNA, 76144 bp, Homo sapiens
ttaacaaaatggtagatagtaggatctattttaatttttcaatctgaaaaaaaaaaacccaaaacaaaaaaaaaacaaactatcctcatatatatatatacagtgtcaacattttcagagcacttacattaggaaacattgtttctcttcaactgtatgacaatactgtatatgccacaataaaatttacaaaaacaatcgcatcagcagtcataacaaacatcatgattttacatttcaatacacaagaaaaaaaatagacatcttcccggcacttggctcccgcctgacggcaacgtctcctccacactttgagagacctcagcttttaaaacccagcagcggctatttcagaagtcatgtcctttccagatccaaacttaaataatgagaaatttgccatttcaaaataactgagagtttattcatggatgtggtgaagtttactccaccaaaagatgtgtaaaaaaattgcatgaaagtaaaaataaataaagctgttgtaaagcagcctcgttgacacggtagcccagaacaaaacacttacgtgtaaaagtgtcattacaattttaaagtaattatttatattcaaattacaactttttgacaaatctaaagaaaacaaactgatttggtaaaaggttcaaagacttccacattcaagctcggtgttgtttcacacgcgtgcgccccggctgcggcggtgacatattgctgtattcggacataaggcactgtgatctgaacataccgtgcactcaccttatgccacatcacctgttccataccagtgaattctttgaaatgaaaaataatgaaaacttcaggacacagtgcactttaatgacatacagcatttaaaatccttcagacaaaggtctgaaaacagtcttttaatgcaagcctgaatcttcaagcacataaaatctttcttttttaagcttaatttcaacatcactggaagaaatacctattgttaaaccctgatatacattcttaaccacttgcagccagtgttcatgaggcaaaacgtgacccagagactttgttcaagttctcctcctagggcgtctacattcacggcggtcactccgtttctgtctccttttgtttggcacctgtcagtggatggaagatgaaagtttcaaagctcatggtaacagcagggttctctaccccaggggtttctacctgtgtctggcagtgccttaggaggatgatccagaggcttcggaggagggcgatgtgggaaggagcaggtggcccaagctcccatctcccacccaatcgttcgggcagcttggatccacgtaacatcttgtcattctaaatatgtcagatttaacttggaaaacaaaaaaaaagaattccactcttaaaaaattttactaagaaatatgtaggtatgttttagtgaaggtgtgaagtatttcagttgtgcactcttacaaatatgtattaaaaaaaggtttaggccgggcgcggtggctcacatctgtaatcccagcactttgggaggccgaggcgggcggatcacctgagatcaggagttcaagaccagcctggccaacatggtgaaaccctgtctctactaaaaatacaaaaattagctgggcgtagtggcgggcgcctgtaatcccagctacttgggagactgaggcaggagaatcgcttgaatccgggaggtggaggttgcagtgagccgagagatcatgccattgcactccagcctggttgacaagagtgaaactccgtctcaaataaaaaaaaaaaaaacaaaaaaacaaaaaaaaaacctttataaatattctgaaggataattgcacctaacaagtatctggctaggacattccacagtggattggcagggagagctactatttttctcatcacaggagcttctctcctaatttttcaccagacgctagacccctgaaagagatcggcaatctattagagcgtgtggctgaaacaccgtagctcctggcatcagactgcccacacactggatgcacgcacacatgggttcatttggacagtctaagtttgacaatgaactgttgctaaaaacttttttgagaaagagaaagtgttattgtgttgaaccagtacccctctggggaacggtggccattgcccgatgaaaagaatcaccactagtaccttctaatcgagtaacagcagacacttcatcaaactgcctcttactgactattccatggacaaccacctaacagtgcaggtcccgggcactgcgcctcattgcacacacatggcttttgtgcacggctttcagctcttttcatagcaacataggagggagacgggcctgtatcagccggctccttctctactgaagaaattggggctgaaggaggtgaagcgacttgcttacattcagacagcgctcgggtgggacagctgggacttggcctcacggtgggggcctcctcacttgcgattgttgatcagatgcaggcgctccctgagttccactccaaaagttcacttgtaatccagttattagtaacacggaatgttttcctcaacaaatcgtgttgtatacactgtatcataaggaattccaacccagctacccccatcttcacggcacaatttctatggtaacatacattccaaattccagctggaaatagattcctctctgcaccagcagtgatgggaggggcattgcaatgacttagaatttttgaaataccaaatctggatggaaatttgaactcatccagcacaaccgttcattcttatggtttgagatatcaagaaacagagaggatgaatcgcttgacttgtttactctttttgtaatgcccaaagagacagacaagagctgacattcagcctgacccgctgggcagactgtgtcccgtggtccagggctggaaacggggcatctttttctgaaggtgccaagctatatacctgtggggataaatctgcccagagaagaggccttttctagttagcacaaatgtgctgtgcagttatgcctgcctggaaatttatatgaatttaatgatggtctggatgagcctggctccctctgttcaatgttgcctgtgagattcctccactgttgaatgcagctgtactgttcgttttcaatcctgtatcgtattccatcgaatgaatgtgacacaatttatccattcttcttttcaaagatatttggattattcccagttttatggcattaacattcgtttagttcttaatgtttcatgattatagagactattgtgagattcaggtcttttaaacacttgaagtttgcaagtgactgcaccaggccccatttctagagtttctgattcagtggatatgggacggggccccaacatgaacatttcattttctagtaaattccaggtggtggtgatgatgcctggcctgaggaccacctcggaaaaatcactgctgtactggaatttctcttggtgttctcatttagcgaataagacatgtttcttgcaggtggtgaagattcctttagggtaggtatttttgggttacagacttaattgtaaaaactagtcttaactgaaatttctgaactaaagagaaatcaatactgtagcacacacaccgtttaatattggattctgagagttcaaagggcatgctgtttgctcccacatcgggtccatgtggccctgacaaaggctgggttgttcatatttgactggggctggggaggtggagggatgggaagaggaggagggaagggagggctggcagttttaagaactctcaagcccacctcttactactgagtgtgtgaaatgagaggaaggccagctcctcttgtctaaagccctctcccgttctctctgctcctcactgtctgagactctgaaggcttgctcaaagtgaatctgtcaaaaaatgagtttaaccacactctatctgaaagtgaatgtgatttctgtacaatattaatgaataaaagtttgtgtttaggtattctgttttatctactcaaaatataagttttttttctctttaaggaaagatgaaggtatcaaatagaagccagtgacgttccctctatgtttctggtcactagttctctcacaaagcacaattgaagaggtcttttcagtggaaaaggttatgatgaacatggcaatggctcccaagtcatttagggggccactggaccttgataggatgctcttaacttcgaatacgttctatacactttcctcactcacgcagaacacttaaacttcccaactgaagagaaaacgaaaatggtttcaaagtaatatactcaaagccttgatctgtaggtgggtggagaaatgatggtttaaatgctgcacttcctgttctacctcccacccttcctagacgccgatggcaaaggtcagaaaccagcattttacctgctggtgtgaggatcagggcttgcagaatgtccgacagggaaataatacccacaatactatctgcttcatttaccaccaccagccgatggacctgcaaagagaaaagcaggacacgtgaaaattaacatttaaaaaaggtttaaaatggacatgagaaataatgtcctgtcatgtttttatatgatcaacacatccctccagcctggggaatagcagtgagacatcatctctacaaaaacattagacagtggctgggtgtgctggtgtgcacctgtggtcccagttacttggtgggaggattgcttgagcctgggaagtggaggttgcagtgggccaagatcgcaccagtgcactctagcttgggtgacagagtgagatcctgtctcagaaaaagaaaaaagcaacacacacacacacatcccataaatgaataaatgagggaaagtagccacagacagacccatacgatgaccttaggctctaatgttcaatgtgttactgtctgattacctggaagacctactccgtattaaaaagtcacagccctggtgaaaaacagggacacaggcatgagaaggaaagaggggaaagctatctatctcctgtctctaatgatactgatttgtctctaattcaagctgatttgcttgcttacttttaagaaaaatgagctagctatgccctgctgagttttcaattttcaaaatattaatatagaaaagatacaactcaaacacgaaacacaacgtagctatcatacattgttaaacataactgttttaatttctaaaagttgtatatcagtttctaataactatcaggtacttgtcttattaatacatgggagagaagtccagatgatgacagaaacgaagaaacaaggtcgcagctcttacaagggttttattttctgcagtgtcttttctctgtgaagttcatatattaagaatcgcatccaagaggataaatgagctataatgaagtgggatagactacgtccatctctagttttctactctgaaatctctgatgagtgacggcagagcgttttgaggtgtttctgtaacaggcctttcacccgcaggaagggagcggcgttgctattctcttaaaagcttcatgatggccgggcgcgatggctcacgcctgtaatcccagcactttgggaggccgaggcgggcggatcacctgaggtcaggagttcaagaccagcctgaccaatatggtgaaaccctgtctctactaaaaatacaaaaattagccagaagtgctggtgggcacctgtagtcccagctactcaggaggctgagacaggagaattgcttgaacctgggaggtggaggttgcagtgagctgagatcgtgccactgcactccagcctgggcgacagagcgagactgtgtcttaaaaaaaaaaaaaaaaaggctttggaacctggagccgggtgcggtggctcacgcctgtaatcccagcactttgggaggctgaggtgggcggatcacaagatcaagtgctcgagaccagcctgaccaacatggtgaaaccccgtctctaccaaaaccacaaaaattagctgggcgtggtggtgcattcctgtaatcccagctactcaggaggctgaagcaggagaatcgcttgaacctgggaggcggaggttgtagtgagctgagattgcgccactgcactccagcctgggcgacagagtgagactttgtctcaaaaaaaaaaaaaaaaaaaaaaaaaaaaaggcttcagaacctgggccacggcagctctgtgccggctgcgccctgggagaccctctctgtattgaacagtgatacccctgatagaaaacagggacataggaaggagataggaagagggggaaatccagtttttgtattttgtctcaaataatactgtttgggtgatgtttctgtcataggttgctttaggttaataataataataataataatggcttggtcatctttcccgtggcagtcaacataaatttcttttaaatgtttctctaaaaaagctttcaggttcatcagtaatcctgtgatataacacagcacaattatttgctaactataatcacacattaaaatgatagttcacatttgtcttctacactgaagacattttattggttacattcaatagtggatattagccgggtgcggtggctcatgcctgtaatcccagcactttgggaggccgaggcgggcagatcacgaggtcaggagatcgagaccatcctggctgacaaggtgaaaccccgtctctactaaaaatacaaaaaattaggcgggcgcctgtagtcccagctactcgggaggctgaggcaggagaatcgcttgaacctgggaggcggagcttgcagtgagccgagatcacgccactgcactccagcctcggcgacagagcaagactccgtctcaaaaaaaaaaaaaaaaaatagtggatattaaacagatatcttttgaactctgaaggctaagggaaaccatctcatccagagaattaagcagttctctcagactgaaatgactccccacgtattttcttgtcatctgctgctgagtcaaacttatgtatgtcctttgttggaggtacctaaaagttagtgttctatttatgtcatataaacaaatggaatcatcactgatactgtacacccttctcctagctacattaaagctaaaaactgttatttttttggtccttctgtgaggagtcatcttgtgaaggaattttctttttaggcggagtcttttatttagggtgttacacaaagtacatttgaaaatcttataagcagtaaagtctaaggaaattggactgctgaggtgcaggaaactgggagttactagattatttgctatttatctaattgaggaaagagagatactggtgggaagagagaaaaaagttttactgacttatcattcactttgttaaaatatatattacgcactttaaattttgaattcataaatattcaaatggaacttaaagcttctgggatttttgttttctcaaaacaaaatgtatccatagatacagatacatcgatctatttagagacagggtcttgctctgctgtcgagactggagtgcagtggcaccgccacagctcactgaaatatcaagctcttggattcaagggatcctccttcctcagcttccctattagctatgactacaggtccaagccaccatgcccagctaatttatttttatttttagtagagacaaggtcttattatgtcgtccacactgtcaaacatatatagtttaaactatgaatgtatcttaccagtttattggattcacctatgataccaggacttttccattcaattcaattcaacaaacttttagagatcgcctatatgccaagtagtgtgccaggttctgggacaggagggaatcccatcgactgaacctggaggctgcctcgctgggcccttcctgagattcaggcttccagaggcatcattcactactggggacttgttgcagtggacgtcgggggagcaggactgggaaagccgtctcacctcagctcttactattctgtccacgatggtctccagtatttccagcttattgcacttcacaacaccttcaaaatactgtgaacggtgctgaagggcctgggtcaccgtgatatctaggttattgtatgttttctcagcagcaagattctgtaatgaagcaagagaataaattatatcctttcatttcagttcacttcaatgaccaaaattagtgagcttaagagagcctgatttctaaaaactttaatgcttatctgaatttagtacctgcatacatcagacgttctttctggcttacgacatgccattgctactgttattttgtcaacatatcaatcacaattaaagataaccatgttacaaggtctaccttccttacgaagcaacattgttaaactttgacagtatatcctgccaaagactgccccccaatttttaccctctaatgctctctaccatgcatggatgaaatctctggcaaggtgggctgacatctgtaaagggtggtgagtgccacagggctagaaatgctgcagcaacggaccttctcaacaagctccctggggaacaaggtttctgctgggaaggctttgggggacccatggggatcaagcaaccagaggaagaacaggcttgaggagccccatggatccaaatggcttcatggggctctcattcattttagcgggtcccactcaaccaaaatgccgatcagcatatttctcggtgactgttatgtttaacataatagtgtgaagcaaagggtttgaggcagctgcagaagaatgtttaatgtggggtcagtattgtggcaaaaaatggcgtgcacatttggggctataaagtgtcagtccccttttcttctttagaacagtggctcccaatcactaagcaatgggatgcgcccgacaaaggagccatgagtccacgtgtgcactgcgcacgcgtctagaggcgaataaatcaggcctcctacgtggaaacaagaacatttaaaatatatacacatgctgtggcagtgcataaaatatgcatgtattgtaaagatgaaaaattataaaatgctactaatatataattggttgctaaaccaatgcagattaaaagtacaattactatagaaggtctataaaattctgataatatcctcacaccccaaaaggttagaaattattaaattaagaaacaagataaaaacataaaaacacattacatgaatgtttaaaatgcattctaggtgacagattgaacaaaattaaaatacttacaattacatcaaatttggaataaatatctacaacttttcctaaaaatgaaaaatatatgttagaaaaatgtcttaagggacaaaaagaaattcatttaaaatcagttttaatgacataattactaaaagttaaacactgataaataaccttgtctattttaaatgaaaacttagatatgaaatcatattttaatggacatatgaaaataaaccaattaaactttttttacgatcctgcgtgccccttggtgctgaatttattcaccatacccaagttttcattttccccacgtatctcctgtgccaggtcatcttacaataattgcaccctgagataaacaattatttctgcctgtcagcgccaaacacacaaacctgactcatccacaacaggcagagctgatattcgtctttccacaaatatgttcaaggctttgatgatgggagtgtctggatgtatgaaggcaatgttgtggtacgttcctattccaagctcatccaggttctgcttcatgaaggcaggctttggcatatcagacatctaaacggaagataaacgcaaacgttctagacccagaacacactcttgtcatgttcaaaggtccagatttgaatgaaaaagtatgtccaacaaattaaagttagttttttctaacagtctacctggatgcctgaattaacatgagaaaattacaaaggactgtatcttttgtttgaaccagtttgtaggtctatgcttctatttaactattcacaaactattgcagagcattgatactgtaatctttttccatctcctcttcactcactaagaacgcgtatagaaccagggaagaacaggtctatttgggatattaagacctgtaagccacgaagaattgaatcctttattcttaattgttcatgttaaattcctggtcctgctgtcaggattaagtaatatttattaagaacctatacatttccaaacccaaagcatttgacggcagctgtctgagccactgctaagctagtcctcacgccacccgcctctacatcctgaattctccttggagagctccaatttttgtctactaggaacaaagaagccagctgaacagaattaaaagaatctttaaaaattaacttttcatgggctgttttaaaggaggagggatatggcaggagagaaaagtctaggatcatgtttgagtataacaaaataaggtctacggtttcaaaaatccaccttttataaagggtatagttgattccatcctcctggtgtaccttataattatcaggaaaagatgaacaattagaagaaacaaaatgttcaagtcaaagagttcatcaatattcaaatcatgagactcctagaaatttagagaaaaaaaaaaagaaagccctattaggtcatctagtccatctcaacatagcgaattccctgttgcacactataggcttaggctaattttcaaacgtcttgaagggtaatgctccttttttctcagaaaatgatctcataattcagtaaaaatcaggctctgaaatgtctttaagttctatatttttaactgaaaacctttagttagctgaatattctggtagcatgattctaattaccatattggcccaaatatgaggcagtactgggcagaggcaacttcctctcctttttatagaagataaaaatctgaagcagctctgcaaaagaatgatctcacgcttttactccctcttgtgcaacagcacactagcagaaatagtttgggcttgggagtcagagagactcccgggtttgcaatctaccacttagtatccacatgactgggggcacgtttcccagccaggtgtcctgtgtatgcaaggtatgcaaacgcctccctcccaaggcccctgcgtggagaaaagcatggggagtgaggaacgcttgaaagggatcctggctctaccgcttcccagccacgcaaccttggcaaagctacttaacctttcttagctgcatccctataaaataggattaataaaaatacctacctgatagggtagcagcgaggatgagattatgtcaagtgcttagaacagtgccggacatacagtaatcagctctcatgattaatattatttaaaaatgatgactctaaggattaagtgagctgcaggcctggcacgtgggggccctgaatacatccttcccaccccatgctccctctgttcctattaaacttcaactactaaagcggctgcattcccagatgtccagtctgataaacaatgcggatgcatccctaatccctttttcctagattatcgcctttattaaacttcagacttgagtttttttgtaaattactcttccctaccttctttcttagcacagcatggttaaataaatgttatttatatatgtaaatgattaaaatacaagactgggttgattgacaaggtatttctctccatcactaagccctctgtgcttctgtcagcaaaaggggtccctcaagctgcctccagggcaggagcttcagctccttcacactgcaccggaacgctatgttaggtccttaggtgaagccatggggaggaaaatgggaaagctaatttgaagtacatttttaatatctgttacagtcttggaaaaacaactcttcaaagtacctcttcagaacgattaagaccttctactggttctatttgactgattacttacaacctcaaattccatgcatgtaattaaaagacaaacataaaaagcctcttataaactctctgttcttcctgagtctcttttaatgtttccaaccaaacaggctcaaagttctggatgactacggagccaggtcatttcaagtagctgagaaaacctacaggttaatacaggccttatttggaccaacatggtattctcttgccaaaattttatttgcttcgggtttttctatcactgctgcagtttataagataatcttgaggaaagcattttttggaacatgtttctaaaaccatgacaccagtaaaagcaacataaagcaatttttgctctagatattagttcagtttatcttgtacaacagtcctcaattagacttgcagattgccttatttcccctcatatgctggtgacaaatgttttaatttaaagagagaatgccgagttttgttgttaaaattgttttgatacttgcactaaaaggtgattcttttaaattggaatcaactttaagaatgtacaattcagagagtagtaagttgagaaactgaagtttagaaagggagacctcaaaactaacaatttcttctactgagggtaacaggagccaatttacttgaagtacattatttaataagtaaatgcaattatgtctttagaaacgctaaaaactacttacaaaaagctggaggaacttgaggattcttttgtgggtaagtatataaagtgcattcccactgatagggtcaataacgggcaatctgtggattttatttttgatcaaggagtatacagcatcgaagaggctgtgggagaagtcattaaagttgttaggaggctttcgagaaaaatcagaacactttggactacccctgccttaaagcacttccagtgtttttattattgcaataataacagtgttttggaagagttttaaattagagatctcagcaaatttttcatttttcacaatctatgttaacatatctcaaatacaagtgcaagctacaaatctctagaagaggagattttttttggtttgtttttttgagacagggtcttgctctgttgcctgccgtcatggctcactgcagccttgacctcccgggctcaggtgatcctcccacctcagcctatttgagtagctgggactacaggcatgcgccacctttcttttttgtagacatggggttttgccacgttgcccaggctgctctcgaactcctgagcttaagcgatccacccaccatggcctcccatagtgctgggattacgggcatgagcccttgcgcccagccaggaagaggagtttttttaaagagtgtatttagtgattttatttgaaagacgatgaaacctaaatccttagaaaagcaaacagatacatcgtattggcaagagagcaaaggctgtagcagcaagctctctgcattggtgagtgggcaaactggctctaccccgggccggcccggctaggagatattgcagggccaacatttctgttctacttggtccctctcctgggactgccagtaagaaggttgttatacctttttgttaggacttggaaataaaatgaaaataaatattttaatctttctctgtactggatttgagtttgaaagatgcttttacaccaatatggaaatgtatcacagccaaaccagaaggcttggataaaaaaggacgggccagacgactacacagaaggcagcccatgctctcaccacatctgaaccgacatctaacacacactgatgtttaaacgctagtgtggagcagaattgccaagggagttgtttaaatgtgtattcctgggccctatcctgatttagcaggtcaggggtaaaagcccaggaatctgcaatttcaacacgccccccagattggccgagatcttcgtgatggtttagtatgaccctattactagaccattatccatccttagcaccagcaacggctgtgatttttgtagtgttcctagatttactgaatgcgtacagtgtagctggaattaaggaggcaggccctgtttggaatgaagaacatgtttatttgtgtctttctttctatcatggtgataaaacacatacatctgaatgaatgttttcaaagaaaaaaaaaacaagtttaccttgcatctggagatatattcactaaaggcttaaatgtttcttgtaaataaagctctgtatttatagaaagaaaatatgcagttagtaacacatttgctgtttgcagttataacacaaattcaaatacccttcagtttacggttaatagttagaaggattaaaaactcaaataaaaagaaatttaatttgcctaaaactcctgtgttaatcatagttatggctattttaaacaacttccaaactgttttcaggatgttgcatttgaagaaaaattaaatattaaaaaacaatgtgacagtaagtgtttataaaatcaggaaaaacaaagaaatctgataaaagagcaataccagcagaggtcactagaatgctaccaggttcaccttactctcaagaaatgaagcaattatgaaatttaaaaaatcaatttccataagttataagataaaatcagttatgacaaactttgttctttaaatatttttaagtattattttaccaaattgatgctcaaaacctactgcattgtgggcatctttccagcacataaaaactgtttttttctgaagatatcaactgcaattaatttgcttttccaaggtttctttttttttctgagacagtctcactctgtcactcaggctggagtgcagtggcatgatctgggttcactgcaatctctgcctcccaggtacaagcaattctcccacctcagcctcccaaatagctgggactaaaggtgcacgtcaccacaccctgctaattttttttgtatttttagtagagatggggtttcatgatgttggccaggctggtctcgcactcctgacctcaagtgatccacctacttcagcctcccaaagtgctgggattacaggcatgaggtcctgtgcccagcctaattttttttttttttttgagaaggagttttgctctgttgcccaggctggagtacagcagcatcatcttggctcactgcaacctctgcctcccaggcccaggcgagtctcctgcctcagcctcccgagtagctgggagtacaggtgcgcaccaccacgcctggctacttttttgtatttttagtagagacagggtttcaccatgttggctaggctggtctcgaactcctgacctcaggtgatccacccgcctcggcttcccaaagtgctgggattataggcgtgagctactgcgcctggctctaattttgtatttttagtagagagagggtttcaccatgttggtcaggctggtcttgaactcctgatctcaagtgatccacctgctttggcctcccaaagtgctgggattacaggtgtgagccaccgcacctggccttgctttaccaaagtttctatacagaaggcgtttaagaatattttggcattattattactacaaaatatcatgtaatgtcaaaacgtaaacatacttaaaccttggtctatcagtacttgtacagtagaactggacaagaagctggtgttacacaatcactgcacaacagactgtacagatcccatgccaaatttgtttagcttggtttgacaaagccgtaataaaccaaacccatcactcagtgaaacttctaaatcgtatggatttgaaagggcccctgggggtgtaagagaactccaagatgtattctgatttcacagccagctacaaaggttgcttctcctatcaagcatattatgggaaacacagaaccaaactcttcaattttgaattcaaaattttccttcagttggtccctccatttctaccagtgtttccttgagcaccctccaaaggctccgctgttgcagacagactgggtctgccgtgattcccacccccggtcctctccaccaacccaccatgacaagtgtcagtgagaccaccaccttacaatcatgaaatgcgaatttaagaaatggttctatggcagaaaagagtatcatgattttacagggtgaatgtcaatgtgacaatgaagagaatatggtcttcaaattacttccatgctatttgctccaaaccatctagtttgaggttcatttgtcctaagtttctccacaatttgtaaagaaacaattactaggtttaaataagaacagatgcttgctttggttcaagttaggcatgcctctgatgcatttcttaataccaaggcaaatctctgagggcttagacttagtagtgagcggtggccccattgtgggcagcgaggtggggcttggttagctcattcatcttcacattcctggccctaggataaggccttgcctgctgaaggtgtcctatacatgtctataaacagaagggacaatacttatattgttcagctttagtacagtagcatactatcaaaattaacagaaataaagagaatgttttatataacattttatggagcagagagaaaaggatctgcaaaatgaaaacatacttttcatactaaacatagctttcccgatactaaaagattttaaacatccaatagtgcttacccctccatgtttcaattttatgttcctctaattcataaatctgtacctgcaaataaaaaaattcttatttataaatatacatatacaacatagaaaaaatatttggaaaatgaaacaaaacatagcttggataatagcattttctattcgcaattagaaaatgaggcggccaggtgcggttgctcatgcctgtaatctcagcactttgggagatcaaggtgggcagatcacctgaggtcaggagtttgagaccagcctggccaacatggtgagacctcatctgtactaaaaatacaaaaattagccaggcatattggtgggtgcctgtagtcccagctactcaggaggctgaggcaggagaattgcttgaacccaggaagcagaggttgcagtgagccgagatggtaccactgcattccagcctgggcaacagagtgagactctgtctcaaaaaaaagaaagtgaggtgagatatagagaaaaaaatgtatctcaagtttttttttttttttgagacaaggtctcattctgtcatccgggctggagtgcacaagtgcgatcatgactcactgcagcctcaacctcccaggcttaagtaatcctctcaactcagcctctgagtaacttggactacagatgtacaccaccatgcctggctaatttttgtgggttttttttttttttttttttttttttttgtagagatggggtttcaccatgttgccccactggtctcaaactcctgggctcaagtgatccacccttctcagcttcccaaagtgctgggactacaggcgtgagccactgtgcctggcctgtatctacagatattaagaaaaactttgggctgcatatttagacataactgcttttttgcaattttgatttcatattctactgctaagatttcttatatgggatttgctgcatttcacagaaatctatctattcaaaaatcacactcatgctgattttgctagttcaaaagcagagatatgaccactataaggaaagcccgtgttcacttgcattggtaatattgaagaaataatacacttcatgggaaataaatacaggatatttacaaaatctttggtaaaacttcctaagagtatggttgtgtttgtttttcggagacagagtctccctctgtcgcccaggctggagtgcaatggcgcgatctcggctcactgcaacctccgcctcctgggttcaagcgattcttgtgcctcagcctcctgagtagctgggattacagatgcccgctgccacacccagctaatttttgtatttttagtagagacagggtttcactatgttggccaggctggtctccaactcctgacctcaagtgatccacttacttcggcttcccaaagtgctgggattacaggcgtgagccactgtgcccggcaagagcatgttttatgaagaaactcatttttgtatttgatgtaagaattattggataatactgagcattacgcataaagcagtattaattgaattaacctacaccttttaagtaccccaaataggactagttaaataagagtatgcaatcctgtccttccccccaccctcatgaacaaacaaacagaaactaaaaacacaaaaccaagcaggttgaatctcagatatcacaaagttagatgaaggacaaaagtggtttttaagctacgctctttccagaaccattgtactagggaccagagagttctgctactaaaatcagccaggagctgtctcttcctaattagcaggaacatgtcaaaacggaatttatttcactttaatgactcatttttttctgctttaaaatcacaaagtacatataattcttgttctgcaattgctggggtaactgaattaagctctaccacctcaacaggcccgcagagataagcaaaacttacagaacgtctagctaataaatatgtagaattctgctaagccaaggaattccgaaagctgaataaagaatctatttccttttatttttcctgagaattccttctttgagtttcatacatataacttacagtaaagagagttttgtactgaagttccctgcatgttatatagatttggaaaatcaccatcagcacaccataccaaaaaagaaaaaactgaaaacattaaaaatcttaaaatacacacatatacctacacacatacatagatacgtacagctccaactactgacataggaactggtgccacttaccataggtgatttatagtatctatgtagtatatttatgaaatctgtaattgttagcattcctggaacaaagaattacatgttacaaataaaaccatgaaaacatttttaaaaatttcaaatgacaagtgagcctagaatatatgctagaagagcttataaaatatacttcgaagatatcaagcagagtttaatatattatttaaaactattgatgtgttaattgtgtataccaaactggatatacaaatttagctgaaattaaacctgacagtaagtactacggaactaaccagagaatttggcaaatcaatgagagaaaactcattaattgatacaaatttgaaaaaagaattgcagttacaggtaaataattttaagtactttaagataaagtattccgtaagctttagaaacgtgacaattctgggcacttggattgtttcccaagaagcattctaaacacaatggttttaacagttgccatttattgagtgcttttgacgtgctagacaccaggatgatacggatgaaaaagacatgaacttcttccctgatgaaattaaaacctagaagcagacataacgatcatttcaaaataacgtgaagaatactaagagagacaatggcattgtctgctgtgattcataagataagtaacgatggcatttagatagctgtaagttacacaacagttttaacagtataacaatggtctggcagagacatcagtcatgtttacagcatctaatttgccctgtcaaaaaggtgtgcactagcgagatgagtgcggggcccagggatgccatatgccatgtgtggcccaaagtggggcagctggctcacatctgactgtggtgtcctacgtggggtttgttcattgggctggtaaagacacataagctcttcagagagccaaaaagttgctaaattaaaagaaattcaacaacaacaacaacaaaagctccataaaagttacaacagtgtgtagagttctcaatgaggcggcaaaaaaaaaaaaaaaaagaaaaaaaggacaacagtgtttggaccttactagcacgtccaccttcttacccagtatgtaaaagcaaggaattttttttttttttttgacagggtctcgctctgtcacccaggctggagtacagtgcagcgatcatggccttgacctcctgggctcaagtgatcctcccacctcagcctcctgagtagctaatttttgcatgtttttgtagagatgaggtcttgctatgttgcccaggctggcctcgaactgctgggctcaagcgatctccctgccttggcctcccaaagtgctgagattacgggcatgggccactgcaccctgccagcaagaatgttctttaacttggaaacatgtttactaggttgaattccaaaccggcatctattaaaatactttaggctttctgctttcaaggtttccattttcgattttcctcaggcccacactgcttacctacaaaactttgttttttactctcccacagtggcgctgctcggacaccgttggctaccaaagcaaagaaggcctttttaacctgaagaaaaagaggagaaacaaaacatactttcaaagtccaggaagaaaaataccttttttttttgagacaaggtttcactctgttgcccaggctggagtgcagtggcaccatcttggctcacagcaacctctgcttcctgggctcaattgattctctcacctcagcctcccgagtagctgggatgacaggcatgtgccaccatgcccggctaatttttgtatttttggtagaaacagggtttcaccatgttggctaagctcgtctcgaactcctgacctcaagtgatccatccacctcggcctcccaaagtgttgggattacaggcgtgagccaccgcacctggccagaaaaatacccttaacatatttgaccaagtcttatcagttatcttccataataagtttcgtaagtttgataagctaaaaataatggaatttattaacattagcaaaaatctttttgaattacacctaaaggcatacagggattagaaattattttttgaaattgaaataatgcaattaacttcttttttttttcttattgtatctgaagactcttgtctacatacatactttatgtaattaaaaccatacaaaagaattaaacttcagggtctaatatctcctacatgtggttattaattcatctgaaaacactgaagttgtatcaaattacctgaaataaaaatttatttttagtattttcaatgagaaaacaagcatactttctcagttcccaaggttgaggaaaaaaaaaggtatgaaagatacaatatatttttgcattttataccttccagacacaaatgggtcaggcactaacatatcatatctcacttaacactcataacaaatatcttttgggataccataaggtatcatacttgaagatttattaataaccaaaagttcagtgctgaaaatgatcctctaaattcagacagcaaataagtacagggaaaatgtccaaccttattaataacccaagaaatgcaaattaaaacaaagtgtcatttgtagatgctaaataagccgatattttaaagttgcagctcctaatacaagggctattataaaaccactggtggcaccaaacactgagaaaatattttttctaacacagctagtgtcaagaatcacaaagtattcatattgcttgtgcaacagctttttctctttgaattattttaggagtgggattcctgaatcaacaatgttccatgtgacattacttctaatcttgaaaactgaaaaaaaaatccacctctcaaacaaaacttatcaaatactagcataccaatgagaaaaaaaatcaaataataattaacataattatgatgttttcataactatatcaagaaaggtctatgacaataaaaatgtaactgtaaaattatacattatgatacttagaaaaatatgtgtttaaatggaaacaatgagaaacaagcaaaaaaagattaaactgatacattaagaagctgggatagtaaaatgtttctttaaaaaaagtgttacattatggtatggttatgtttttttttttttaactaaaagtaaattattctcttctcactcactactcaaaaaaaaaccttgttggctgggcacagtggcccacgcctgtaatcctagcactctgggaggccccccgagatgggcagatcacctgaggccaggaattcgagaccagcctggctaacatggtaaaacctcgtctccactaaaaatacaaaaattagctgggcatggtggcgcacacctgtaatcccagctactcaggaggctgaggcacaagaatcgcttgaacctgggaagtggaggctgtagtgagccgagaacacgccactgtactccagcctgagtgaagagtgagactctgtctcaaacaagcaaacaaacaaatgaacaaacaaaacaaacaaaatccttgttaacttactaatgaaaacaactgcaggaacctagagcagatgactttaggactaataacttagtacctatttcttcctttattgtgatatattttgccttatgtggaactgctcatgcatgtacctagttcacctacacaagaatatagggactactggtgcgttgagggagctcatcaattatttcacgcatttattttaacccgtccagcgctgagtcctgaatatagcagggattctagacattagtcaaatgactacaagagaatgacgatgaggaaatgagtagagccaacccagtgatgtgggagagcaacagtaactgagcagcatccagaaactcatgaactgtttctgaaacacacctttatcaaaaaggcaccaaaatacactgcttttgtaactaaatggcatccaggaaaggtgtgcccatttgaatggtttgctatttgtaccctgggcatctctgattgtggtcctagaatatattatagaagaatatagtggaaaagtcgcatgtaaatagattttaaaacacactgaatatctggtaagtttgcttttctaaactggttggaatagaatgggaatgggggcaccttttatgttttatttgtatttatttattttttttggagacagggtctcactttttcacccaggctgaagtatagtggtaccttggctcattgtttcctcactgcacccctccccgctgcccctgccgggctcaagtgattctcccacctcagccttccaagtagctgggaccacaggcacatgccaccatgtccagataattttttttcttgtagaggcaggatcttgctatgttgcccagactggtctcaaactcctgggcttaagtgatcctcctgtcttggcctcccaaagtgttaggattacaggcatgagccactgcacctggccaggggcatcttttaaaagcacaaattgcttactgttttcttcaaaatgacagatttagcagagaaaataaatgttaaaaacattcatgaggatcattcatgaaaccctaagtagccatagctattgaaaacctatgccagaaagttctgagtttggcataatgaaacagttgaaaacaactatccaagttgtacaaaagacaggaaacactatttgagggccctggagtgcatcaacacggggtggattctgggagctacaattcttgaaagaaaagaaggctatgcattgagcatcacattcattctggaatttttctgagggcatttcccacatcatctgcacataggtcaatttcaacaagaagctgaaatttatcaagaagaatcaaacaaatcccaggtaagataaacacaaagaaaaccacacctaagcacgtcatagacaagatgctaaaaaccaaaggtaaagggaaaatcagctagagggggaaaagacacattggctttcaaaagggtaacaagcaggctgacggctgactttccagcagaaactatgaaagtcagaagacaagagaaagaaaactttaagatgctaaaataaaaaacctgccaatctaggttagagcatatatccagtgaagatatccttcaaaaaggattggcaaagtaaggttttttggattaaaaaagcagagaaaattgtcaccaaccaaccagcattaagaaatacttaagggaggccaggtgcactggctcatgcctgtaatcccagcactttgggaggccaaggtggggggatcacttgaggtcaggagttcaagaccagcctggccaacgtgatgaaaaaaccccatctctaccaaaaatacaaaaattagtcgggtgtggtggtgcgcacctgtgatcccagctacttgggaggctgaggcaggagaatcacttgaacccaggaggtggaggttgcaatgagctgagaccatgccactgtactccagcctgggtgacagagtgagactccatctcaaaaaaaataaaaaatacttaaggagtcctctgcactgaaggaaagattctagacctgcacagaaccgtaggagggaacaaagagcacaggagagggcagagatgtaggtgaacataaatcaatactgcataaagccagagtaatgatatcctgtgggattcataacttatatagaagcaaaatatataacaatagcacatagggtaggagacggtttaacttttgtatacattttttgcattgtttgggacttggtaaaattattattaaaagatggaaagtagtaagtcaaagatgctatgtaatctgtaagacagcctctgaaagatcaacaaaagaatgtataactaagttcacatgttctcatccatttgtgggagctaaaaatgaaaacaactgaactcatggaaatagagagtagaatgatggttaccagaggctgggaagggagggtagtgggggtgggtgcggggaggaagtaggggcagttcatggataaaaaaatgtagttagatagaatgaatacggtctagtatttgatggcacagcagggtgactacagtcaacaataatttattgtacatttaaaaataaccaataattgggatgtatgtaatgtaaagaaatcataaatgcttgaggttatggacaccccatttatcctgatgtgattatacaatgtatgcctgtatcaaaatatttcatgcaccctataagtatatacacatactatgtacccataaaaatgaaaaaagaatgtataactaaaaagctagcagaggagaaaaatgggttaaacatagtttgttaaatcgagtgaagaaggaataaaagaacaaatcaatagaaaaagtgaaaaacgcatagcaaaatggtagacaaacctaactatagcagtaactgcatgaaatgaaaatggactaaacggtaattaaatgctattctaggcatttattgcatggtttaattgcaattgtcaatacagaaagtaaacgaaccttgtctatgacctaagtcctaggatcctatcaaggactgcctttctctaataagggccaatgagtccaatggatctaaaccatagatgagaccacgtgagagccaaacaagagggcttccttcagtggacacatttctagaagcttctggcagagactattgtatccagcttcaagacataaatgactgagcacagtggacatctacacacaaaaatctctggtcaaatagtgtaataatttaaaaaaacccaagaataaatattgctattagcttagtttgtgaatattttgatattttgatatttaatgtttacaccttgtacaaatgatcacatatagatccaacagatttaatggacatttttacactacagtgagcctcatcacacctcaggcttaaaagaatgataccaacaaaagcaggggtttaagtttaacactcaaatatgatgattattacttcagactcagaaaaaaacatcctgcttccccataataaattctcagactaatctgctacaaaagcgttcagcccccaaaatgctgcagatactgtttacggtgaggccactgtgaacaacacaaacaggaaataactgcctaacaccaattcttaaggtggcaaatacatgtatgggaaagtatacggggtaataatacagacgttagaaactgatcacgcgtgctgaatcaagttaattctgagatgaaagacactgatgctgcgtggtcaatggcagggagggatggagggaggaattaattaatttcagacagtatcggtccaacagagggatcgatgtatgtatgtacgtatgaatgacagggtctcgctctgttgcccaggctggagtgcagtggcaggaacatggctcactgcagtctcaacctcctgggttcaagtgattctcccacctcagcctcctgagtagctgggaccacaggtgcacaccaccacagctagctttttattttgttattttttgtagagacagggtccggttatgttgcccatgctggtttgaactcctgaactcaagtgatcctcctgcctctgcctcccaaagtgctgggattccaggggtaagccacctcccccagcccaatggcaaggtttatagagagaaaagccccagtgaagcagcagttcaatggcaaagagaacgttaagaatttaacgtgcaaagtggtatctcttctgcaacagaagataaaacaaccaaggctcacggaagcacgtggagtgaattaagaggccatcccacttcttgtcaacgagctaaggtgctacacctactggacttcaacttctcgttttccacataaaatgtgtatctctacagaacagggacactgcttcatttctcaaactgaaatcataagcacagcagctcacttcgtttttctgatggcctcaagcaccaaggctttctcgcgggctccttggcccgtgccagctgtgtggtggctgctcagtcacttaaccctctgtgagcctcaacatgctgttataaaatggggctaatggatatttcctcacaggtgtagggtgtggattgaataggctagtatttgaagatgttcagtatggtgctcagcactaacagccaagaagaacaaatgcttaaaatttccagtctatactgaccaaaccagaagccaacagaaatttcttctttttttcactttggagacagggtcttactctgttgcccaggctcaagtatagtggtatgatcacggctcactgcagcctcaacctcgtaggctcaagtgatccttatgcctcagcctcctgagtagctgggatcacaggcatatgccaccatgctcagctaatttttaaatctttttgtagagatggggttttgccatgttgcccgggctggtctcaaactctaggcctcaagtgatcctcctgcttcagcctcccaaagtgctgggatgaaagatttattcttttaatttcatccacatacactgttgacctgtccgcaggtcactgaggaagtctcaattccatccttcagagatctcatataatattccaaacggacatgatactcgtacaatgcattaaagagcagtgtcctgggtgagctcgggaggggcctgacgcttctgtggttttgccgaccttctttgcaataacgaggccttctaaaacttggctttcttaagaacacgtgcatggagctgtttataaagcaatttaaaatcatacttggaaaattctccataattatagacggcacagggtgttccaattaaccaataaacaggatacaaagaggactaacacaatctagttctaatttgcaggaagaaaccgctcagggatcttgagtacctttgaaaatttctttccttttaactgatacgcaatttgctcaaactatgattaattttaaagtttacattttaataggattttcaacacatttcaaagcaaatgtgataattagataagaaaagatgggaaataaaatgttcataggtaagtttttagaatagtgagcaggcccgagctgctctaagagactctggcagtctataccaaggagaacatctgtgttccccagaatgggaagctggttcctctgatgcctcactgctttctacacagcttcactctgattttcagtaattaagttgactgtgaagcttttaaaattaacgctgatatctactgcgtcaagaagggtccagcttctgaaatacggtcgtcgagactcttctccgtccaggcccaggcctcccttgccagctgcatgactccctcctccctgaactcatcttccatgcccctccaagccccagtactccttcgacttcagaagaacagttgcccaccattgccatggaaggactgttttctggaggaaatgcactgctccagaaataaaacagacataggaacatggggcctccaatgaaaaagatggctggcttactgctcttcagtgaagcccaccaagcaagaagcccacctgtgaacttggtatgtccatgccaactgttagcagtcactcttaattatgaatgaatgggcagccatctgacagggccttgaacgctgaagtcacacaagtcccagttttacacagatctcactagaagggttaggaaaaaaaaaatcttccaaaaagtggaatgaaaagaaaaattgaaaaaacaatgggaaaagaatattaaagatcaactcgggggtctcagagctgctcactgaagttccggagaaaagcaagcactgggaagaaaatgattgaggaaagaatgcaaggaaggctaggcacagtggcttcgggaggccgcagcgctgaggatcgcttgagcctcggggttcaagacccagctgggcaacatagcaaaaccctgcctctacaaaaaataaaataattaactgaatgtggtggtgcacgcctgtagtctcagctacttggaaggctgtggcaggaggatcgcttgagcccaggaactgggggctgcagtgggctgtgactgcactaccatactccagcctgggtaacacagtgaaaccctatctctaaaataaataaataaataaaaattctaaaaaagaaacaacgcaaggaccagagaactggatactaggagtgtcaggttctagcgggacgtcacctgcccggcaccatgaactgaccacaagacacatgatgatggaattttagggtaccaggtagaaagcgagagccacaaaagcttcagaggggaaaaataaaatcatatataaaggctggggattttaaaaaagcatcaaatttctctcgatcagcactggtagctagaagaaatggaatgatattagtaccttcacaattcttaataaaaatgatttctgttatagaattctagacatagcagtctacaggttgaacgtaagtgatatataaaatttcaagtaatacattcccacgcatcttttcttgggaggttttatggactcagtgtgtttggttcaacggctcaacaggttgtttctgtggaatatgacaagagtaaggcacaggagcaagagactatgtctttattgtcagtttttttggtaccacttgacagaaattgttaatatgtgctttgaaaaactctcagccactagtctgctctgctccagcacattcccgagcacgagcccatgtgtggcagggcttgccattctccctccctgttctcagcccgttttcatctttttagaatattcacatgctctcatctcttctgtccttgatgccatatcaagtgatcctatgtataaattttgcctactgaggaatctttctgcgtttcgattattatcagctatcccacctggtttcaagtcatctgtaaattagatgatgccatcaatgaaatcaatattcaagtcattgttccaaagctgaagagcgtggggcacaagaatgctctggcgtacccccagtttctcagctggggctccccagaaggcagagtgtatttgggaatgtgatgccagggagcagaagtacaggaagggaggaaggagacgggtgggcgggtgagtcagcgcaggacgcgttcctgagctgccgccgcagagcccactgatgctgatgccagtgggatcttcctaggactgcatgtagctgctagcttctatcctcccctggcggaggaagctggggtacatgggatggtcctgggctgagggccgtcccactgcccctgcacagagtgaggagtgctggactatgagttgatgtgaatggatttggaaatggcccacgagaggcatccaacacaattagaaaccttgctccaggtgttgactgagatttaaatattaattgatctgcttggctgccaagctgcagctctgcatctcatcctctgggacctcgtgccaggctctgccagcctactctagctggaatccagacgtgcctgtcatggcacggccgtctacgcaacagccacaaaagaaaggcaggtgaatctcctgtaaattttttttttggtcaattcatgaccgattccattcattcataaatctcagctgggattgatactacattccccagcctctgctttttgagaaatctatctgctctttccttttatctctggcctccgaaatcagacctcttctccgcaactcctccaatatcacgaacaggttaggaatctcctttgtaagttccctttaatgctagaatgtgattcatctggatcagaaatgagatgtggttcatgctgacaggtgctctccgcaactattgtgggctttagtttcctcgaatcactattactttacctcttccactttgaagatcattttccttgataatgaacaaagtacagtttgagctgagcagttctgttttctctttattgacatcagcagcatcagcctggaacaataggaccggggcttctctttccttcctgcttttaaaataatcaagcgccccttccctttgtgcctcttaattttaacactaaactaggattgtcctgggcagctccctcctattcaagctttccttttactttacttttgatcatgtgctctgcattctgtattctctactcattcttcaaggtgggtggatcacttgaggtcaggagttcgagaccagactggccaacacggtgaaaccaagcctttactaaaaatacaaaagttagctaggcgtgttgttgcccgcctgtaatcctagcttctcgggaggctgaggtgggagaatcgcttcaagtgagccgagattgcgccactgaactccagcctgggcgacagagcgagactctgcctcaaaagaaaaaatagtgcttggcaaacagccacttatttggatacttgcttgtttttttgttggcattattcaaaatcacattgcctggaataatgtaaagaacaaaatgaagttgttctggattataacccaaaaataaatatccataaatccatactgaaatagatgactgaataaacaaacagatggagaagggacaaatctcccttgcagaaaaatcccaactaactcacgtagctgctcagccctcacggaggtgaagcgtcactccccatggctaagtgtgggctgtacgtggtgacttccttcttgggactatggcatggaaaggaggaagaagaatcatctcatggtggaaaaacctggcacacctcagccaggtaatggagagtggtaagtcacacaggcagtaagcaccctggagacggtatgatgaaaagggcactttacctctctctggtctttctcctccaaagccacatgcccagtctaatcatgataaatcatcatgcaaatctcagtagagggcattctggaaaatacctgaccaacactcctcaaaaccgtcaaggtgtcaaacacagggagtacctgtctgagaagctgtcccacctaaggaggcatgatgacgagacgtgatggggtaacctagatgggatcctccaacagaaaacggcattatgcaaaaactaaggaaatctgaagaaagcatggactttagcaaataaccatgtatcaatattggttcattaactgggacaaatatagaccacactaacgcaagatgtcaaaattcaactgggtgtggggtatatgtaaattctctgcactagctttgccatgtttctgtacatctaaaactcttataaaacacttgttaaaaaaaaaagctatcatttgtagagtattgctaaaagaagttacattgccactgtgaggaaaagcctggatcattcctaatgcttccccccaccaatcctagggtgtgaggattccattatgaagttttatttatttttgggcctctcataattctcgaggtgtcatcttttggaatcactaactgatgtggtttggctgtgtccccacccaaatctcatcttgaattgaagctcccataattcccacgtgtcatgggagggacccagtgggaggtaactgaatcatgggggggagtctttcccatgctgttctcatgatagtgaataagtctcacaagatctgattttttttttttttaagacagattcttgctctgtcgcccaggctggtgtgcaagtggtgcaatcttggctcactgtaacctctgccttctgtgttcaagcgattctcctgcttcagcctcccaaatagctgggaccacaggtacccaacaccaagcccagctaattttcgtaattttaggaggacggtttcgccatgttggccaggctggtctcaaaatccaggcctcaagtgatccacctgcctcggcctcccaaagtgctgggattacaggcgtgagacaccgcacccagcgatctgatggttttataaagaggagttcccctgcacaagctctctctgcttgccgccatccatataagacatgacttgcttctccttgccttccaccatgattgtgaggcctccccagtcacgtggaactgtgagtccattaaatctcttttcctttataaattacccagtctcaggtatgtctttattggcagcatgaaaacaggctaatacactaactgatacctatctttctctgaattcctgggcttatctggaagggaaggggatgtcccccctctctactgtgccagtcatgaagttactgtctctctgctccatgcccatccctctaacttggcttggtgatgctgggactttgcagaccctgtttcggtgttgccaactggctctatttcaggttctgacaatacaggagtctagggagggactcaaagccagagcaggaagaagggcttgctcctcccgtcagcggctagcagggctcctgtctgcctgcagctcccgtgagctccacccaggcactgccttacctgggcaccgaggcacctcctgtagcagcggctgaatacagtttgttgttttcccattttgtgcaaaatgagcttcctcaagccccaactcccacccagagacataagcaccagctagaaggcacgcgccaggaccccctctcctccacgacactgtggagtacaccagactcacacagcatcatggtgaaacatgggtcactgagcctcatccccccgttttggattcgggtctcagattgggtctgatgagctgcgtttttaaaagttccagctgatgctgaagctgctagtctgggaatcagactttgagaacactgccttagaggtctttatttgtcctttcagttaccagttaatttagatccagttaacatttgcttatgttctttttctgttcaaataactggtgtggcttctgtctcctgactgaaccttgactgatcaagaaactggcaccacggccgggcacggtggctcacacctgtagtcccagcactttgggaggctgaggcgggcaggtcaagaggccaggagtttcaggccagcctggccaacaaagtgaaaccccatctctactaaaaatacaaaaaattagccaggtgtggtagtgggtgcctgtaatcccagctactcaggtgggtgaggcacaagaattgcttgaacctgggaggcagaggttgcagtgagccaagatcgtaccactgcacttcagcctgggtgacagaatgagaccctgtctttaaaaaaaagaagaagaagaagaaaaaagaaactgccaagactggttcccaggaacagaggacttggaattggtttcccatccatgggtttaacacagtgttgagctctttgtcagtgggaaatcagattcctgtaatccagggcaggccatggcattgtgactaaaaaagccatcatctgtgcctgtgatgacatttgtgtgccagggcccacatggccactgcactggccactgaggcagaagccaggaccaaaggactcagtatgacagcattctgtgagtgcgctggggcctctgagaaaacctcaagcccaggtctgggacctgcacccacagacagagaacccaacaagcctctatggcagtccccagagagtctatttcttgtagctacagggctgtttccaaaatcaaacacaaagcataactctgcggggtgtggatgcacaggcggaattggtggcatcaccaggtttgatgggaaagctgggcatggatctggaaggagtgggaccctggcaccggacagagggacatctgactggactcagatgaagctgagattccagattcgggagttcctccgagcctcccatggcagtgggaacagctggctccccagtgtctgagaatcacctttctttactcgaaagcccagtgacaggctttcctagggcagacgcctagcgtgggcctctcaccctcccacccttgccaccccttgacctgtaactggggacaggtttccgcatgctgcaggggaggaaaccacttatatgcaaaacaaactgtgagatcttgccatttcacagctgcagaaaccgaagaagtatgtatgggaataggtgctagtaacgttaggacaaagacgagaaatttaacactagtttggtgggactgattgctatgagtggtcttatgagaaattgttcattaacattttgtgcacgcagccggcagtggctctaaccgctcacttggttgactgcctgaagtgcagggcactgctgagtccgtgtttaatgaggctgagatgccaggcttctgtggcacagtgaactatacaggaggaatccacaggcttcgggagacaggggcattggcacggatttgtcatgtgccacctgcacattccatacccagaggacactccctcctggagcccctgaggaatgtacaggtgaggggccccttcaataggaaaagtgaacttgtcactgcagcagctgttcccaatgtagtatcttgggggacccacagcccctgcctggacacatactccttttctctataccaatctacaaggacccctagacggagtctgctttacctggcaacaggatactttcacccgtgtgtctcaaggctgcggcacccccgctctctaccttattatggtctgcagagaagctggccatcttcacactgcacactgccacactggcccatgcgctgatagcggtgtgggctggactagacaggcaggaagtagcagagctctaggtgcctctgtgagatatgtgccgggcagagcatgagggacagaccccgcagaaccgggggtctcacaccccagaacggcctgaaacactggagacacccctccaatgggagcttcaagttgtcactccacactccacctgccactgcaaccaccaggcaggtgttttggaggcaacatgcaccacatgtgtacgtgctactctgacaccggtactgagtgacactaaaagctgttttcagagaggcccagggcacgatcaggcatgtggcaagtccaggctgctcttctgtgtggccttaggacccagcaaggttgatattaggggtgctgtaggaagcctccaccaaaaggaaatttacagagcagacattgagggttttgagggaagattaaccccaaaacaaccatgccttctcctgcagataatgactctcccgctgggaaacagttcctggccgactgcaccaggcccttatagagaccaaacaagctagccacgagatgcggagaccatgcaacctgagctccccatcacgaacagggaactactaggccccccaagccgaatgctgagcatgcacagcgaccctctctcgccaggccgagacggggctcgcccaggcctgtgaagtacatggacactgcatgggtacatgatgcagctgctctgacaccggtgcctcccctacctcgatccacacccagactcgggggagctccttatgagccactgactgatggagaaaaagctgggcttggtttacaggtgcttctcctgctgggctggcccctgctggcactgcacagtgtggctcttgaggacagtggggattacatcccccagcaggcagacctcccagttggacatttgatttccactttatcaggactgagatggccaggacatatctacatggatccccagggtgattccagtattaaaccgaggggaatctcatggaacccaactgcagggagtccagtcggcctctcaagagaccgaagatggaagcagaaaagccaagcccgagactgctcttccccctcattctggtggcacaccctcgcattctgctctcctctcattggctctgttctactcctgtctgcgcacactctttcagcttccctgcaagtggctcgccttggtccctagagcagttacggctctgatgacgtcgtatcctcagagtaacgtggtcattttgagtactgttctgcagcttactttttcttttcctaatcaatgaatcaatgaatatactcttgacaaacattttctccattatgcagtattctattatatgcctatgcgaggatttatttaactggtctcttaggttgttttgggtacgcggctattttgtttgctttcttagctcttgagggtgtgtcaatggctattactgcagcctgtgtctagaaaatactcaaatcaccccttttcaaatacatctttttaccttgacttaaccaatgccaaacaactctctccccctatttccatggtaatgcatctcagctcctctcaacttagaggctcacaggataaacggcttcccggagatgatgctcacagctcctcttaattacggaagtgatatttactggatcagtcaccttggacatccataaggcattgcatttttcatgtattactcacttgactttctctagggtttagccaaaatgagtaatacatggaaagctgggtaaaagtcaaatcagctgttacttgttattattattttttgagagtcttgctttgttggagtcttgctctgtcatccaggctggagtgcagtggcacaatctcggctcactgcagcctccgcctcctgggttgaagcgaccctcccgcctcagcctcccgagtagctgggactacaggtgacttctaccacactcggctaattttaatttttgtattcttaacagagacggggtttcaccatgttggccagggtggtcttgaactcctaacctcaagtgatctgcccgccttggcctcccaaagcgctggaattacaggtttgagccactgtgcccggcctactgtcgcttatttttaagttggtagaaatgccggtggtcagaaaatctggtattttaaaaagtaaaccttctgggggatgggcgtgaggctgaaataggttgagccagtagttcctttattttgggaattcagaacttctcattattttgttattgaaacatgtagtcacagttctcgagaccgcatctcttaaaacaactgcctactgttttccctactataagattgtatttggatgcttccttctttgtgtcaaataatcaagaatcttagggttttaaaagtgactctgaaggttacctggtccaaagtgaactcagcaaagaacataaagccaatttgcaaaaatcaattgtatttccatacgttaacaagaaacaattggaaaatgaaattaaacaaaagcaaagtcatttttggtcatcctgtaagtcctgggtggcaggcacagaatacaggtaaggggctccaagagcccggggagccctctgaggacgcacggcaggtgtggggcatgggaacagaagcaggccacacctgggggtccctggggaggtctaaagggcctggtggagcaggaagagcctggaaggatcatctaaggcagggctatgggagggggtggatacactccagggcacctttcagctggtgctcccgaaggctcaggctgaggcagcccttccagggcccttgctgggtgtcttcccctgccctgctcttcctctgatcccttcatgcttcctcctgggagtgcatccttcataaacccatgaattcttggtttagcatttacttctgaggaactcgactgaggacaatcctacttggaaaatatttatgtagaaacaatacactaaatgtatacgcacagatatgtgtgtagacacccatttgattacactgaatgtagtttgatcacggtattgagtatattatttaggactttttgtatgtgattataagttacattgatataaagtaagttgcaatacgcataattttaataccaaaatgttaagattcaaattttctgggaaaagagatcggtaaggttcttctttcaaaagattgcccatttttgtgattttcttcttttttaccaatattatttcaaatttatcatatgttctactaaataactaagaaagaccatgaggatatactgagcgaggccatacagtttaataatgaacagcttaggttctaacacacattagacaggcctgtgttcaaaaccccatcttgtactagctctgtggattaggtccttaaattccacaacaacttgtggactaagctttctttttcttttttttttgagatggagtctcactctgttgccaagctggagtgcagtggcacaagctcggctcactgcaacctctgcctcctgggttcaagcgactctcctgtctcagggtcctgagtagctgggactacaggcatgcaccaccacacccggttaattttgtatttttagtacagatggtgtttcatcacgttggccaggctggtctccaactcccaacctcaggtaatctgccagcctcggcctcccaaagtgctgggattacagacgtgagccactgcacctggccaaagctttctgacttaagttcttaaactctataatttgagcttccctgtctttaggaagaagacagtaatagcacatttcttataaggttgccaagatgttgagaattcagataaaacctcagcacagtgcccgatagtgcaaaggactcaataaacgtttgctggcattgctggttttaaattactgtataaagtagtagccatccaaaaaataccaaaaaattcatgaaaatggagtacacttacttgtaatgtagtatcaaagacaacaagctttgaactggttggaacgatgtcataacacttgtgtgacctcatgaatcgcatgtaaacaccactttctgagtcttctactgctaaaagaaaaaaaggcaaaacatcagtaataataaagaattccctcaatcggatgaagagcatatacgtaaacctatcactaacagacttaatggtaaaatacgaaatgttttcccagtatgatcaagggccaggcaaggatgctcactctcactaattctatgaacactatattggaggtcccagatggtgaaataaggcaagagaaaaaaatgaaaggcatacatgttgaaaaggaaaaagcaaaactgtctttatgtgcacactgtatgattttctacataggaaataccaaagaatctagaaaaagttcctagatctaaaaagaatgagtttagcagggtcatagaattaaatcagggttaataaaacaaagacaaagctaatcgaatggggaaaagttggaagctttcccttcaagatctggaacaaggccaggtgcattggctcacacctgtaatcccagaactctgggaggctgaggtggaagggtcacttgagcccaggagttcgagaccagcctgggtggcatagcaagacccagtttctacaaaactaataaaataaaataaaaataaaaataaaggggaaaaaaaagaccaggaacaagacaagaatgcctgctgttgctactctgttcaaggtagtactggaagtccttgtcagagcagtcaggcaagacaaagaaataaaaggcatccaaatatggaaacaaggaagttaaattgtccctgtttgcagatgacataatcttatatatggaaaaccctaatgactccatcaagaaactgtcaaaactaataaattcagtaaagttacaagatataaactcaacataaaaaatcagtagcatttctatacactaatagacaactatccgaaatagaaataataaaagaatcccatttacaatagctacaaaaaaacaaaatactcaggaattaatttaactcaggaggtgaaagacctctagagtgaaaactataaaacactgatgaaagaattgaagcagaccaggtgtggtagcacgcgcctgtaatcctagcactttgggaggctgaggcaggcagatcacctgaggtcaggagtttgagaccagcctggccaatatggagaaaccccgtctctactaaaaatacaaaaattagctgggcatggtggcacaggcctgtaatcccagcttctcaggaggctgaggcacgagaattgcttgaacctgggaggcggaggttgtagtgggctgagattgcggcactgcactccagctttggttacaaagtgagactgtcaaaaaaataaataaaaataaaaaaaaagaggaagaattgaagaagatacaaataaaagggaagatatcttgtgttcatggattggaagaatattgttaaaatgaccacactatccactgtgatctacagattcaatgcaatgcctatcaaaataccaattcttcgcaggacaagaaaaaaaaaatcctaacatttgtatagaaccacaaaggaccccaaatagccaaaagaattttgagcaaaaagaacaaagctgaagatatcacactacctgacttcaaaatgtactacaaagctataataaccaaaacagcatgaagctggcataaaaacagacacacagacaaagagaattagaaagcccagaaataaatccacacattacagccaaatgatttttgacaaaggttccaagaatacacaccgggcaaagggtggtctcttccataaatggtgctggaaaacctagatatccacatgcagaaaaatgaagctggactcctatctctcatcagatacaaaaatcaatggaaaatagattagagactgaaaatctacgacccaaactacgaaactactagaagaaaacataggggaaatgcttcatgactttggtctgggcaaatattttatggataaagcctcaaaagcacatggaacaaaagcaaaaatggacaaatgggattatatcaaactaaaaagcttctatcctgcaaaggaaataatcaacagagtgaagagacaacctacagaatgagagaaaatatttgcaaactatacatctgataaagggttaatatccaaaacagattaggaactcaaacaactcaacagcaggaaaaaaaccccaaataatctgattaaaaaatgggcaaaagaactgaatacacatttctcaaagaagacatacaaatggccaacaggtatatgaaaaaatgtccaccatcgctagtcactggagaaatgcaaatcaaaaccacaatgagatatcacctcactccagttagaatggctattataaacaaaacaaaacaaaacaaaagatgagtgttgctgaggatgtggacaaaagggagcccccccccccgctcttttattgaactattggtgggaatgaaatataaattagtagagccattatagaaaacagtacagaggttcctcaaaaaattaaaaatagaattaccctatgatccagcaatcccactaccgggtatatacccaaaggaaatgaaatcagagtgttcatgacacatgtgcactgccatgttgagtgcagcactattcacaacagccaagacatggaatccacctaagtgtcgccaaaagatgaatggataaagaaacgtggtacctataaacaatggagtactattcaaccataaaaaagaatgaaatcctgacatctgtgagcacaggatgaacctagaggacactgtgttacatgaaataagccaggcgtggaaagacaaataccatcccattcatctgtggaatctaaacaagctgatctcacaggagtagaaagtagagagtggttaccagaggctggggagggaatggggtgggggtatgaggagaggttggtcagttacagtcagacaggaggaatgcattctggtgttctattgcacagtggggtgactatagttaacaataacgtattgtatagttcaaaatagctagaagggaggattttgaatgttcctgccataaagaaatgatacgtgttttaggtgacagatatactaattatcctgattttatcagtacacaatatatacatgtactaaaacatcaaactgtatcccataaatatgtacaattatgtgtcaaccaaaaataaaacttaaaaaaaggaaaaaagtacaataaagcaaatgcaaatagaaaaaaaaggctactatatttgtatctactaactcattgttagcagacagaaatttaaaaaaattttaaaggtactatttacataaatgctgtatggaaatacggacttacacagggaacagagagcactgaaaatggtaacaatgtggacaaatatacaaatgctttcaaaaattatttaaatctctctaaaagctaattgacaatttatttttttatgtattttttttttttgagacagagtttagctcttgttgcccaggctggagtgcagtggctagatcttggctcactgcaacctctgcctccaaggttcaagagattctcctgcctcagcctcccgagtagctgggattacaggtgcacaccatcacacctggctaatatttgtatttttagtagagacggggtttcaccatgttggccaggctggtcttgaactcctgacctcaggtgatcttgcatggctcggcctcccaaagtgctgggattacaggtgtgagccactgtgcccagccctaactgacaatttaaacaaaaataatgacaatgtattgtggggttgatagcacactgataaggaaaaggcaacaccgtccaaccaatcatggaaatctaggagtcacccttgccaatgtcctcttgtcaccctaaccaatttatcacaatgccttgattttgcaccccagaaccctcaaatccactcatttctctgcctccatggccaccccctacatatcctaacttcctcaccaatccttctgccccctgcatcttccacagctgtccacactgcatccaggaagattttgccagatgcaaatataatctaatccagatgctttagaataaaggcaaaacccttgaagtcacctagaacagcagtccctaggactggttttgtggaagacaatttttccactgggggtggtagtgggtggtttcaggatgaaactgttccacctcagatcatcaggcaccagattctcatcaggagcacacaacctagatccctcgtgggcacagttcaccatcgggtttggactcctatgagacactaaagctgtccctaatctgagaggatgcacagctcaggccataatgctggctcacccgccccttgcctcctgctgtgcagcccatttcctaacaggccagggaactgtactggttcatggccccaggattggggacccctgacctataagacctgggaggcctggcccccgcctacctccctgcctcttgtattaaacactcctgctccgtattttctccaaccccctatttttttccagtcctccatcagtgctctgctgtctcttccatggggcctgacactactgcttcctctgcctgaaatactttctccgtctgtttgtggcccagtgaactccttcattagaccttggctcaaggatatgactggtgagtcatggaacctgaatttgaacttgaagcctctggattccaaagctgtgttctcagccaagctgatccccctccttccctcggcccgccacaactgctttccccgttctgccgaaatccttccctattttcatgggtcagtccaaattatgccatctgcaagagacatccttgacagctccattcagcccacaccgatctgtgcattttaggaagatctggactacttgggaaatatctgagaagaaaaacatgtagtgtataagctaattagcaaaacaagtgttaaacaagtgatactaaccaagctctttggctgtggaaaggagccccacaattttgtatatttcctactgtggacatccatgcagctggtttgccaatttcatgacaaatgatgtggaccactctcaagtctattttcattctgacctctctttgggatattacaatttataatgcagagttttgtcactgcaactgcctcctggatatttctctctcaaatgtctccctcctgatgtggaataaattccagacgtctcctgtctcattcatgcatctccacatctggcttctccgcagccttatttcccagctcctggtttcatgtctaagcaaacggtctccctgtcagtctcctgtagcctttgacctctcccttcttgcccttgttcactcacttgccttaaacgtcctcctccttgacttttccttgttcaatttcaatccaacctcaacggacatcttttcccacaaaagaagtgaacgtctgagtgctcattacggaccaggtactgcaataaatcacctcacttaactgatgtgacaacctcgaggaatacagcttcattttttcattttacctctgaggaaaccgaggctaggagaagctgcgtcacttgccccaaatcagacggtgaagtagtgacccaagcgggatttgaagctctgtcccaggctccagtagctccttattaaactcacttccctcactcaacggtgcgctcatctgagcgcacctggggaggacccctgtgtcctgggccctgtcctggggttacccacagggggacacaatgaccggttatccaccctcaaagcttatgcatcagcccagggtgagcactggatcacctgagaacacacaggtgggtcaccaaccctgacctggaaagggtaaggaaatctaaaatgacttcttcccctgaacgccaacagcattttacttctgtctcatcagttattaccttctatctcgttaacagtgactgtgtatttctaatatttttttccttcctgggtgataatttatttgaatgatcagtatcttactcaagtaatccatacattaattcagtctataaatatttattgcatattgtctagtgtgcattcctcccaaagctgatcctgagaccatggaaagttaggggaggaaaaattcaaaagaaagggtgcccagtaagcaggttataccttcgtgaccctggagtgaagctatgagggaggatgctctgaggctgtacagacctcagaactgtctcgtgggaggaccactcctgccctgcctgggttccaggtaattcctgggacatcacccccgtcatttctacccacaagcccagttgccaaagaatgtcctggggcagagatgttgaaatatgagaacttggatgagacaggattctggtgaggcacccgcagcatccactgtgcgagaggcggggatgccgcagggaagacaacaaacacaacccttgtccttacagacactgcaaaccaatggaggggacagtgactgtcatcacactgccaccagcactaccaaggacaagctcggggttcgtgaatgaatagcagcggctgtcagggagggaacggatggacagatgaagtttcagttggtgtgctcccatgtttctcaaaacactgatagactagacagtgagggccctgcttaagaaaggcctgaaacagcaagctctcatgagagcggcacagagagatctggtccgtgtccgccatcgctgctaaggatgacgctcctcgcgcagccgcatgcgcagtctcctcatgcctactgagtgtggaattggcgcaaaacaaaagccaaagatcagggcagtcaagcatacattcagccagtatttaagttacaaattgcctgccaaatctaacatcctaaaattcaaaagcaagaaatcaagagggaggctaagtatagtaaaatgtaacaaaccatctcccagaaaggaaatctcagaagataattttgttcattcattaaatcaagaattttcataaaagaggtacacatattatagacatattatacatgttagtattactatatgaatatgtgaaataattgaaaataatatagggcaggaatgttcaaacttacagaatttttgaaaatctgtaagtttggtgttagattatatttttaatataccattttaatgtgttgatttctaaattatttcaatgaacattgtattttgaataaatatatgttccagatttacaaaaaagttgcaaagctggaacagttcctatatactccatatcaggttcccccaagtttatcatcttacgttattgatatggtttggcttcgtgtccccacccaaatctcatcttgaattgtagttcccataatccccacgtgccaagggcaggacctgctgggaggtgattggatcatgggggcagtttcctccatgctgttcttgtgatagtgcctgagttttcaggagatctgagagttttataaggcagttttctctgccctcgctctctctgttgcctgctaccacgaaagacgtgcctcttcccgttcagccatgattgtaagtttcctgaggcccctccagccatgcagaactgtgagtcaattaaaccgctttcctttataaattacccacccagtctcaggtagcctatttaaagcagtgtgagaacacacggtttttctcagtctttgggttacacagtttcattctcatcatcacacggaggcacccgctccatactcaccacacacggaggcacacgctccatactcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggagggacacgctccgtcctcaccgcacacggaggcacccgctccgtcctcaccgcacacggagggacacgctccgtcctcaccgcacacggagggacacgctccatcctcaccgcacacggagggacacgctccgtcctcaccgcacacggaggcacccgctccgtcctcaccgcacacggagggacacgctccgtcctcaccgcacacggaggcacccgctccgtcctcaccgcacacggagggacacgctccgtcctcaccgcacacggagggacacgctccgtcctcaccgcacacggagggacccgctccgtcctcatcatcatactgagggtacacatgccttctcatcccatcctatccagggtgcctaaaatcaacgtgactcatcaccttaatcacctgagtgaagtcatatttgtcaggtttctccaagtagaggtactctttccctcctcctttatgtactgtaatctttttaagaaggtcactaggacccctcacttaatggcaaggagttatgccctacctccttgtttaaaataattatgtacaggagagttatttatttatctgatcatttattcatatcagtgtagactcatggatatttacttcaacctaggtataatccaatcctaggttaggagcggtcagaggctgtgccccagccagtcaggcacccacctgtggctgatggactggtgggtggcttgtggagccctctcctagttaagacagtttccaagcctgccatggcttagactttctggcaggtcctccagcactgccttcacacacaggcagccccctagttggctggggagctgtgggagtgtggcttggtgctccctgcgtgggcttcctccgtcatccagggaggtgtgcagagctgggctctcctgcctctgtcctgcatgcacacagcctccagggcagctggaaatgtgtttccccatcatcaacatcttgcattagcatggtgcagcggttatagttaagcagccaagaaaatcataatgaatgtgtctaggtacagtggctcccacctgtaattccagcactttgggaggccgaggcaggaggagccctggaggctaggagtttgagaccagcctgggcaacatagtgagatcccgtttctacaaaacataaaaaaaattagccaggtgtggtggtgcacacctatggccccagcctactcaggaggctgaggtgggagggtctcttgagccaggaggttgaggctgcagtgagctgtgattgtgctactgccctccagcctgggtgacagagcaagactctgtcacacacacatacacacacacatacacacacaccccaacaatgtattaacaaaagtctccacattattcagatttccttattttttccttaatgccctgtgtctgtctcacgatcccgtccaggattccacatgatggtcgggagcatctcctcgggctcctcctggctgcgacagtttctcagaccctccttgttgtgatggccttggaagctttgaagttctgatgaggcactttggaggatgcccattggctggaagaggtctcatgcttttctcaagattagaacctctgtaactgggttccaggtttgggggaggatctacgacattttttaaaaatataaagcactcgaccaaacaaagtaacatgttaaatatttacttatttatttattttggagacagggtctcgctctgtcacccaggctggagtgcagtggcacaatctcaactcatcgcaacctccacctccagggttcaagcaattcttgttcctcagcctcctgagtagcttggattataggtgtgggaaaacaagcctggctaatccttgtatttttagtagagacggggtttcaccatgttggccaggctggtctcaaactcctgacctcaagtgatctgcctgcctgagcctcccaaagtgctgggattacaggtgtgagccatcacacccagccgtaaaaggttaaatatttaaaataaattataataaaccctctttgaatgtgtaaaaccagttaaaaataattttaaaaacaaaaataaaatttataataaaatttctttaaaaaatttttttaaattaaattttatggctgggtgcagtggctcacgcctgtaatcccagcactttgggaggccaaggcgggtggattgcttgagaggccaggagtttgagactatcctgggcaacatggcgaaaccccgtctctactaaaaatacaaaaattagctgtgcatagtggtgcatgcctgtaatcccagctacttggcaggctgaggcacaagaattgcttcaggccaggtgcagtggctcacacctgtaatcccagcactttgggaggccgaggtgggtggatcacaaggtcatgagatcgagaccatcctagccaacatggtgaaaccctgtctctactaaaaatagaaaaattagcctggcatgatagcacgcacctgtaatcccagccacacaggaggctgaggcagaagaatcgcttgaaccctggaggcggaggttgcagtgaactgagattgtgccactgcactccagcctggcgacagagcgagactccgtctcaaaaaaaaaaaaaaaaaaaagaattgcttcaacccaggacatggaggttgcagtgagctgagattgtgctactacactccagcctggggaacagaatggtactctgcctcaaaaaaagaaaaataataattaattttaaatagagatgaggtcttactatgttgcccaagctggtctcaaactcccaggctcaagtgatccacctgccttggcttcccaaacttctgggattacaggcgtgagccacctacaaattataataaaatttctgttgagtgggaataaggacagattattactgatgtaataaaacaacatcaatcacaacaaaagtataagctttttaagctaggaaaatacagtaaaatataaaacgttcctttttaatgtcgcttttctacttttagtataaactttacgattataggtggcaccatctgtgttagttacattatggtgaagtctcacattgtacttggaggaagaaataaattgaaacagagtgaaaatgagtgtaatttggagttatacaacaacaacaacaaaacccacccaaattgttcaacaacaggctgtttaaaatatattatcaaaattccttggccgcgtgcggtggctcacgcctgtaatcccagcattttgggaggctgagctgggtggatcacctgaggtcaggaattcgagaccagcctgggcaacatggtgaatccccatctctatgaaaaatacaaaaatcagccgggcgtggtgacatgtgcctgtaatcccagctacctgggaggctgaggtagaggaacggctggaacccgggaggtggaggctgcagtgagccgagatcctaccactgcactccagtctgtgcaacagagcaagactccgtctcaaaaaaataaataaaataaaataaattatcaaaattcctgagagggcaagaagttccaactccatattcaaaagctaactgaggttaagatattaacacaatgctcccttcttgcttttgatattttcagtgttataggatagaagcataattacagagtatcacactgggacttgagttactgctctacaaaaggaagaaacctgtttgcagactgatgttaaatctcactactctttaaacagatgccaacccaacattattatgcaagggagttgctaaagaagaatatgagtaagtagcaagtttatattaaagtgtttaattcataaaggttaataacaaacttttacaaatgcaacatctaagtttaaatgcaagcaattataaacactaaattgaaatattggaagtatttctcctattaaaaacaaatctgattacataatatgcttgtttggtacctttgtttgtttttttgagacagggtctcactctgccacccaggatggactgcagtggtgcgatcatggctcactgcagccttgaactctcaggctcaagcaatcctagcagctgagactacagatgcctgccattacatctggctaacttttttattctgtatttttttttttgtagtgatggggtctcactatgttgaccaggctggtcttgcacttttggcctcaagcctcagccttccaaagcactgtggttataagcatgagtcactgtgcctggctgctcgtgtcctccctacctacacaatataccctgtatcattcaaggttctagaactcgaactctaacctacctttccagcctcatctcctatcacatcccctaggaatctcatctctaggatcatttcaacatatccttttcaaaggaagggtttgaactttgggaaatccagttttgagaatgcgttcctcatgcttctgttctgtgcctctgcacacactattctttcttcctcaacagtgccttccctgttctcctatggtcacctgacatcctgcttgcctttctgcagtgggctgaacagtggcctccgcaaaaagacaggtccactggaaacatcagaatgagaccttatttgcaataagggtctctgcagatgtaactaaggtgaggatctggagatgaggttatcccggattagggtgggccctaaatccaatgacaagtgtccttataagagagagagagaagatgcagcgcggcacggaggggagggccacgtgaagacaggtggaggctggggcgacgcagcgacaagccaaggatgccaaggactgccggcaacagcaggagctgagggcagcgtggggcggattctccctcagcctccagaaggaaccacccctgctgaggacttaggaaccaaccctgctgatgacttactccagacttctggcctccagaactacaaggaaataaacttctgttgtctaagccaccaagttgtggcatcctgggaaactaataggccttcaaagttcagttcaaaggctacttcctcccataaaaccttccctttgagcccctcaggtcggaattaactgctccagttttgacatgcctgttaatgcttcgtgagtcacacacaccttgtactgaagttacaggtctgttcttcccttagacatgcgcaccggggggcagcagtggacgtcccttgctcttctctataatccaggcccctggaaggttcattgtagatatcaggcatgagttaatgcctggtatcttgcaagtcactgaagaagcacagatcaaatttgagaggggcaagtacggatctgagatgactatattgtgttcctgacctcagagaggaaatgtcagcaaatgaagcacgcaggtttaaaagaacactggtgaatctagatttaataaccagtataaaaaaacaaaacaaaacaaaaacctttatatacctttataagattaaaggattacctttatattcctttataagattaaaggattagacatggatttttttttttgtaagagaaataatgcacctatgaaagtgcctcatgtgatttttttctctttctttctttcttttttgttcaagatggggtcgcacactatgttgcccagcctggcctcaaactccttggttcaagggattctcccacctcagcctcccacatagctgggactataggcatacaccactgcaatttttgtttttttaagtgaaacagcattgatctaaataaagctttaacatgtttacaagtatattttatattgaagctattttctaattctattagacaaaaaaatgcagttgaattgaataagattgcagaagaccttcaaatgttcattctaccatacacattttaaaaacacctgcaaatacagcaaacaactggacaagtatgtttcagagataagcactacagtcatcaattactttttctgaaacccatttacacagaattttaatttagaaagaatttatataaaaaaaatgtgttgtaagacggtgtaattctttggtcttcttggccttaattctatgaaaatgaacaagacagactatcactaatcatttattagtcaggcaaaaatactaaaggataatttaacagacacataccagtatgaaattcattttacttatacaccttaatcaaactaagagcaggatagtgactcaaaatggatttcaacgtgtcctatttataaaaataacaactgctaaaataatccactactaaccagacagttaccatcaatctgcccgtcccaggttctctccccactgatactggcaacacccacacagtgagggaatagacgccccgagaagcagagcgtgaggactcacttcccaccctcaagttccacacttcttttggtccagtcctggaactcttgtttagtctagaaggaggattgtcccatcactcctgggaatggttactccaatttcagaaggggttggcctcaactagaaaaggaagcttctaacgtgagaagaaaagaagaccttctgagaaaacagtccaggcttagcggttccgtgcccaccatttggggctccctcaccacacgatctgggtgactgactgcagacacacctctcctgccatgagcagcacgaacttgctgacctagtcctatcacctgtgtagctggctctaccccggaggctgccaacaccacctttatctcatgctccacattttaatatgtcaacatacacagggactgctgcttactttccagactataagaaccttagtgtggctcacatctgtaatcccagcactttcggaggccgaggtgggcggaacacgaggtcaggagatcgagaccatcctggctaacacggtgaaaccccgtctctactaaaaatacaaaaccaaaattatccgggcatggtggcgggtgcctgtagtcccagctacttgggagactgagacgggagaatggcgtcaacctgggaggcggagcttgcagcaagccgagattgcgccactgcactccagcctgggcgacagagcgagtcttcatttcaaaacaaacaaacaaacattttagtgtgggctgggcgcggtggcttacggctgtaatcccagcactttgggagaccgaggcaggcggatcacgaggtcaaaagattgagaccatcctgaccaacatggtgaaaccctgtgtcaactgaaaatacaaaaattagctgggcgtggtggtgcgcacctgtagtctcagctactctggaggctgaggcaggagaattgcttgaacccaggaggcagaagttgcagtgaactgatatcgcgccactgcactccagcctgggggacagagcgagactccatctcaaaaacaaaaaacaaaaaacaaagccttagtgtgttagcatattataaatattttttcttttctttttttttttttttttttgagatggagtcttgctctgtcacccaggctgcagtgcagtggtgcaattttgccttctcctgggagtggtgcaacctccatctcctgggtttaagtgattctcctgccttagcttcctgagtagctgggatttcaggcgcccacccccatgcctaactaatttttgtactttttttggtagagatggggtttcaccatgttggccaggctggttttgaacctctgaccgcaggtgatccgtccaccttggcctcccaaagtgctgggattacaggcgtgagccaccacacccagccaatattttcaattcaaagttgagaaaatggccacagggagctctaaataagtcattttttatattctctgcttttaagtcaaaagaaggaacagagaagagatgcgtgcagggtgggagcagagcacactggggtcagaatgccaaggaggacttccccatctggaacccacacacagagagcagcggagtgctgatcgatggttacacccctcggcatcttcctctctgtattctatacccattatgcgaagattttgtccacagaaccaccttcgtttactaagcaatgcttgctgcggtttcaaaggtgctcagatccagggcggtgcagcgcttgccagaggccgccctgttccaggatccgttcctcagcttcatgcttaattttgtaaccatcagtcttctagggacttggtgattcaagtgaaataaatcagtaagtgatgaggaaactgaaatatcaattaagtggtaaagagatggaggccaggttagtgagcacagactgagaaaggaatgatctgatccatgagtgaggcgtggatccagcagagccgagcccaccccatcccaccaggacaagtggcaggaaccgcagggaaagctggaaacacaacagctttcttagaaaagacgttggcgcacttacgtggggtggtccagatctcacactcatcatctcagacaacattaagatggtaaaaaagcagtctcgggccgggcacggtggcccatacctgtaatcccagcactttgggaggacgaggcgggcagattacttgaggtcaggagttcgagaccagtcaggccaacatgaaacctcagctaagatacaaaaattagctggacgtggtggtgcacacctgtggtcccagctactcgagagactgaggcttgagaatgtcttgaacctgggaggcggaggatgcagtgagctgagattgtgtcaccgcactccagcctggacgacacagtgagactccgtcagcaccaatgtgttactcccttcagcactttctgtgctcccttttgtgggaggacagcgacaccagcatcactaaaggagctgaattaaatgcagtgcttttgactttggacttacatgcagagagaaagaggagagttgagtaacatgctcagcctgtctctccccaggatgcccatcctctgctgaacctgcccgcaggtttgggagccgctgagtgcactgcagagtgagcgtcagctaccacagtcccttcttgcagggtgttcctagtttaatccttatctgtacttgtgaaatggaaggtttatgccttgctagagagcttttaggtataaggcttgtcaactctaaaatcacactgcagagacctgcagtgtgcctctcccctactgacccacacaggtaggggacagagttggaggccccaagcacagagccctgcctaggcaagacactgccactgctgctcactgtgaagcaacctggggaaccccctgcttccacctgttctgtcccatcagcaggcgtaggggctgctgccatggtctggttctgccccccatcactccaactctgtgcactgcctggcggttgtcaccagtccaggggtctgaccagcgtacccacctctgcctgctcaccttcatagtgcacagccccatttctaagatgatgctcagcgagtgaccgtctatgggaccattcccaaaggcacaggtgcatggggaaccccaagaaatagtgcaataacctgaagctgttaccagccctagacctggggtgaggaacagttacaaaacctggaaggagagagtttcaggtagagccagtccccttgggtggggcagcgaccttcattcgagcagtccagccaggtagcggcagcctcccaggatgagggagctacaggagtaaccacctgcctcctctgggggctcctcactggctaagctcaacaggaccccagaatacgggagcccagccgatgtgtcccacactcagcctccctggtgagaaagacaggtgaggcagggtgaaaatgggacctgggggcaaacaggagctacctgcggcactctaagactgggcagatggaagaaagacagttggggttgacgcagtatcttctacaataacgcctgaaataacttaaactttgttttcagaaattattatttgtaatagcaataaaaggcatgaacatgttttccaaaaataacaacagtgatatacacaggttgagcatcccaaatctgaaaacctgaaatctgaaatgctccaaaatccaaatttttttgagcatccatactacactcaagggaaaagctcatcagagcatttcagattttggatttttgaattaggaatgctcaactggtatgtatgatgcaaatactcaaaaatctgaaaaaatactaaatctgaaacattcccagtcccgagcattttggtttttattttatatatgtttgagatggagtctcgttctgtcacccaggctggagtgcagtggtaggatctaggctcactgcaacctctggcttctgggttcaagtgattctcctgactcagcctcccaagcagctgggattacaggcacccaccaccacgcctggctaatttttgtatttttagtagtgatggggtttcgccacgttggtcaggctggtcttgaactcctgacctcaggtgatctgcccagcttggcctcccaaagtgcttacaggtgtgagccactgtgcccggcagcagtcccaagcattttttttttttttttgagatggagtctcgctctgttgcccaggctggagtgcagtggacgatctcggctcactgcaacctctatctcccgggttcaagcgattctcctgcctcagcctcccaagtagctgggattacaggcgcacaccaccacccctggctaagtttcatatttttggtagagacaggctttcgctatgttggtcaggctggtctcgaacttctgacctcaggtgatccaccttacctccaactcagacacccccgctccagtgaccaactctctggtctcactggagccgaccaggaggtgccccgttcccacggctatgctgagcgccccagccagcactccaacacggcctgtcaggggaggtgacgctgtctccagctgtgtcttgaaggcaggaaaagggattccaggcagaggcctgagcccctcagatctgagggtatcctcaggagctcgcaggggacatggggcaggggctggcaccccatggcgatgggggagcagcagcagggtggcagggaggccatggggtcggttacgttgggcgcttggcatgtgctctgtactactttatcctggaggtgaccagaagccacacaggggctcacacaggaggctgaaaaaatcagggctgcgtggacgctcagtcagaggagaaaagaggcagagcagtcagtggacgtctctgagaccctgctccctccatcgtgactctccgtcccatccctgcgtgctctccttcacctccgcccctcaccagcttgcttcccgctctctctccccatctccacttgaccttgtggtggttcactccactccactgcctttctttcagagcaaacagctcgcagtgatgatctgtggccctaagcccactttgccaggaccgctccagttcagcaccatggaatgggactccacctgggccttctgagtccccatcaccagcaaccacctggcactaatcacaatggcttttctgcaaactccttgccgaccactgatcacttggcactgggctctcagccccagtctcctcacctttacactggaacaaaagagcctcaaaggggccatgtggatccagagggaacctcgagagaggagccgtgtggatctagagggaacctcgagagaggagccgtatggatccagagggaacctcgagagaggagccgtgtggatccagagggaaccccgagacagaagccgtgtggatccagagggaacctcgagacagaagccgtgtggatccagagggaacccccagagaggagctgtgcagatccagagagaaccccgagaaaggagctgttttttgttcctgcattagtttgctaaagacaatggcttccagctccacccatgttcctggaaagggcatgatctcattcttttttatgcctatatagtattccatggtgtatatgtaccacattttctttatccaatccaccactgatgggcatttagtttgattccatgtctttgctattgtgaatagtgctgcaatggacatacacatgcatgtgcctttatggtagaacaatttatattcctttgggtatccacccggtaatgggattgctaggtcaaatggcaggattaaagacttaaatgtaaaattgaaaattataataacctggaagatgacctaggaaataccattctggacatacaaatgggcacagatttcgtgatgaagatgccaaaagcaattgcaacaaaggcaaaaattgacaagtgggatctaagtaaacttaagagcttctgcacggcaaaataaactatcaacagagtgaagagacaacctacagaatgggagaaaatatttacaaaggatgcatccaacaaaggtccaatatccaggatcaataaggaacttaaacaaattgacaagaaaaaatcaaacaacccaattaaaaagtgggcaaaggacatgaatggacatttttcaaaagaagacatacacatggctaacaagaatatgaaaaaaagctcaacactactgctcattagagaaatgcaaatcaaaacccttgattctctaatgatgttgctgcaccttcaacaccactgggaactctgcctgctgcaagccaaatgccctggtctaccatttgcacaccggcagtataaacacaaagcatgattagagcctctgtgtacagaagagagtaactgctcacccacaccagctcctgtagttgtggggccctgacttagtcaattactgacgtcctccttggcaagcaaattttgccactggtcagagggttcattttaacagtgctgtgggtggtgggggcgtgaagcaaaggcggaatgcatgtgtgccttggagggtgcagtggcttctcctcagggtgggcttttggagctgctgtccagctaccaccagagagaggctctgcttggccaggcaggcaacgagggcgggaggaagcaggtgcacatgcatgcacacatgcacatatgcacacaggcacacacacacatgcacacacactcatacacctgataccaagttaaacccctctctcttttatcacgaccactgactattatattttaaaacacatattcaagggaaaatagtggataggaagcaggactggaatgcagctcccactcagacggacagagcagcgtgtggcaacttgcatcatgaacctgtcttccagaactactgcaggaataggccaggaaagctgagagaatccacagacccttgaagaaggcagattgcttctgcaggacccaggagacacaccaaacactgccccgtggcaggctggtccccgccctgcaggagtgtttggactgtgcagtgtgataagcactgtgggtgaagtactgcaaagtgctaaaggaacatacacaggaggagccagaggagccttcacggccaaggggatgtgagctggatcctgaaagaagaagtgtttgagagagaagagaagaagaaacattctaggaagacgtaatagcatatacaaagacagaggtcccaaagaacatggcatgtttgaaaaatgatgtagccgtatcttagcctgaaacagctggagtctagcactcatgggatatggctggagatgcgacaggaaagttactcaggaccagatcgccaagggcctttagaaacgcacactactaggccgggcgcgggggctcacgcctcaaatcccagcactttgggaggccgaggttggcagatcgcctgaggtcaagagtacaagaccagcctgaccaacgtggagaaaccctgtctctactaaaagaatacaaaattagccgggcttggtggtgggtgcctgtaatccaagctatttggggaggctgaggtaggagaatcacttgaacctggaggcggaggttgcagtgagccaagatcacgctgttgcactccagtctggcaacaagagcaagggaaggagcgagggaaggagggagggagggaaagagggagggggggagggagggagggagagagggagggcacattgcttcgtgtagcaccaaggcgtcactagacccgggattcacctgcaaataatccgagtgtggggaagtgggtgagggtgttgatgaaacaaggctgtctcaggaattgatgcattgaaggtggatggtggctatttggaatgcattgaaccattctctctaccatttcatatgtttggaaattttcataatacaattttgaaacaaaaaatatcatcatcttatgcaaggacattctttgttgttacataatattagaatacttttattattgttgttaatagcattgttgagtttttttaaaataatcatgttaacagaaaaaaacccccatattcattaatcacaggtcatagtaacatattcaaaacttgtcttaaagactaagtgtataagaatgaaatgcattttaaaacaaaatttacactgtcccaaacttcacttaaaaactccccaaaccgaaaaaaaccctgactccttattcacaattttaacttaatatgctgaatttcattataattccacaaaaaattatcagtgttaaaatgtatcttttatactttattctgcatttagaaatacaagtttactatatttatatagtgttttctctttttagaaaactgttaaaaaatatctgagtaagaaataagcaaagaagaggaatgtgacagtcaaaagtatatggaagagaaaaaattaaactcataagttggctgggtgcggtggctcatggctgtaatcctagtactttgagaggcaaagatgggagaatcgcttgagctcaggagttcaagaccagcctaggcaacacagtaaaacctcatctctatttaaaaaaataaggtcgggcgtggtggctcatgcctgtaattccaacactttgggaggccgaggcaggcagatcacttgaggtcaggagttcgagatcagcctggccaacatggcgaaaccccatctctactaaaagtacaaaaattagccgggcatggtggtgggtgcctgtaatcccagctactcaggagcctgaggcaggagaatcgcttgaaccgaggaggcggaggctgcagtcagccgagatcatgccactgcactctagcctgggcaataagagcaagactccgtctcaaaataaaataaaataaaataaaataggccgggtgtggtggtggctcatgcctgtaatcccagcactttgggaggccgaagcaggtgggtcatttgaggtcgggagtttgaaaccagcctggtcaacatggtgaaaccccgtctctactaaaaatacaaaaatcagccaggcatggtggtgggcacctgtaatcccagctacttgggaggctgaggcaggagaattgcttgaacctaggaggcggggtttgcagtgagctgagatcgcaccattgcactctagcctggacgacagagagagattccgtctcaaaaaataaaataaaataaaaacccctaagtttttctaaagtgcctagaaacatgaacagaaacaaaggcaaatcttaaacataattttacaggatttacaattataaggtggcagaataaatgaagtctgttactttttttcccctttccatgctttttgcatttggttttgtgtgtgggggcaaatgtgtacacgggcgagaaaatgcacacactcttctaaataagggggcagtaaaagagttattaggaaagaagaaaaagcacaggcaggatcaaggcagagtttgcccaattagttcaaagtgagttgcaatcgatgcctaaggaaagtcacggacaaagcaatgaccttgaaattgtatgtggctcctgtcagaattttaaaatggttttgcatagaattctaggaactattaatacataattaaagcatctaccacagccaatgattcctttctcagggaagaaaacccagtgatgaagctggagaacggtgatggccaaggagagctcacagggatgaagcagcaagcaccagccaggccagaagagtgagacccaccttggcaggtacagtggagcatccataatccaaaaacgtaaaatcccaaatgctccaaaatgcaaaactttccgagtgccaacacaatgccataagttaccctgaacacatcggtttttcactgtatttatcagtagcatagaaatacagagtcaggaacgatggtgatgccagactgtccacaagggtggctgagacagtggcacctttgctttctgatggttcaatctgtacaaactttgtttcatgcacaaagttattaaaaaattgtataaaataacttcagactatgtatataaggtatatatgaaacatgaatttcgtgtttaaaattgagtcctcatccccaagatatctcattatgtatatgcaaatattccaaaatctgaaaaaaatcagaaaaccggctagacgcggtggctcatgcctgtgaaatcctagcactttggaggggccgaggtgggaggatcacctgaggtcaggagttcaagaccagcctggccaacatggcgaaaccccatctctactaaaaatacaaaaattagctgggcatggtggcgcatgcctgtaatcccagctactcgggaggctgaggcaggagaatcacttgaatccaggaggcagaggttgcagtgagccgagatcgcgccactgtactctagcctgggtgacagagcgagactccgtctcaaaaataaaaaataaaaataaaaataaaaataaataaataaatcagaaaacctaaacatttccagttccacgcatttgggagactcaacctgcaccaggaattatacagctgctgcccccgctggctgtcatgaggtatacttttagctacttaaagaagtttcctcatatccctggtttattaacgatttttaaaaaggaacatatgttgaattttattaattgctatttcagtatctactgagatgactaccagtttctctcctttatcaacaacattaattccttaggcaatttcttctttttctttctctctctcattctttctttctttctttagagataggatcacattatgttgcccagactggcctcaaactcctgggctcaagagatcctcctaccatggcctcccaagaagctgggactagatttctcaatagatggctttgtttttttgttttgttttttttttgagataaggtctcactctgttgcccaggctagagtgcagtggcatgatcactgctcactgcaacctcaaatggccaggctcaagcaatcctcctgtctcagcctcctgagtggctgggactacaggcatccgctaccatacctggctaattttttttattgtttgtagagatgggagtctcgctatgttgtccaggctggtcttgaactcctggcttcaagtgatccttccaccttggcctcccaaagtgttgggattacaggtgttagccaccacatccagctccttaatagattaaaaaaatttttttttaattaaaaaaattaaagatggggttttgtcatgttgcccaggttggtctcgaactcctgggctcaagtgattcacccaccttggcttcccaaaggcctgggattacccgatccacccatcttgacttcccaaagggctgggattacctgagccgcccaccttggcctcccaaaggcctgggattaccggcaagagctaccttgcccagcctagatttcttaatcaacagaagaatacttgcatttctaagataaaccttacttgaccacaatatattcggcttttaatcctgcatagctagtgtttgtttaggagctttggccacattttaaatgtaagactgatcgcttgttttcttctttgtgtgctatcttcctctggctttgatttcaagatcaagctagccttacggaaggagctgggaagtgctccatattttcctatgttctaaaataatttaaataaggcattaactgttcctgaaaagttttacagaattcatccataaacaggctgaatagaatggtatgctcttctgtagcagaagaggaataagacctttcattatcttatttaaaaaatagctttgttggggctgggtgcaatagctcacgcctgtaatctcagcacttcgggaggctgatgtggaaggatggcttgagcctaggagttgcagaccaacctgggtgacagagtgagaccctgtcacaaaacaaaacaaaacaaaacaaaaaaccaacaaaaatagtttgagatataattcacattcacaggttcgccaatttaaagtgtaccatctctgttgcccaggctggagtgcagtggtgtgatcctggctctctgccacctccacctcccaggctcaagcaatcctcctatctcagcctcccaagtagttgggaccacaggcgtgcaccaccacacccggatagtttttgtattttttttgttgagatggggtttcgccatggtgcccaggctggtcttgaactgctgggctcaagggatcctcccacttcagtctcccgaagtgctgggattacaggcgtgaaccaccatgcccggccggtgtgctttgatcaacgttacttttaaagatctctgcatttatagttaagaagcttctcttctttctaaagctttgcattttctcccattttttcctgaacagacttgacaaaggtttatccactttactgacttatccaagaactaagtttttgtttttattaagcatgactacctttgtagttgatttcactgatctatgtcatttcagtagactttaggagggaagagaggtaagtgaatatattcagcaaaccgctgagtcacaagagtggcagagcaatttggtgaattcattctgatgaattcaagatgggcacttcatccaagtccccgcaagtgtcctgaagtttgagactctgacaaaaggctatcctaactcacaatgaaacactggagtttcgcagagattacacatacgtccataaatgtgtgcacctctttggggttttgcaatataatggatctttctgttgtgcgtcctctgacagtttctactatggcgtgccattgtttttacactgtgtgacagcactgacaagaattactactgcaaatcaaaacacaaaaaaaccattggcagagccattacaataagtcaccaatagaagatgtcaggtagcaagccagtgttcaccaatggggactactcaaggtactcccagttcaaatgggaggcaatggagaagacagaagcatctagaccaaccctaggtcagaattgttactgcctttcttgtgagcttgaacaaattgatacccttgagcctgaatttcttcatttgtaaaatggtgacacaccatctttcctgagagcatttctcaggaacagggataagcacaaacatccaatcgcaaaagctgccaactatatgtggcatacatacctgtgtccacatggggcaaagtctgacagtgcagaagaacagaatcgctggaatcactttaaatttttgctcggtttcttcttgtcttcctagtcatcatcgcagttactgctgatggagactgtactacatcccaggccctctaatgcagcggtccccatactacatcccaggccctctaatgcagtggtccccaacctttttgggagggaccagtttcatggaagacaatttttccatggatgggggagcagggggatggtttcagcatgaaattgttccacctcagatcatttggcatgagttagagtctcataaggaaggctgggcacggtggctcacgcctgtaatcccagcactttgggaggctgaggcaggcagatcacgaggtcaggagtttgagaccagcctggccaacatggtaaaaccccgtctctacaaaaatacaaaaattggttgggcatggtggcaagtgtctgtaatcccagttacttgagaggctgaggcaggagaatcgctggaacctgggaggtggagcttgcagtgagccgagattgcgccactgcactccagcctgggcaacagagcaagactctgtctcaaaaaaaaaaaaaaaaaaaaaaaaaaaagctcataaagagtgtgcaacctagatcccttgcttgtgcagttcacaatagggttcgcgctcctatgagaatctaatgctgctgttgatctgataggaggcggagctcgggaggtaatgctcgctcgcctgctgctcacctgccgtgtgggccgattcctaacagtagtggtctgtggctagggggttggggacccctgctctagtggatatcatgcccatgttatttaatccacatataatcctcctggctaggtactattattatttccaagttacatatgaagaaaccaaagctttaagaaacttactaaagttctcacagttattaagtagaagaaatgagactctaaggtgaatctgactcatgctcttaattgctatggctctaattacacatgcattaaaaaaaggggggttacatcgtatgtatgtataagcttcaaagctagagaagtcaacgtgaagactgagagccaaggaaagagggtaaataagcgtcttacaatgcgcatgtgtgtactggggaggaggtcttgacggaacaatgaaacattccacttccaagaaaatgtggaaaatgattcataaaataacaacttattgctagcaacttcctgtcagttacaaatgaccaaagtacaacctaaaataaaatgaatcagttagcatgatgttcagaaacctcattgatgttatataaattcagatacatgggaaacagctccaagtgggacagaaggcagcgtgtgtgtgtgtgtgtgtgtgtgtgtgtgtacatatatatatattttttttttcagataaggtcttgctctgttgccccagctagaatgcagtgatgccctcatggttcagcacagcctcaacctcctggactcaggaggcatgggactcacctcccatgtctggctaattttctgtattatttatttatttttatagagagagggtttcgccatgttgcccaggccgatctcgaactcctggactcaaatgatccatccaccttggcctcccaaagtgctgggattacggggtgagccacagcacccggccgtggcagcatattaaacagattaaaaagtgactaaaatttagccaaaaggttcccagactagttcccttcccccaaaatcgctcttcccttttcatatcagagatgaacctggctctgttccccctaaccttagcacaagtgtaatcacggccatgaaaggaaggtgtcaaggcgatttcctcggatgccagattccgcaggcgagccatcccactctacccacttgctactgccttcagttattcaactgcaaacgtcacaagccctgatgtcacccaccgtcgggtggagaagcctttcacacctccagggttcactcagtcatttcacttcctccgttgctccgccctcactgctctttgattagcgcaccatcaacatggcaaatgcaattcctctcatttctccaatgcctcaaatagaaatgccttatgtctttgtaagaaataacattgaccacctgaagtatggcaagcctaggtgccacagtaaaagcataagctccaaaatacatacgttcatttgtgtgacaaatgtttactgaaaaccaagtttcactcatcccagtggcctcaagacctggcaaatattaagatttcagtctccatcctcacagagcttacaatgtaatggcaaataaatgggaggggctactgggaaacacaaagaagtgcgtccccctaacagcacctatcaattgtgagggatcatgagatagcatgggaagtcttcatcggggcttctgggaaggcttccctgaggaagcgacatctaacctgagacttggagaaaacgagcaggtggccaaaggagaggaaggaatgattcaaggagcaggagctgtctgtgtaaagtctggcaggcctggaggagcaaggcagtttgaggaagctgatgaaggccagagtagctggagggaaatgcagggaggaaagaggcaccaggtgaggctggggagggaggagaagggggcaaggagggcgtgccgggaagtgcggactcctacaggcaaaggaaaagtaccggaggctttagaaatgaaagcgatgggattagaaatatgtttgaaggaaatatctccaacagcagcatggcaaattaattggagggggcagagcaggtgctgggagagcttggctgctggaacggtccataggaagatgacactggccgggagtgagggagagaggtgaacaagccggaagcagcagcaaggagctgttctcttggacctggagtcaagcagctttcctgttaaaacagctgggaggatgcgggcatttatggaatcaggctggttaaaaagaaagaaaacaaaccgaagaaggaaggggaaggaaggagatgggcacagagagatcagtgtcaggggaatctgagccgtggaggagggcacgacctccaggctgaaggcacaggatgagatgtaggcctcagacagggcagcgagaagcccatatccagtgctccaggagggaggggaatcgtatgggatgtgagttatatcacaggggtccgaagcatgggtaaggactcagcacagctggctgtggggttggagctgaacagctgtagggccaagaggccattcttcaacacatccaccaggaagcagagaaagttctgagatgggaggtcacatggccctagagcaatggccagaggtgctcaatgccctgggccctgatgactttccagctggttccagttacttgcgaagactggtgacgagtcccacttaccaatacccccgaatcctcccagcattgtcctctgcttaaactagtcagggatcttccggtgacaaaacctctatctactccaagacaacaaccctacctcaccaagtcggagacaccaccaaatgtgaagtcacgtcctgacttcagagatactgaaatgtgtacctagaccctacagaatagggcaatatgttacatatggcgccagctccagaggaacaactttaattacagggatttcatacaattgtaactactcataatccagaaacaataagtctcttatctacgaggagtgtgtgaactcagcagggaagggtagagtttggaaagcagataatcacccgagccttctcgtgccctaagtaatgatcgacaagtaccagactgtgcccacacacctgccactttgatatctccaccagcagaggtcagtgccccgcagtagagtcaagaaacctgcaagttgacgcttggctgtgagagtcaagggacaagggaataattcaatagatgaccacaaatacacagggaggcaattctcccttaagcaagttccagcagcttctaagccttgttttcattatactcccctccctgagtcttttttatacattctcccccaactgtcctacccccacgacattttaatagcacagatatactgtgtatttgttcatgtgccgtggccctttgggtggccaaaatccactgtaacagctgcaatttttttgtctcccaacaagaaccgatcttcacttactcagggtgttactcactccagttgagaatgaatgagttttgagtgaacacacatttttgttttgtttatttgtaaagagtgattattggttgctttggggtctgatttttaagcgagagagaaaaagcaaaagatcaccaagtgccggccccctggttttatagagaaaactcttaacgacagcaataacaacaaaacaaagcccggagaggcctcacgggttgtccaaggaaatacaggcccttcatcacagatctgggcctgaatcccgagatgcctcactgaaagacaatgctttctttccctcctacgaaaagtggcccctacttttacctattttgatcactgtaggtgaggctgaccagttttgctagaaacaagcaagattggctgggtgcagtggctcacacctataatcccagcactttgggaggccgaggcaggcagatcgcttgaggccaggagttcgagaccagcctgggcaccatggtgaaaccccatctctactaaaaatacaaaaattagccaggcatgctggtgcatgcctgtaatcctagctactcaggaggctgaggcatgagaattacttgagcctgggaggcagaggttgccgtgaaccgagattgtaccactgcactccagcctgggcaacagagcgagacaaaaataaaaagagagaaaaataaagcaagattgaggcacgttctggaaagaagattctatttcgttgttgtcattttgtttttgttttttggagacatgaaattactccaggctgaagtacagtggtgcaaccacatgcgctcgggtgatcctcccacctcagcctcccaagtagccggaaccacaggcgtgcaccaccatgcctagctaatttttaaaattttttataaagacggggtctcaccatgtttcccaggctggtcttgaactcctggccttaagcaatcttcctgcctctgcctcccaaagtgctgggattacaatggtgagccgccacgcccggcctggattctactttggaaaatctttgcaagtgaagaagaataggacagaatggctgaactgggatgaaataagcggcaaatgaggaggaagaggagagacagtcagtctggcaagacactctctgctaagaagcgggtaaaatcaccacagcaagttatcaaaaacttgaaagagcccagctcctccggcagctgggagagaatgcggaccgctctaaagaggctgcagacttcatgaagtggtaccagagtagagcaggtttattaatcacggataaaactgctgaataattacctacttcaaaaagcattcatgagttgtgtttaggtgcttacaaagtactttgtgcttggtcctggccagtaagttagttcaaggcagttaatatagataaacacaaacacagcaaagacgtggtcggtgtaacaattacaaatgtaaaaagcaaacacagaaagggattgctggctgggcaccgtggttcatgcctgtaggtcccagtagttagggagactgcagccggcagatcacttgagcccaggagtttgagaccagcttggccatcatagtgaaaccccatctctactaaagtacaaaaattagccaggcatggtggcatgcgcctgtagtcccagctacttgggaggcggaagcaccacttgagcccaggaggttgaggctgcagtgagctgagatcgcatcactgtacttcaccccaggtaagagtgagaccctgagggagggagggagggaaaaattgctatgggcaaggcttctcatacacaaaatcatttcctcccccaatatgcccacaaagtaactacaaacacttaatgaaatcattgagatccaaagcactgctgagaacttgctatgtgccagctgtggtagcaggcacgggggagagaaaggtgaatgccagagaagtacagagggtattcagagaaggcctcggagaccagatgagacttgagctgagccttgaagtcttactaagatcggtgtggcatggaaagcatgcagccctcatcacgtgccaccccctaaggcacaggcacagtgagggagacacagagcagggggctggcacactatgcctgagggccaaatctgggttttggtaaagaagttttactggagccgagccccgccccttggattgtgttagctgctttctgctttcttgctacaagggcaaattgagtggttgtgacagaaactgagaccataacacccgcaaaggctaaaatatttactatctgaccctttacagaaaaagttggccggcccatgtcctgttattccaagaggggtctgtgaaccggcagcaggagcggcccctgtgctaggcaagtcccaccccagacctagagaactggaatctgcctttcaaaaagatctgtggctattcttatgcacagagagggaggggcactgagcctgcggagtaagagaagtctgcacctgtcggatatacggacagaggaacgtggtcaagaccttcccatagaggagtgaggccatcaaacccacccgtaccatgtccctcttgtcgtggtaagaagggttgacagcagaaaagggatggcagctcctgtcataacccaggccaaagacgacccaactaggcagggtagaactcaatctttcttcctaacctcaccagtgcttccaagatgtttctaacaaatatagtatcagttataacttattaggaaatagaaaaatcttggtaatgaaaatatgagtaatcatgtgtttccacgtacagcgaatatatctcggttgaagcaatgcctctagacatcaatgcatacatgaagacgttaacagggtatgctggatgctgaaagatgaaatgaggatctcgtcaagggctccctattatgtaggatatttagaggtgtaatgtcttactgctgggacttttgtccctgctaaataagtgtgagattctgcttgatattcaattttcctgtattttggatgaataagcaatttaaagttcaaaagaaacaaagctgcatttggactaccacgccaacactgttctttcttccagctcagctcagcctcaaagtcactgtttaacattctgcctccttaagaatctagaaaagtttgacagggttattcgtgggattcggtgtgctttaaaggaatgacagcaatatagataaaaatagatgggtgaagaggggaaattcctctcttagacacttaggtttaatactttacattcattacattggcagacacaatgaaaagaaaaaaaagagtgtatatctgcttagagaaatgcataattaaattaataaatctcaagtaagaagaagaaaagggacaggacaccaaatctgtgttgagaagaatctctgtgttgggtttcattaataaaaatcttaaaaagctcatgaattcagtacaatgcttaatggcacttaagcgataatagtaactaacatttatgaagtactcactatgggtttacactgtttttaaatgccatgatacggattggctcatttaatcctcaaaacacctgatattagctctattttagaaatgagaaaaccaaggcacagagaggttaagtaacttgtccaaggtcacacagctaaataagtagtagcgattcctctcgaacagaagctgctctctagttcttcttgcctccctgctaatttgcaaaaattgtaactgtaaaagactctcattcttactaatataagagacaaaaccctggtgatttagacattcaaagtcttatggaacgggcacaccattccaccctgtggacagcggccaagatttggcctgcaatataataaaactgaggaatagtgagatgggttcgaatgaagaccctggattatttttctgtaggatgaaatgcaaattaagtccggtaaaattctgaaatgcaccatttgttaccaataaatacagacaaacacttttaatgacaatgactatgaacgcgttctcttccagctaacatgtttgtgaaatgctgcagtgaatctcaaagataacaggcacccggctaattctattgggttaacacgtccatgctggctgtgcaggcttatttaagtaattgcctgactgtgaatgaacagaggtattaaagtaaagttggcacaagggacagcatccacatggcacgttctttgtttcgagagctttattctatcaatactcctggaaaaaagagaagttgctaaataaataatggaagcacacaagacagtgtgaacgccttttcaagtcctcgaattgtcaagcatcttatataaagttctttcccgactctgagctcatcacatttcattttacatattaattttgcgtaagagcaagctcatcccgttcaaatgttaacagcttcaaaataagatcctggtgaaagctcgtcacattccattttaaatattaattttgccaaagaacgagctcatgcctttcaaatgttaacagcctccaaataagatccaagttatttacctgtaagatacaagaagaagacaggagagggaaaaaaaacaaccaagtgagaggagaggcgacagaaatgacggagtgagagggtcgcctgaactcaacaccgattcaataacctcttcaggttttcctatttaactttccccattaaaaaagaagacacaccctaccggtcatatcttcacaggcgcagataagggcaccagtctatgattaaagggtctggactgtgggtatgattcggggttgcctccgagtgcatggtgacaagcacaaacaattagcgctccctgacaccttgctgtaattcgagttcggcgagtaaggacaaaagggccgcccgtccgtgtggatgccgggctcagggctgcgctctgggagcctggctcgcgtcccctccgcggacgcccggtaccccgcagcccgagctcgccggcgcccgcatccccgccccggttcccgccccggcccctgggcttccgcaggacgcagctcgccgtggggcagcgccggagatggggcgcggggtccccgcgggtcccggtcctcgggcggccgggccgtgggagcgccgggccggcagcgggcggggcgcactcaccttcgtcctcgaactccagcttctccagcatgccggcttccgcgggtcccagggccgccgccagcgccgcctgagggggaggaggaggacagcgatcagcatgagctgcgacgctcgtccccggccggcgggctcgcggccggccgagcgctggggcctggctctgccgcgccgccgggaggaggggcct

SEQ ID NO: 493 - DNA, 6831 bp, Homo sapiens
tgcagttgaaattttaactttattattttcctattacaaaagcaacacatattcattacataataaaagggagggagctcaaaagatataaagaagtctatgttttttttgtttgtttgtttttttaaaggagtctgttttaaaattgcctattatcctattccagggaaaactattaacattttgccatatttcattttatcagtcttttcctatgtatttttgaacacagctcaaatattactctatataaagacttgtattcagctttttcaacataaattacattaaagttatttttatgtcaataaaaattatctttgtaaacaaaattttaatggcaaaataacatttcatcatatagacatactgtaatttatttaaacactctcctaaaatcaaatatttagttaggagaaagttagtaggtcaaagcatataaacattgcgcaggtcactgtggcctaaaaaggctgttcttttttattttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgggattacaggcgtgagccactgcacccggcctcaaaggctgggagggaatgcagtgactctgcgggtgaggggtggtatcaaggccggcagcaagacagagaaggctcacaggtcctggcctagccgctccagctcgttgaggaggaagtccatatcagcacaggtcagtgcagagttggccacaaccacacggaagaagttgccccgggtcccgtggggctggtagccaatcatcatggagccctccttcaccatgcgctccttgagcacgggggccacctgtggaagggtggagagagattccagctgcagcctgggtcggctgacaggtaggctggcttcttgtcctgccaggcttccagaggtgcttttccttcccacccagccaccttctgggggtagcacaccttgctcagaccttgaccttggcctcagtttacctttctgtcatatctaacctgcttggccttcgctatcttctgcttttctccccatttctcctgtctccaagaaatctgtcctgtgggacattttctgccaaatcttgactttctcttgattcctaacactgctttagtctaacttcaagccttggtcatctaagccttagtcaacaccttcttctcccctctcttaattcctgtaatatttttgataatattaatctgtgccctgtgatctagcaagtaatttacaacactgccttgaacacattgcttccaagtaggtaactcttgccttataataacaactccataagggcaagaacatttgtcctttcagatcatctgcagcacctagtaccactctatctttagggaccaggatataacacagctcctcgcctccagatggcacttctagactggctttctcgggttgctgtgtccctagcacgggtaataaggcttttccatgatcattctgcctcatatctgtcctgggcctgagttcccagcccaattgccagcacaaggctctgtgtactacacactggtgacttctctgacttctcctgtaacacacgtcgctgcttcttacttcccagaaacataccttcctccccatccccacccctaccgaaaagagagcatccacgcctcagagcaagagaccagcaaggagacctgccatgccactcccagccaacagggggcagaagcgcatcagttgcatcagctccctaacgggtaaagagagcagcacagcacgcctacctttgacagcctttcgtggtaatctggactctcctgcttccctcgcaggctggggggtacgaaccagaaacacacattgacaaactcaggctgagaggaatgagaaagaggaaggtgtgagctgagaaagggggaccgttttccctctccctgcccctttcccctctccctgcccttttccctccactagggctttagttggggcttgggggctgcaaaagagctaggctggggcaggggccacaaaatagaaaggggtcctacctccatgactagctcaaacccttcccgcttcttcatttcctccaccaggtacctgtgaacagagagtgagaaaccataggcggggaggaaaagcagagatccagacagaagaggcccacgtagaatgagccacagagagaccgagagaaaagtaatcccgggagcaggaaagagggaggggcatggacccaggagaggggaacagggacgaccccccacctcctcccgcctaccgggcaaggacaaaggcctggtcgatgcgccgctccagcccttgatcgccctgtgccttccacatgagccacagcttcagacagtccacacggcggccacactgcaccaccttgtctcccgtgtccagagccacatcgtagaacttgtcctgctggaaaaggtagctggcctgggacccatggcagcgcttgagcaggttctgtgtgggggtgaggagattgtcagaccctaccctctccaccgaggctttcctccagggctgcactgtgggggtcttagctcaggataccctcttctttccctggagccagatggcactgctgggacggctgcctgctggctccaacacctttctttgggtttcctcccaatacccagggttcttcccaaactctgatggcaacctcaagctagaaactccaggatacctctgactccaacttcaagctggaaacttttcttttaagagaggccactgggggagtgaaggagcctaatacaggttagggtggtagctgagatgcagcttcagaagggatggtaaagagaatagagaaaggcctgaactttatctaaggtgggatagagaaggcagagctccagagagaggtggggctggtgcaggggcaggggcagacccaccgaggtatcctggagaagaagtgcagagcattgcaggcctgctgcgaggagcttgtggggattccaggccacagagtcagccctggatggggtggagcaaaggcaggtcagtggctcctcctccagctgcccaaccagagcccttcctccttttccaggtccccagcaaaggggctttggtctcaccctcaccccagcatcaggaagaactgccatgtctgacctcccagctccaatcaatcctctctccagtccccctcccctcagcctcctaccccagccatgttaaactccctagtccatgatgattctctggaccaatggtttgaagggcgggatttgggaagaaggggactgtatgcacctctggatcccatccaggagatgcctgtgtgtctgtgacagcaggacgctcccaccccaggcagcctgtggagcaggaggaacaacgtgggccttggccttggctcagcccaccccaccgcacccccaagccgaagtcccactcacatccacatgcagccatagcccatgacgctggcacacatcagcaattgcctccagggggtcaaaggcccctagcacagtggtgccagaggtggcactgaccaggaacggcacagcaccctgttgccaaaatgtagagggagaaagatgtaaagtcatctcaaaagctactcagagcctgatgctgggcccagctctaagctctttgcatgcctaaaatggcccatttcaacctcacaacaatgtgttactgtcctttttaatgtgcagccagggacactgagattcaaagatccaagcagaagctgcagagatggacttcgaacctaggttttcatttccaaagctcatactctcaaagaacttgaatgttttactggaagatccaatgctattgaaaaaaaattgagtcaggcatagtggctcacacctataatctcggcacttcaggaggccaaggcaggattgcctgaggccaggagttcaagaccagcctgggcaaaatagcaagaccccatctctaaaaaaatttttttgtttaattagccaagtgtagtgggcatgcctgtagtcccagctactcaggaggctgagatgggaggattgcttgagcccaggagtttgaggttacaatgagctatgattttgccactgcactccagcctgggcaacagaatgaaagcctgcctcaaaaaatataaacaaataggccaggcacggtggctcacacctgtaatcccagcactttgagaagccaaggcaggtggatcacttgaggccaggagttcaagaccagcctggccaacatggcaaaaccccgtctctattaaaaaatacagaaattatctgggtgtggtggtgcacgcctgtaatcccagctacttgggaggcggaagccgaggcagaggcatgagaatcgcttgaacccgggaggcagaggttgcactgagccaagatcacaccattgtactccagcctgggcaaaagagcaagattctgtctcaaaaataaataaataggctgggtacggtggctcacacctgtaatcccagcactttgggaggccgacgcgggtggatcacgagatcaggagttcaagaccagcctggccaagatggtgaaaccctgtctctcctaaaactacaaaaattagccaggcacagtggcaggcgcctgtaatcccagctactcaggaggctgaggcaggagaatcacttgaacctgggcagcagaggttgcagtgagccaagattgtgccactgcactccagtctgggtgacaaagtgaaactctgtctctaaataaataaataaatttgaatagtacaaaagtttatgcagaaattgaattagtaatttttaaaactactacagctggatgtggtagctcatgcctgtaatcccagcactttgggaggccaaggcaggagaattgcttgagcctaggagttcaagaccagcctgggcaacctagtgagacctcacctctacaaacgaaaaaaaaatacataggctgggcgtggtggcttatgcctggaatcccagcactttgggaggccgaggcgggcggatcacctgaggtccagagttcgagactagcctgaccaacatggaacaaccctgtctctactaaaaatacaaaattagccaggcatggtggcacatgcctgtaatcccagctactctggaggttgaggcaggagaatggcttaaacccgggaggcggaggttgctgtgagccaagatcacgccattgcacctcagcctgggcaacaagagcaaaactctgtctcaaaaaaaaaaaaaagaaaaaaaatagacaggtgtataggggtgcactcctatagtcccagctacctgggaggctgaggtgggaggatcacttgagcctgggagatcaaggctgcagtgaaccatgattgcaccactgctctacagcctggtcaacagagtgaggccctgtctccaaaaacaaacaaaaaaaatctaccacagtgggagtctgaggcaggaggatcacttgagcccaggtggtcaaggctgcagtgagccctgatcgtgccactgcactccagcctcagcaacagagcaagaccctgtctccattttttttaagttaaaaagaaaagaaaggcccaggcagagatggctttgctgatgaattccatcaaacatttaatgaaaaattggtaacagatcacaaactcttccaaaagacagaatatacaaaaatcaattgtatctctatacacattagcaatgaacaatctaaaaatgaaattaagaaaacaatttcatttacaaaaacaccaaaaaagaataaaatacttaatctatttaacaaaagaagtataaagcatatactctgaaaactacaaaacactgtggaaattaaagacctaaataaatgaaaatatgtttcatgttgatgaatgaacacaattcctatcaaaatcccagttgccctctttgcagaaatggacaagctgatcttaaattcatatggaaattcaagaaacccagactagcgaaaaacaatcttgaagaaaagaacaaagttggaggactcacacatcctgatttcaaaacatactacaaagctacagctgaatcaagacaatgtagtctacaggatagacatgtagatcagtggaacagaactgagaacccagaaataaccctcacatttacagtcaagtgatttacaacaaggatgccaagacaatttattaaagaaagaattgtcttttcaacaaatggtgttggaacaactggatatccacatgcaaacaatgcagtttgaatgcttttctcacatcacaccctcaaattaattcatattggatcacaggcctaaatcccagggctaaaactataaaactcttagaagaaaatataggagtaaatctttgtgagcttggattaggttaaatataacaccaaaagcagaagcaaccaaagaaaaaacagataaattggacttcaaaatttaaaacctttgtacttcaaaggacactatcaaaaaagtgaaaagtccaatagcaaagacatggaatcaacctaggtacccaccaacagtggattagattttttttaatgtggcatatacaaaccatgaagtattatgcagccataaaaaagaatgaaatcatgtcctctgcagcaacatggatgcagctggaggccagtatcctaagtgagttaacacagaaacagaaaaccaaa

SEQ ID NO: 494 - DNA, 22984 bp, Homo sapiens
tgcagttgaaattttaactttattattttcctattacaaaagcaacacatattcattacataataaaagggagggagctcaaaagatataaagaagtctatgttttttttgtttgtttgtttttttaaaggagtctgttttaaaattgcctattatcctattccagggaaaactattaacattttgccatatttcattttatcagtcttttcctatgtatttttgaacacagctcaaatattactctatataaagacttgtattcagctttttcaacataaattacattaaagttatttttatgtcaataaaaattatctttgtaaacaaaattttaatggcaaaataacatttcatcatatagacatactgtaatttatttaaacactctcctaaaatcaaatatttagttaggagaaagttagtaggtcaaagcatataaacattgcgcaggtcactgtggcctaaaaaggctgttcttttttattttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgggattacaggcgtgagccactgcacccggcctcaaaggctgggagggaatgcagtgactctgcgggtgaggggtggtatcaaggccggcagcaagacagagaaggctcacaggtcctggcctagccgctccagctcgttgaggaggaagtccatatcagcacaggtcagtgcagagttggccacaaccacacggaagaagttgccccgggtcccgtggggctggtagccaatcatcatggagccctccttcaccatgcgctccttgagcacgggggccacctgtggaagggtggagagagattccagctgcagcctgggtcggctgacaggtaggctggcttcttgtcctgccaggcttccagaggtgcttttccttcccacccagccaccttctgggggtagcacaccttgctcagaccttgaccttggcctcagtttacctttctgtcatatctaacctgcttggccttcgctatcttctgcttttctccccatttctcctgtctccaagaaatctgtcctgtgggacattttctgccaaatcttgactttctcttgattcctaacactgctttagtctaacttcaagccttggtcatctaagccttagtcaacaccttcttctcccctctcttaattcctgtaatatttttgataatattaatctgtgccctgtgatctagcaagtaatttacaacactgccttgaacacattgcttccaagtaggtaactcttgccttataataacaactccataagggcaagaacatttgtcctttcagatcatctgcagcacctagtaccactctatctttagggaccaggatataacacagctcctcgcctccagatggcacttctagactggctttctcgggttgctgtgtccctagcacgggtaataaggcttttccatgatcattctgcctcatatctgtcctgggcctgagttcccagcccaattgccagcacaaggctctgtgtactacacactggtgacttctctgacttctcctgtaacacacgtcgctgcttcttacttcccagaaacataccttcctccccatccccacccctaccgaaaagagagcatccacgcctcagagcaagagaccagcaaggagacctgccatgccactcccagccaacagggggcagaagcgcatcagttgcatcagctccctaacgggtaaagagagcagcacagcacgcctacctttgacagcctttcgtggtaatctggactctcctgcttccctcgcaggctggggggtacgaaccagaaacacacattgacaaactcaggctgagaggaatgagaaagaggaaggtgtgagctgagaaagggggaccgttttccctctccctgcccctttcccctctccctgcccttttccctccactagggctttagttggggcttgggggctgcaaaagagctaggctggggcaggggccacaaaatagaaaggggtcctacctccatgactagctcaaacccttcccgcttcttcatttcctccaccaggtacctgtgaacagagagtgagaaaccataggcggggaggaaaagcagagatccagacagaagaggcccacgtagaatgagccacagagagaccgagagaaaagtaatcccgggagcaggaaagagggaggggcatggacccaggagaggggaacagggacgaccccccacctcctcccgcctaccgggcaaggacaaaggcctggtcgatgcgccgctccagcccttgatcgccctgtgccttccacatgagccacagcttcagacagtccacacggcggccacactgcaccaccttgtctcccgtgtccagagccacatcgtagaacttgtcctgctggaaaaggtagctggcctgggacccatggcagcgcttgagcaggttctgtgtgggggtgaggagattgtcagaccctaccctctccaccgaggctttcctccagggctgcactgtgggggtcttagctcaggataccctcttctttccctggagccagatggcactgctgggacggctgcctgctggctccaacacctttctttgggtttcctcccaatacccagggttcttcccaaactctgatggcaacctcaagctagaaactccaggatacctctgactccaacttcaagctggaaacttttcttttaagagaggccactgggggagtgaaggagcctaatacaggttagggtggtagctgagatgcagcttcagaagggatggtaaagagaatagagaaaggcctgaactttatctaaggtgggatagagaaggcagagctccagagagaggtggggctggtgcaggggcaggggcagacccaccgaggtatcctggagaagaagtgcagagcattgcaggcctgctgcgaggagcttgtggggattccaggccacagagtcagccctggatggggtggagcaaaggcaggtcagtggctcctcctccagctgcccaaccagagcccttcctccttttccaggtccccagcaaaggggctttggtctcaccctcaccccagcatcaggaagaactgccatgtctgacctcccagctccaatcaatcctctctccagtccccctcccctcagcctcctaccccagccatgttaaactccctagtccatgatgattctctggaccaatggtttgaagggcgggatttgggaagaaggggactgtatgcacctctggatcccatccaggagatgcctgtgtgtctgtgacagcaggacgctcccaccccaggcagcctgtggagcaggaggaacaacgtgggccttggccttggctcagcccaccccaccgcacccccaagccgaagtcccactcacatccacatgcagccatagcccatgacgctggcacacatcagcaattgcctccagggggtcaaaggcccctagcacagtggtgccagaggtggcactgaccaggaacggcacagcaccctgttgccaaaatgtagagggagaaagatgtaaagtcatctcaaaagctactcagagcctgatgctgggcccagctctaagctctttgcatgcctaaaatggcccatttcaacctcacaacaatgtgttactgtcctttttaatgtgcagccagggacactgagattcaaagatccaagcagaagctgcagagatggacttcgaacctaggttttcatttccaaagctcatactctcaaagaacttgaatgttttactggaagatccaatgctattgaaaaaaaattgagtcaggcatagtggctcacacctataatctcggcacttcaggaggccaaggcaggattgcctgaggccaggagttcaagaccagcctgggcaaaatagcaagaccccatctctaaaaaaatttttttgtttaattagccaagtgtagtgggcatgcctgtagtcccagctactcaggaggctgagatgggaggattgcttgagcccaggagtttgaggttacaatgagctatgattttgccactgcactccagcctgggcaacagaatgaaagcctgcctcaaaaaatataaacaaataggccaggcacggtggctcacacctgtaatcccagcactttgagaagccaaggcaggtggatcacttgaggccaggagttcaagaccagcctggccaacatggcaaaaccccgtctctattaaaaaatacagaaattatctgggtgtggtggtgcacgcctgtaatcccagctacttgggaggcggaagccgaggcagaggcatgagaatcgcttgaacccgggaggcagaggttgcactgagccaagatcacaccattgtactccagcctgggcaaaagagcaagattctgtctcaaaaataaataaataggctgggtacggtggctcacacctgtaatcccagcactttgggaggccgacgcgggtggatcacgagatcaggagttcaagaccagcctggccaagatggtgaaaccctgtctctcctaaaactacaaaaattagccaggcacagtggcaggcgcctgtaatcccagctactcaggaggctgaggcaggagaatcacttgaacctgggcagcagaggttgcagtgagccaagattgtgccactgcactccagtctgggtgacaaagtgaaactctgtctctaaataaataaataaatttgaatagtacaaaagtttatgcagaaattgaattagtaatttttaaaactactacagctggatgtggtagctcatgcctgtaatcccagcactttgggaggccaaggcaggagaattgcttgagcctaggagttcaagaccagcctgggcaacctagtgagacctcacctctacaaacgaaaaaaaaatacataggctgggcgtggtggcttatgcctggaatcccagcactttgggaggccgaggcgggcggatcacctgaggtccagagttcgagactagcctgaccaacatggaacaaccctgtctctactaaaaatacaaaattagccaggcatggtggcacatgcctgtaatcccagctactctggaggttgaggcaggagaatggcttaaacccgggaggcggaggttgctgtgagccaagatcacgccattgcacctcagcctgggcaacaagagcaaaactctgtctcaaaaaaaaaaaaaagaaaaaaaatagacaggtgtataggggtgcactcctatagtcccagctacctgggaggctgaggtgggaggatcacttgagcctgggagatcaaggctgcagtgaaccatgattgcaccactgctctacagcctggtcaacagagtgaggccctgtctccaaaaacaaacaaaaaaaatctaccacagtgggagtctgaggcaggaggatcacttgagcccaggtggtcaaggctgcagtgagccctgatcgtgccactgcactccagcctcagcaacagagcaagaccctgtctccattttttttaagttaaaaagaaaagaaaggcccaggcagagatggctttgctgatgaattccatcaaacatttaatgaaaaattggtaacagatcacaaactcttccaaaagacagaatatacaaaaatcaattgtatctctatacacattagcaatgaacaatctaaaaatgaaattaagaaaacaatttcatttacaaaaacaccaaaaaagaataaaatacttaatctatttaacaaaagaagtataaagcatatactctgaaaactacaaaacactgtggaaattaaagacctaaataaatgaaaatatgtttcatgttgatgaatgaacacaattcctatcaaaatcccagttgccctctttgcagaaatggacaagctgatcttaaattcatatggaaattcaagaaacccagactagcgaaaaacaatcttgaagaaaagaacaaagttggaggactcacacatcctgatttcaaaacatactacaaagctacagctgaatcaagacaatgtagtctacaggatagacatgtagatcagtggaacagaactgagaacccagaaataaccctcacatttacagtcaagtgatttacaacaaggatgccaagacaatttattaaagaaagaattgtcttttcaacaaatggtgttggaacaactggatatccacatgcaaacaatgcagtttgaatgcttttctcacatcacaccctcaaattaattcatattggatcacaggcctaaatcccagggctaaaactataaaactcttagaagaaaatataggagtaaatctttgtgagcttggattaggttaaatataacaccaaaagcagaagcaaccaaagaaaaaacagataaattggacttcaaaatttaaaacctttgtacttcaaaggacactatcaaaaaagtgaaaagtccaatagcaaagacatggaatcaacctaggtacccaccaacagtggattagattttttttaatgtggcatatacaaaccatgaagtattatgcagccataaaaaagaatgaaatcatgtcctctgcagcaacatggatgcagctggaggccagtatcctaagtgagttaacacagaaacagaaaaccaaataccacatgttctcataagtgggagctaaatactgagtccacatggacagaaagatgggaacaaaagacagtggggactataagaagcgggagggaggggagaaaaggttgaaaacatacctattgggtactatgctcactacctgggtgatgggttcaatcgtgccccaaacctcagaatcacaaaatatacccttataacaaacctgcacatgtacttactgaatccaaaataaaagtttcaaaaaagtgaaaagtcaacctagagaatggaaagaacatatctgaaaatcatatatctgataagggacttgcatctagaatatatgaagaactcttacaactcagtaataaaaagacaacataatttttttaatgggcaaaggatctgactagacttttttcaataaagataaataaattgctaataagcacatgaaaagatgctcaaccatcactaatcattagggaaatacaaatcaaaactacaatgagttaccacctcacacctattaggataactactatcaaagtaacagaaaatgaggggatgcatggctcatgcctgtaatcccagtactgttgagaggctgaggtgggagaatggcttgagcctaggagttttgagaccagcctgggcagcacagcgaaatggaattttggtagagatgtgtctctaccaaaaataatttttaaaattggccaagtgtggcagcctgtgcctgtggtcctagctccttgggaggctgagatgggagaatcatttgagcccaggaggtcgaggctgcagtgaaccatgatcgcaccactgcactccagcctgggtgacagagcaagaccctctctcaaaaaaaaaacaaaacaaaacagaaaataacaagcgttggccaggcgcggtggctcacgcctgtgatcccagcactttgggaggccgaggcgggtggatcacaaggttgggagatcgagaccatcctggctaacacggtgaaaccccgtctctactaaaaatacaaaaaaaaattagctgggcgtggtggcgggagcctgtagtcccagctactcgggaggctgaagcatgagaatggtgtgaacctgggaggcggagcttgcagtgagccgagatcacgacactgcactccagcctgggtgacagagcaagactccatctcaaaaaaaaaaaaaaaaaaagaagaagaagaaaataacaagcgttgacaaggatgtgaataaattagaacccttgtgcactgcaggaatgtaaactggtacagccactatagaaaacagtatggcagttcctcaaaaaaattcaatagaattaccatatgctccagcaattccacttctgagtatacacccaaaacactgaaagcagggtctcaaagagattccaaacagcaacccaaacagataaatggataagcaaaatatggcatatatgtacaatgaaatattattcagccttaaaaaggaagaaaattctcacatgctacgacgtggatgaaccttgaagacattctgctaagtgaaataagccaatcgaaaaagacaaataccaccgggtgcggtggcccatgcctgtaatcctagcactttgggaggccaaggcaggcagatcacaaggtcagagtttgataccagcctggccaacatggtgaaaccccgtctctgctaaaaatacaaaaaattagctgggcatggtggtgcgcacctgtaaccccagctactcaggaggctgaggcaggagaactgcttgaacccaggaggtggaggtggcggtgagccgagatcgcaccattgcactccagcctgggctacaagagcgaaactccatctcgagaaaaaaaaaagaaaagaaaagacaaagacaaataccgtgtgattccacttatataagtacttagagtagtcaaagtcatggagacagaaagtagaatggtggctgccaggggctggaagagggggtaatgagttgttgtttgatgagtatggagtttcagttttataaaatgaaaagagttctgctgggtgtggtggttaatgactgtaatcctagcattttgagagaccaaggtgggcagatcacttaaggccaggagttcgagaccagcctggccaacatggcaaaaccccatctctattaaaaatacaactagccaggtttggtggcgaggggcctgtaatcccagctactcaggaggctgaggcacgagaatcgcttgaacccaggaggcagaggctgcagtgagctgagactgtgccactgccctctagcctgggggacagagtgatactctgtctcagaaaaacaaaacaaaacaaaacaaaaaaacaagatgaaaagagttctggagactggttgcaaaacaatgtgaatgtatttaacactactgaactgtacatgtaaaaatggttaagatggtaaattttatgttacacacacaaaaaaacaagtagaactggcagcagattctcaacagagactctactggcatgttgggtgagtcagttcttgttcatgtagagctatacctgctcattacaaaaatgtttaggatccctctttccctctcaataaacacagtaatgccctctggctagtgtcacaaaacaaagcaaaataaaacagttccacacacttcaaatgcccacttgatgactaggagagtgggggtagatggcagcaccagccccaagcaagtatccatggatgaggaagactacaggtggggtggaaacagtccaggcaaaggggggaagctgctccaactccatatcttcaattccagaaatatcccgtggcctctgcacatacacagaatcttcttgtctacccaaaggggcaccacctagttcatttcttttctcccttccagtctcagctcaaccatcccttctgagggaagccttccctgactccttcacctcctgattaggtcaattctcctgtattctatgctcaaagagcacaatgtacctcaccttcatagcacatatgcagcatttttacatatatttatgaatgtcagtcttccttactggaataaaaattctatgaaaaacaaaatgggtgaaggatctgaatagacatttttccaaagaagatatacaaatggccaataagtacatgacaagatgctcaatatcattagtcatcagggaaaatcaaatcaaaacacagtgagatcccacttcacacccactaagtggtataatcaaaaaaagatatgacaagtgctggtgagtatgtagagcaattggaaccctcacacactgctggtgggattgtaaactggtgcagccactctggaagacagtctggcagtttctcaaaaggttagatacagagttactatatgacccagccaattccactcctaggtatataaccaagataaatgaaaacgtattttcacacaaaaatctgtatacaaatgttcatagcagcattatgcataagagccccaaagtggaaacaacccaaatgtccatcaactgatgaatggataaataaatgtggtatatccatttaagggaatattatttggccataaaagaagtgaagggttgatacacgctacaggttggatgaaccttgaagacattatgctatgtaaaagaagctcatcacaaaaggcatgcataatatgattccagaattcacaacaggcaaatctatacagacactaagtagattactggttgcctagaactgggagctttgggagaattacagagggatggctaaagggtatggggtttctttagggggtgataaaaatgttctaatactgattgtgatgatgtttgcacaactctgcaaatatgctaaaccactaaatagtaccctttaagtgggtgaattatatgttaggtgaattatatgttatgtgaattatatatcaataaaactattaccaaaaaagtttctataataaaaagagaaacatcactattctaattgctgcccttactgctactcagaggtaacatccatatatcaataatatatactcttctaaataacaaaaatgggctcatagggctcataatgtccattctatacggcaatttgcaataaatatttaatatatacagtggagatactttcatgttagtatatatattctcacctattcttttaaatggctacccagtactctaataatagtaataaataataataacaacaataccagtagcttgtatttatacagtgcatctatgtgccaggaactattctaagtgctttacatatactaattcattcaatccttacaataaccctatgtggcaaattctatactctgtccattttacagaggaaggaactaagacacatagatataccataatttattttgtctactaatggacatttaaatttttttttaaaacatttatggccaggcatggtggctcacgcctataatcccagcactttgggaggccgaagcaggtggattgtttgaggtcaggagttcaagaccagcctggccgacgtggtgaaaccccatctctactaaaaatacaaaaattagccaggcgtgttgatgcacacctgtaatcccagctactcaggaggctgaggcatgagaatcactcgaacccgggaggtggaagttgcagtgagccgagatcgtgccattgcactccggcctgggtgacacaacgagactctgtctcaaaaaagaaaaaaaaaatggccgggtgcaatggctcatgcctgtaatcccagcactttgggaggctgaggcaggcggatcgcctgaggtcaggagtttgagaccagcctgaccaacatgcagaaaccccatctctactaaaaatacaaaattagccaggcctggtggcacacgcctataatcccagctacttgggaggctaaggcagaggaatcacttgaacctgagaggcggaggttgcagtgagtcgagatcacgccattgcactcctgcctgggcaacaggagtgaaactccatctcaaaaaaaaaaaaaaaatttttacatttatatttatttatttattattattatttttgagatcacaccactgcactccagcctgggtgactgagtgagactctgtctcaaaaactattaaaaaataaaaataaataaaattgtatagatggtgccaaaatgccctccaaggtggctgtagcagttacatacccctcgaagtagaggagagtgctaatgtcccctcatccccactactcacagccttcaccagtgcctctcccctcctcagcctctccctgcgcagaccctcacagcccacaggaaccttccacactacagcgcaggcccccagcaccctccctgtggtgctgcctgggactcgctccctcactcagccctgcctctcagaatccaacccggcgtaggtgtctgggcagagccccagaaagcaatgtagtgtcctcacccccaggctctccatggtcacttcagcccacaggggagatgggcatggagacgagagggatgaaggatgccttgagaaaggagagcccaaataaccctccaagacagttggaggctatatcaccccagcgagcctcactgactcacctcagcctcggccataccaatctgcctctccagatcctcggggaccattttccctctgaaaaagaaaatgcagagggtagagcagggacaggttctctgttgaaggcagggtaaggtggggttagcaatgcagagacaacagtgctagtttttccctcagggggtgaaacagatctcagggcagaggtgggagacgctggcaggctctggtagacaggaacagcaattctactgaatagcgaggggagagaggtccaccagcggtaagggtctgatgccagagctttctggcggcaggaagttacgctgtgcaaagctaggtcacagccatgtgggcagaaggaccttcacctctcatcagccttgaccactcggacactgtcggtgccaagtcccagaaacgcagctcccttctggatggagtagtgacactgtgggggaaggcagagggcaagttagcacaacttgatgggggaggggagagaaggtaaaagtcaagtgtgagctccaacaaatgggatcctgtagaccagggcttctcaaatgtcagcgtgcatacgaatcgcctgggtgtctggttaaaatgaaatgcaggttctggtccactaggtctggggtctagggtggggcccaagattctgcatttgtttgttttttttttttttggagacaagagtctccctctgtcacccaggctggagtgcagtggtgtcatctcggctcactgcaacttccgcctcccaggttcaagcaattctcgtgcctcagcctcctaagcagctgggactacaggtgcccaccaccatgcctggctaattttttgtattttagtaaagagggggtttcactatgtttcccagggtggtatcaaactcctgagctcaggcaatccacccacctcagcctctcaaagtgctgggattacaggcgtgagtcaccgtgcccggccagattctgcatttctaacaagccccaggtcataccaatgctgctggtccacagaccacactcttgagtaggaagagtatggactgtgtccactgcactcacggcccctcctctgcccccaaacagaaggcaatgtgaacaggagcagttacttgacctccttgattggaaggaagcacatccgcctgggggcaggctggccttggaggatgtagggagggcagggagaagacctggaaggtctctacttagctggctggagattagaatcaggagcccagggttgggcctgtgcctcttccccacctccttcgatgtgaatagggccaggggcggcagtgtgcggaggcccctctgcttgcaatccgggtagcgctgatagcgggccagatttacagcatacatgttggagatggagccacctgtcacagggagggggcggtggcaagaggaaggagcagtgggtcaagactggagcttgcctcccttccctttctaccagaagagctcatcaaagaagcaggtatgactggctcccaggccacaattctcaggatcataccatcccagaatggatccaggatcagcagatcctcttgaccacacctctccacatctggggctgcccccaagagacagcccccgtccggagatagcaggaactagaccactgaccccagggaatggtgacaaacatgagcatgaagggaccaggcagccgcctccctggcctggcctgggtccagctggagaggaatcaaagaggaatcatccctccctgccagacactagagcaagagaacggtgggggaggaggaactcataaaaagggcaaagaaaggtcctcctccttctcacaaaccagggcagaagattccgtccccagagctccagcccaccagggcccgcagtttcctcagcacctcctcttccatgagcacaaacacgggggcgatttcatatgtgtacctgccaggagagagaacgacgagaaaggagagatggggagggactgcccagacaggcccttaaactgcacaggagtcacaaaaaggaggcagtgaagagtgagcaaagcaacagtccaaggagaagaacgagttggtgacagaaccagggaagcaagaaagagaaaacaggggtcaggaggcctgagaaagtttggagaaagtgggtccaaaggatatgaggaaaaactctctgccgacagggattcccagaagcagtagagagagggcagaaccattctcctcccctacccctcaggcacctctctagcaaacctaaatcctttgtgggatggtagaggggccttgggatgctcactggctggtgttgaggctctcagtgataatgcgcccggccagagcatggggatccaacccagagaagagctggttgaagaaccgagggtgacctggagaaggagagtaagccagggagctcagagtagagctcagggcaaactcccaagtctcctcctcacagaagccagggcccaccagtcttgacactgtagcgaatcacagcccgacaccgctccaggatctgcttctgtgactcgccctggctccgcagctccaaatccagcagctgcttcagctcctcaggctccttccactcacagacctaggaagagagccggggatgctgggggcctgggatgcctgtggactggctgtcaaaccacacctccacagacacgagacacggccaacctgcactaaaaacaacttcgggatatttccaaagcaaaactctgaaaatgaacaagagtagtgaacacagtaagacccagaatgtaaatccctgaggtacccaggggggcagggatgaattctggggagaaatcttatcaaaggaggaaagttctgagccagatttggaaagagaaagagaaggcttgggccaggcgtggtagctcacgcctgtaacctcagcactttgggaggccgaggcaggcagattacctgaggtcaggagttcgagagcagcctggctaacatggtgaaaccccgtctctactaaaaatacaaaaattagccgggcgtggtggcacatgcctgtaatcccagctactcgggaggctgaggcaggagagctgcttgagcccgggagacggaggttgcagtgagccaagattgtgccactgcactccagcctggccgatagagcgagactctgtcaagaaagaaaggaagaaaggaaaaaaggaaggaagaaagaaggaaggaagggggggggagaaagaaaagaaaggaaaaaagaaaagagaaaagaaaagaaagaaagcttgatgggaaggaggaggaagaaaggactcaccttctgggagacactggttcctttctgaatggcctcatccacaacaaccccaaacacggcccggagcaaggcttccacagccactgggtccccagcaagggaggggagtgcttctgagtcagccatcaggatctgtggcagagcagagtcattccctactcagcctgtcaacccttcccggacctacccagcaggagcctcctctcccaaacgggcctgaggcccaaaccctgcagctcagtctcggcctccagtgcacagacaagggcaagtgagagtgcccagggagaaaaccagtgggaacaggtgggagagaaaaggcagtcagtgctgagcaagtggactctagtggccatttccacctaaggcagagacaagcttacctctctgctcaggagagccggaggcagggtgcacaggtagctcctcaggacagcaggaccaagatggcagaggaagtggggtgaaaagtgtacaattaagtgtttttttcataaattcacaaagttgttgcaaccatcatcactatctaacgccagaacattttcatcacccaaaaaaaaacctcagtagcagtcatttcccattctccccttccccgacccctggcaactactaatctactttgtttctgtagatttgtctagtctggccatttcatgtaaaacgggtcatacaggccaggcgcagtgggtcacgcctgtaatcccagcactttgggaggccgaggcgggcggatcacgaggtcaggagatcgagaccatcctggctaacacggtgaaaccccgtctctactaaaaatacaaaaaattagccgggtgtggtggcgggcccctgtagtcccagctagctactctggaggctgaggcaggagaatggcgtgaacccgggaggcagagcttgcagtgagcagagatcgcgccactgcaccccagcctaggcgacagagcgagactccatctcaaaaaaaaaaaaaagaaaaaaagaaaatactgaaaaagaaggaaaaagacttcaaaatattcatttgtggctatttctgggtgttgttatggatgatttttaagtttattatttatacacatctatatttttataactttatacaatcatttcacattgcttatggaattaaaataacggttctttttaaacaatataaaaattgtccgcgtgtggtggctcacacctgtaatcccagcactttgggatgctgaggtgggtggatcacctgaggtcaggggtttgagaccagcctggccaacatggcgaaacctcatttctactaaaaaatacacaattagccgggcgtggtggcgggtgcctgtaatcccagctactcaggaggctgaggcaggatccacctgaacctgtgaggcggaggttgcactgagccaagatggtaccactgcactccagcctgggcgacagagtgggactccatttcaaaaatatatatatatatggaggaattaagggggtacaagaattctaaaatatacaaatcatcaggctcaaggaatgtcccttgcacatcatgtggtttcccaactcctcaatccactgttatcaaaggtctaatggaaggcaaagggagccacacactgctcatctctattacgcaacccctcaacccccgctggctctcagggaagggaatgggttcagtttgttcagcaaacattgactgagtgttgtctacttctgagcgcctggctggcattaccctaggtgctgcatctgccctgtgggctccagctaacaggctggcaagagagacctgcatgtaaaataaagggaaattgccacaagagggagttgagaggtcaccatggaaaggcaggaaagttcaactggcccaggacaggcttcaaggacaaaacactaaggctctccttaaggcaatagagagctggtgcaggaaaagactcagcaggagtcattgcaatgctatttgaataagtgatggagtgggcctgagggaagagggagttagggaaggtcacacaggaggaggcctgcctggggacaaagggatctaggcaattgtctcctgaagcgctctcagccaggtttatggttagaaagctaaagtactctgtgctatctcccaatcaacaaaccctagtggctccacacccacattaataaaggcacaaactctcctatgtatacaatcttttctctgcttctagactgtactctcctgggtggagagaactaagtcttttccttcattaagtaaactaatagaaaacagggacccctcaaatgttagtttccatcttcttgattgtcctctcccctcccccagggacttgcacagaggcattacataaacatttgttaaatcaatcaatgatttgcaggtactggaaaaaatgctgcattctacttacatttgatttgcatcaaccaagaatctgtagtaatgataatagatttgcaaagggtgtttttccttctcatttattatcttatttgaccttcacaatagtattagaaattagcctaaataggtatttattcattcttgttttcaagatgaggattcttagctgaaagaaggtgaactaattgtccaaaattacaaaggtgacatgggaacaagcctagatcactgactttctgactttaggctacctcttccactgcatcacaggtccgtgtggcatttctcactatttctcatcattgacaaaaattaactgcagctaagataaagacagaaactgaaaatatacaaccataagaatacaagaagggggggtgaggggcgggcacagtggctcaagcctgtaatcccagcacttgggaggccgaggcaggtggatcacctgaggtcacctgaggtcaggagttcgagaccagcctgaccaacatggtgaaaccccgtctctactaaaaatacaaaaattagccgggtgtggtggtgcatgcctgtaatcccagctacttgggaggctgaggcagaagaatcgcttgaacccgggaggcagaggttgcagtgagccaagatcgcaccattgcattccagcctgggcagcaagagcaaaattccatctcaaaaaaaaaaacaagaataccagaaggggctgggagcagtggctcacgcctgtaatcccagcactttgggaggccagggcgggtggatcacgaggtcaggagatcgagaccatcctggctaatatggtgaaaccccatctctactaaaaatacaaaaaattagcccggcatggtggtgggcacctgcagtcccagctactcaggaggctgaggcaggagaacggcgagaacccgggaggcggagcttgcagtgagccgagatcatgccactgcactccagcctgggtgacagagcgagactccatctcaaaaaaaaaaaaaatatttatttattattttagagaataagttttgctgtatcacccaggctgaagtgcagtagcacaatcatgtcttactgcagcttcgaactcttgggctcaaacaattctcccacctcagcctcctgagtagctaggactacaggcacatgccagcatgccgggttaattttttaattttttgtaaacagggtctcactatgttgcccaggctggtcttaaactcttggcttcaagcaatcctcccacctcagcctcccaaagcactgggattacaggtgtgagccacctcgcctggccaaaatataatgtttttattgtgaatcagattatttattctatggtattttagtgttggttatattcttatattttatttatataatttttgtttgttaatctgacatctggtcatgttgctgaactccatagttttgatacattgtcaatcgtttctctttgtaagatgaatatatatgaaatcaaggaggctttagggtggccaggagctctcctaaaatcttagttttaatagtaaacatccctggcttgttcctagcaaagacagaaatgtttcaaatattttcccataaagcatgacttttgtctcaaaagctgaaagataagtgaaaaagagaaaatattttaaatgcagacgacaaagaatagttattatccataacacagacaggatttctaccatcaataagaaatatacaaatgatctacctttttttaatgggcaaaggatatgaacagacagtttacaaaaacaattaaaatggtcaaagagcaataaaatagtcccacctatttggaaggctgaagtgggaggatcacttgagctcacgagttggaaaccagcctaaggcaacaaagcgtggagacccatctatttatttatttatttatttatttattttttgagacagagtttcgctcttgttgcccaggctggagtgcaatggcacaatatgggctcactgcaacccccgcctcccgggttcaagtgattctcctgcctcagccacctggtaactgggattacaggcacgtgccaccaagcccagctaatttttttgtatttttagtagagatggggtttctccatgttggcccagctggtctcaaactcctggcctcaggtgatccgcccacctcggtctcccagagtgctgggattacaggcgtgagccaccgtgcctgtccagagacccatctcttaaaaaaaaaaaaggcaataagagaatattaacttcactattaatgacatgaaaattaaaacaaatactatttttcacccattaaactagtaactgtataaaaaattcatagcatacactaaacattgccaaagttgtaggaatagggaacattcacacatggttctgagtaaacatgggagttgttacaaacttttacaattcattttcacagaatctattaaaatttacatatccggccaggcatggtggctcaatcctgtaatcctagcactctaggaggccgaggccaatggatagcttgagcctaggaattcgagaccagcctgggcaacatggcaaaaccctgtctctacaaaaaacaaaaaaacaaaaaaaaaactacaaaattatccaggcacagttgcccacatctgtagtcccaactacttgggaggctaagatgggaggattccttgagcccaggaggttgaggctgcagtgtgccctgactgcaccattgcactccagcctgggcgacagaccaagaccctatctttaaacagaatgaaaatagggccgggtgtggtggctcacacctggaatcccagcactttgggaggccaaggtgggtagatgacctgaggtcaggagttcaagaccagcctgaccaacatggtgaaactccatctctactaaaaaatacaaaaaaattagccgggctggcagcaggcgccagctactcaggaggctaagccaggagaattgcttgaacctgggaggtggaggttgcagtgagccaagattgtgccattgcactctagcctgggtgacagagtgagactccatctcaaaaaaaaataaaaataaaaataaatttaaataaaagcacatatcctatctataaatccttataaatgcaaaaggtaacttttttttcttttttgagacagagtttcactcttattgcccaggaaaggcacgactctcgcctcaccacaactcccgcctcccgggttcaagtgattctcctgactcagcctctcgagtagctgggattacaggcatgtgccaccacgcccggctaattttgtatttttagaagagacgcggtttctccatgttggtcaggctggtctggaactcccgacctcagatgatccgcccacctcggcttcccaacgtgctgggattacaggtgtgagccaccctgcccggagcaaaaagataactatttaaggatgttcattattgtattgtttataaagcaaaaaaatctgaaacctaaatgttcatcaagatgggacaaggcacacacataaactggaatactgtgcaacagttttttaaatgttagctgactcagatgtctaaaatacactgtatggcgcattacaggtgctcaataaatactggttgaaaagatttttgtatgaacacagaaaaaagcctaaaagcatatataccaaactggtaagaatgattcccttcaggagcatgggataagtagagggggagaataaccattttgtgtcttttatacttttgcgttgtgtcgatttgtaaaataagtaggagctaattttcaaaaaagatttaaaagacttattcctggtgatgtttctttatctctctctttctccattttgtctctattttagaatgatcctaaaacacaaaaaacgtactttcaatggcccaaatcatggagtggctcagggaaatgaaatctgtctacaaaaaaaaaaaagttgagaatccttgtctttttttcatcatacagttttttttttcttttggtatcaccattacttctcctaaagtcacgacataatatcacctacagcagaaatgaggacttcagtggaattgacatctccttccatcaagcgcatttgcagtccatctttagcaggacctctctctaatggctaaggctaggcagaagaatttgaagacagtctggtttccattttcctaatgcagcctggcccaagagccaggactcccataagactagtctactgtgggagtcagggtcttttccacgtgtggaggctagtgtttgatgctggacggcctggagtaaagggcgaaggggagaaggtaaccaaccaggctggcctcgggattcgcagaggagggctggggctttgacttctgcagggaggtgagcagtgtggccaagggctactcaaggaacgcctctgcgagaattcagactgtggttgagcgcacaaagcaagagtgtgcgaagaaaagttaacgcctctcccagctgaccccaaaatctgctaatctgggcctgacggaaaaaattcggagaagaaccacctcggccgagttacgtgaaaaggctgggtacgaactactctggctctacttggggcgccggctcagagcgatgggcaggacgtccgcgaggaagaaagagtgacgatgatttttcaaggagtctgaaccagctcacccagcaaaccctcctcccatcgagcacccagcgtacaatcatcgaagggccgagggtcctgccctcagtctcgatggcggccggggcgcgccccggccacggcgcacgcgccggcctcagcgctccctcctccatgccctcggcgcacggcgccgcccactcacccagctgcacctctccgtgcgtccccaagctcacccgctctgaggctgcccccgctagtctagctgccgagcccggaagt

SEQ ID NO: 495 - DNA, 23247 bp, Homo sapiens
tgcagttgaaattttaactttattattttcctattacaaaagcaacacatattcattacataataaaagggagggagctcaaaagatataaagaagtctatgttttttttgtttgtttgtttttttaaaggagtctgttttaaaattgcctattatcctattccagggaaaactattaacattttgccatatttcattttatcagtcttttcctatgtatttttgaacacagctcaaatattactctatataaagacttgtattcagctttttcaacataaattacattaaagttatttttatgtcaataaaaattatctttgtaaacaaaattttaatggcaaaataacatttcatcatatagacatactgtaatttatttaaacactctcctaaaatcaaatatttagttaggagaaagttagtaggtcaaagcatataaacattgcgcaggtcactgtggcctaaaaaggctgttcttttttattttttttggaacagagtctcgtactgttgcccagcctggagtgcaggggtgcaatctcggctcactgcaacctctgccccctgggttcaagcaattctgccccaacctcctgagtagctgggtttacaggcacaggccaccatgctcggctaatttttgtatttttagtagagacagggtttcaccttattggccaggctggtctcgaactcctgacctcaagtgatccacccgcctcggcctcccaaagtgctgggattacaggcgtgagccactgcacccggcctcaaaggctgggagggaatgcagtgactctgcgggtgaggggtggtatcaaggccggcagcaagacagagaaggctcacaggtcctggcctagccgctccagctcgttgaggaggaagtccatatcagcacaggtcagtgcagagttggccacaaccacacggaagaagttgccccgggtcccgtggggctggtagccaatcatcatggagccctccttcaccatgcgctccttgagcacgggggccacctgtggaagggtggagagagattccagctgcagcctgggtcggctgacaggtaggctggcttcttgtcctgccaggcttccagaggtgcttttccttcccacccagccaccttctgggggtagcacaccttgctcagaccttgaccttggcctcagtttacctttctgtcatatctaacctgcttggccttcgctatcttctgcttttctccccatttctcctgtctccaagaaatctgtcctgtgggacattttctgccaaatcttgactttctcttgattcctaacactgctttagtctaacttcaagccttggtcatctaagccttagtcaacaccttcttctcccctctcttaattcctgtaatatttttgataatattaatctgtgccctgtgatctagcaagtaatttacaacactgccttgaacacattgcttccaagtaggtaactcttgccttataataacaactccataagggcaagaacatttgtcctttcagatcatctgcagcacctagtaccactctatctttagggaccaggatataacacagctcctcgcctccagatggcacttctagactggctttctcgggttgctgtgtccctagcacgggtaataaggcttttccatgatcattctgcctcatatctgtcctgggcctgagttcccagcccaattgccagcacaaggctctgtgtactacacactggtgacttctctgacttctcctgtaacacacgtcgctgcttcttacttcccagaaacataccttcctccccatccccacccctaccgaaaagagagcatccacgcctcagagcaagagaccagcaaggagacctgccatgccactcccagccaacagggggcagaagcgcatcagttgcatcagctccctaacgggtaaagagagcagcacagcacgcctacctttgacagcctttcgtggtaatctggactctcctgcttccctcgcaggctggggggtacgaaccagaaacacacattgacaaactcaggctgagaggaatgagaaagaggaaggtgtgagctgagaaagggggaccgttttccctctccctgcccctttcccctctccctgcccttttccctccactagggctttagttggggcttgggggctgcaaaagagctaggctggggcaggggccacaaaatagaaaggggtcctacctccatgactagctcaaacccttcccgcttcttcatttcctccaccaggtacctgtgaacagagagtgagaaaccataggcggggaggaaaagcagagatccagacagaagaggcccacgtagaatgagccacagagagaccgagagaaaagtaatcccgggagcaggaaagagggaggggcatggacccaggagaggggaacagggacgaccccccacctcctcccgcctaccgggcaaggacaaaggcctggtcgatgcgccgctccagcccttgatcgccctgtgccttccacatgagccacagcttcagacagtccacacggcggccacactgcaccaccttgtctcccgtgtccagagccacatcgtagaacttgtcctgctggaaaaggtagctggcctgggacccatggcagcgcttgagcaggttctgtgtgggggtgaggagattgtcagaccctaccctctccaccgaggctttcctccagggctgcactgtgggggtcttagctcaggataccctcttctttccctggagccagatggcactgctgggacggctgcctgctggctccaacacctttctttgggtttcctcccaatacccagggttcttcccaaactctgatggcaacctcaagctagaaactccaggatacctctgactccaacttcaagctggaaacttttcttttaagagaggccactgggggagtgaaggagcctaatacaggttagggtggtagctgagatgcagcttcagaagggatggtaaagagaatagagaaaggcctgaactttatctaaggtgggatagagaaggcagagctccagagagaggtggggctggtgcaggggcaggggcagacccaccgaggtatcctggagaagaagtgcagagcattgcaggcctgctgcgaggagcttgtggggattccaggccacagagtcagccctggatggggtggagcaaaggcaggtcagtggctcctcctccagctgcccaaccagagcccttcctccttttccaggtccccagcaaaggggctttggtctcaccctcaccccagcatcaggaagaactgccatgtctgacctcccagctccaatcaatcctctctccagtccccctcccctcagcctcctaccccagccatgttaaactccctagtccatgatgattctctggaccaatggtttgaagggcgggatttgggaagaaggggactgtatgcacctctggatcccatccaggagatgcctgtgtgtctgtgacagcaggacgctcccaccccaggcagcctgtggagcaggaggaacaacgtgggccttggccttggctcagcccaccccaccgcacccccaagccgaagtcccactcacatccacatgcagccatagcccatgacgctggcacacatcagcaattgcctccagggggtcaaaggcccctagcacagtggtgccagaggtggcactgaccaggaacggcacagcaccctgttgccaaaatgtagagggagaaagatgtaaagtcatctcaaaagctactcagagcctgatgctgggcccagctctaagctctttgcatgcctaaaatggcccatttcaacctcacaacaatgtgttactgtcctttttaatgtgcagccagggacactgagattcaaagatccaagcagaagctgcagagatggacttcgaacctaggttttcatttccaaagctcatactctcaaagaacttgaatgttttactggaagatccaatgctattgaaaaaaaattgagtcaggcatagtggctcacacctataatctcggcacttcaggaggccaaggcaggattgcctgaggccaggagttcaagaccagcctgggcaaaatagcaagaccccatctctaaaaaaatttttttgtttaattagccaagtgtagtgggcatgcctgtagtcccagctactcaggaggctgagatgggaggattgcttgagcccaggagtttgaggttacaatgagctatgattttgccactgcactccagcctgggcaacagaatgaaagcctgcctcaaaaaatataaacaaataggccaggcacggtggctcacacctgtaatcccagcactttgagaagccaaggcaggtggatcacttgaggccaggagttcaagaccagcctggccaacatggcaaaaccccgtctctattaaaaaatacagaaattatctgggtgtggtggtgcacgcctgtaatcccagctacttgggaggcggaagccgaggcagaggcatgagaatcgcttgaacccgggaggcagaggttgcactgagccaagatcacaccattgtactccagcctgggcaaaagagcaagattctgtctcaaaaataaataaataggctgggtacggtggctcacacctgtaatcccagcactttgggaggccgacgcgggtggatcacgagatcaggagttcaagaccagcctggccaagatggtgaaaccctgtctctcctaaaactacaaaaattagccaggcacagtggcaggcgcctgtaatcccagctactcaggaggctgaggcaggagaatcacttgaacctgggcagcagaggttgcagtgagccaagattgtgccactgcactccagtctgggtgacaaagtgaaactctgtctctaaataaataaataaatttgaatagtacaaaagtttatgcagaaattgaattagtaatttttaaaactactacagctggatgtggtagctcatgcctgtaatcccagcactttgggaggccaaggcaggagaattgcttgagcctaggagttcaagaccagcctgggcaacctagtgagacctcacctctacaaacgaaaaaaaaatacataggctgggcgtggtggcttatgcctggaatcccagcactttgggaggccgaggcgggcggatcacctgaggtccagagttcgagactagcctgaccaacatggaacaaccctgtctctactaaaaatacaaaattagccaggcatggtggcacatgcctgtaatcccagctactctggaggttgaggcaggagaatggcttaaacccgggaggcggaggttgctgtgagccaagatcacgccattgcacctcagcctgggcaacaagagcaaaactctgtctcaaaaaaaaaaaaaagaaaaaaaatagacaggtgtataggggtgcactcctatagtcccagctacctgggaggctgaggtgggaggatcacttgagcctgggagatcaaggctgcagtgaaccatgattgcaccactgctctacagcctggtcaacagagtgaggccctgtctccaaaaacaaacaaaaaaaatctaccacagtgggagtctgaggcaggaggatcacttgagcccaggtggtcaaggctgcagtgagccctgatcgtgccactgcactccagcctcagcaacagagcaagaccctgtctccattttttttaagttaaaaagaaaagaaaggcccaggcagagatggctttgctgatgaattccatcaaacatttaatgaaaaattggtaacagatcacaaactcttccaaaagacagaatatacaaaaatcaattgtatctctatacacattagcaatgaacaatctaaaaatgaaattaagaaaacaatttcatttacaaaaacaccaaaaaagaataaaatacttaatctatttaacaaaagaagtataaagcatatactctgaaaactacaaaacactgtggaaattaaagacctaaataaatgaaaatatgtttcatgttgatgaatgaacacaattcctatcaaaatcccagttgccctctttgcagaaatggacaagctgatcttaaattcatatggaaattcaagaaacccagactagcgaaaaacaatcttgaagaaaagaacaaagttggaggactcacacatcctgatttcaaaacatactacaaagctacagctgaatcaagacaatgtagtctacaggatagacatgtagatcagtggaacagaactgagaacccagaaataaccctcacatttacagtcaagtgatttacaacaaggatgccaagacaatttattaaagaaagaattgtcttttcaacaaatggtgttggaacaactggatatccacatgcaaacaatgcagtttgaatgcttttctcacatcacaccctcaaattaattcatattggatcacaggcctaaatcccagggctaaaactataaaactcttagaagaaaatataggagtaaatctttgtgagcttggattaggttaaatataacaccaaaagcagaagcaaccaaagaaaaaacagataaattggacttcaaaatttaaaacctttgtacttcaaaggacactatcaaaaaagtgaaaagtccaatagcaaagacatggaatcaacctaggtacccaccaacagtggattagattttttttaatgtggcatatacaaaccatgaagtattatgcagccataaaaaagaatgaaatcatgtcctctgcagcaacatggatgcagctggaggccagtatcctaagtgagttaacacagaaacagaaaaccaaataccacatgttctcataagtgggagctaaatactgagtccacatggacagaaagatgggaacaaaagacagtggggactataagaagcgggagggaggggagaaaaggttgaaaacatacctattgggtactatgctcactacctgggtgatgggttcaatcgtgccccaaacctcagaatcacaaaatatacccttataacaaacctgcacatgtacttactgaatccaaaataaaagtttcaaaaaagtgaaaagtcaacctagagaatggaaagaacatatctgaaaatcatatatctgataagggacttgcatctagaatatatgaagaactcttacaactcagtaataaaaagacaacataatttttttaatgggcaaaggatctgactagacttttttcaataaagataaataaattgctaataagcacatgaaaagatgctcaaccatcactaatcattagggaaatacaaatcaaaactacaatgagttaccacctcacacctattaggataactactatcaaagtaacagaaaatgaggggatgcatggctcatgcctgtaatcccagtactgttgagaggctgaggtgggagaatggcttgagcctaggagttttgagaccagcctgggcagcacagcgaaatggaattttggtagagatgtgtctctaccaaaaataatttttaaaattggccaagtgtggcagcctgtgcctgtggtcctagctccttgggaggctgagatgggagaatcatttgagcccaggaggtcgaggctgcagtgaaccatgatcgcaccactgcactccagcctgggtgacagagcaagaccctctctcaaaaaaaaaacaaaacaaaacagaaaataacaagcgttggccaggcgcggtggctcacgcctgtgatcccagcactttgggaggccgaggcgggtggatcacaaggttgggagatcgagaccatcctggctaacacggtgaaaccccgtctctactaaaaatacaaaaaaaaattagctgggcgtggtggcgggagcctgtagtcccagctactcgggaggctgaagcatgagaatggtgtgaacctgggaggcggagcttgcagtgagccgagatcacgacactgcactccagcctgggtgacagagcaagactccatctcaaaaaaaaaaaaaaaaaaagaagaagaagaaaataacaagcgttgacaaggatgtgaataaattagaacccttgtgcactgcaggaatgtaaactggtacagccactatagaaaacagtatggcagttcctcaaaaaaattcaatagaattaccatatgctccagcaattccacttctgagtatacacccaaaacactgaaagcagggtctcaaagagattccaaacagcaacccaaacagataaatggataagcaaaatatggcatatatgtacaatgaaatattattcagccttaaaaaggaagaaaattctcacatgctacgacgtggatgaaccttgaagacattctgctaagtgaaataagccaatcgaaaaagacaaataccaccgggtgcggtggcccatgcctgtaatcctagcactttgggaggccaaggcaggcagatcacaaggtcagagtttgataccagcctggccaacatggtgaaaccccgtctctgctaaaaatacaaaaaattagctgggcatggtggtgcgcacctgtaaccccagctactcaggaggctgaggcaggagaactgcttgaacccaggaggtggaggtggcggtgagccgagatcgcaccattgcactccagcctgggctacaagagcgaaactccatctcgagaaaaaaaaaagaaaagaaaagacaaagacaaataccgtgtgattccacttatataagtacttagagtagtcaaagtcatggagacagaaagtagaatggtggctgccaggggctggaagagggggtaatgagttgttgtttgatgagtatggagtttcagttttataaaatgaaaagagttctgctgggtgtggtggttaatgactgtaatcctagcattttgagagaccaaggtgggcagatcacttaaggccaggagttcgagaccagcctggccaacatggcaaaaccccatctctattaaaaatacaactagccaggtttggtggcgaggggcctgtaatcccagctactcaggaggctgaggcacgagaatcgcttgaacccaggaggcagaggctgcagtgagctgagactgtgccactgccctctagcctgggggacagagtgatactctgtctcagaaaaacaaaacaaaacaaaacaaaaaaacaagatgaaaagagttctggagactggttgcaaaacaatgtgaatgtatttaacactactgaactgtacatgtaaaaatggttaagatggtaaattttatgttacacacacaaaaaaacaagtagaactggcagcagattctcaacagagactctactggcatgttgggtgagtcagttcttgttcatgtagagctatacctgctcattacaaaaatgtttaggatccctctttccctctcaataaacacagtaatgccctctggctagtgtcacaaaacaaagcaaaataaaacagttccacacacttcaaatgcccacttgatgactaggagagtgggggtagatggcagcaccagccccaagcaagtatccatggatgaggaagactacaggtggggtggaaacagtccaggcaaaggggggaagctgctccaactccatatcttcaattccagaaatatcccgtggcctctgcacatacacagaatcttcttgtctacccaaaggggcaccacctagttcatttcttttctcccttccagtctcagctcaaccatcccttctgagggaagccttccctgactccttcacctcctgattaggtcaattctcctgtattctatgctcaaagagcacaatgtacctcaccttcatagcacatatgcagcatttttacatatatttatgaatgtcagtcttccttactggaataaaaattctatgaaaaacaaaatgggtgaaggatctgaatagacatttttccaaagaagatatacaaatggccaataagtacatgacaagatgctcaatatcattagtcatcagggaaaatcaaatcaaaacacagtgagatcccacttcacacccactaagtggtataatcaaaaaaagatatgacaagtgctggtgagtatgtagagcaattggaaccctcacacactgctggtgggattgtaaactggtgcagccactctggaagacagtctggcagtttctcaaaaggttagatacagagttactatatgacccagccaattccactcctaggtatataaccaagataaatgaaaacgtattttcacacaaaaatctgtatacaaatgttcatagcagcattatgcataagagccccaaagtggaaacaacccaaatgtccatcaactgatgaatggataaataaatgtggtatatccatttaagggaatattatttggccataaaagaagtgaagggttgatacacgctacaggttggatgaaccttgaagacattatgctatgtaaaagaagctcatcacaaaaggcatgcataatatgattccagaattcacaacaggcaaatctatacagacactaagtagattactggttgcctagaactgggagctttgggagaattacagagggatggctaaagggtatggggtttctttagggggtgataaaaatgttctaatactgattgtgatgatgtttgcacaactctgcaaatatgctaaaccactaaatagtaccctttaagtgggtgaattatatgttaggtgaattatatgttatgtgaattatatatcaataaaactattaccaaaaaagtttctataataaaaagagaaacatcactattctaattgctgcccttactgctactcagaggtaacatccatatatcaataatatatactcttctaaataacaaaaatgggctcatagggctcataatgtccattctatacggcaatttgcaataaatatttaatatatacagtggagatactttcatgttagtatatatattctcacctattcttttaaatggctacccagtactctaataatagtaataaataataataacaacaataccagtagcttgtatttatacagtgcatctatgtgccaggaactattctaagtgctttacatatactaattcattcaatccttacaataaccctatgtggcaaattctatactctgtccattttacagaggaaggaactaagacacatagatataccataatttattttgtctactaatggacatttaaatttttttttaaaacatttatggccaggcatggtggctcacgcctataatcccagcactttgggaggccgaagcaggtggattgtttgaggtcaggagttcaagaccagcctggccgacgtggtgaaaccccatctctactaaaaatacaaaaattagccaggcgtgttgatgcacacctgtaatcccagctactcaggaggctgaggcatgagaatcactcgaacccgggaggtggaagttgcagtgagccgagatcgtgccattgcactccggcctgggtgacacaacgagactctgtctcaaaaaagaaaaaaaaaatggccgggtgcaatggctcatgcctgtaatcccagcactttgggaggctgaggcaggcggatcgcctgaggtcaggagtttgagaccagcctgaccaacatgcagaaaccccatctctactaaaaatacaaaattagccaggcctggtggcacacgcctataatcccagctacttgggaggctaaggcagaggaatcacttgaacctgagaggcggaggttgcagtgagtcgagatcacgccattgcactcctgcctgggcaacaggagtgaaactccatctcaaaaaaaaaaaaaaaatttttacatttatatttatttatttattattattatttttgagatcacaccactgcactccagcctgggtgactgagtgagactctgtctcaaaaactattaaaaaataaaaataaataaaattgtatagatggtgccaaaatgccctccaaggtggctgtagcagttacatacccctcgaagtagaggagagtgctaatgtcccctcatccccactactcacagccttcaccagtgcctctcccctcctcagcctctccctgcgcagaccctcacagcccacaggaaccttccacactacagcgcaggcccccagcaccctccctgtggtgctgcctgggactcgctccctcactcagccctgcctctcagaatccaacccggcgtaggtgtctgggcagagccccagaaagcaatgtagtgtcctcacccccaggctctccatggtcacttcagcccacaggggagatgggcatggagacgagagggatgaaggatgccttgagaaaggagagcccaaataaccctccaagacagttggaggctatatcaccccagcgagcctcactgactcacctcagcctcggccataccaatctgcctctccagatcctcggggaccattttccctctgaaaaagaaaatgcagagggtagagcagggacaggttctctgttgaaggcagggtaaggtggggttagcaatgcagagacaacagtgctagtttttccctcagggggtgaaacagatctcagggcagaggtgggagacgctggcaggctctggtagacaggaacagcaattctactgaatagcgaggggagagaggtccaccagcggtaagggtctgatgccagagctttctggcggcaggaagttacgctgtgcaaagctaggtcacagccatgtgggcagaaggaccttcacctctcatcagccttgaccactcggacactgtcggtgccaagtcccagaaacgcagctcccttctggatggagtagtgacactgtgggggaaggcagagggcaagttagcacaacttgatgggggaggggagagaaggtaaaagtcaagtgtgagctccaacaaatgggatcctgtagaccagggcttctcaaatgtcagcgtgcatacgaatcgcctgggtgtctggttaaaatgaaatgcaggttctggtccactaggtctggggtctagggtggggcccaagattctgcatttgtttgttttttttttttttggagacaagagtctccctctgtcacccaggctggagtgcagtggtgtcatctcggctcactgcaacttccgcctcccaggttcaagcaattctcgtgcctcagcctcctaagcagctgggactacaggtgcccaccaccatgcctggctaattttttgtattttagtaaagagggggtttcactatgtttcccagggtggtatcaaactcctgagctcaggcaatccacccacctcagcctctcaaagtgctgggattacaggcgtgagtcaccgtgcccggccagattctgcatttctaacaagccccaggtcataccaatgctgctggtccacagaccacactcttgagtaggaagagtatggactgtgtccactgcactcacggcccctcctctgcccccaaacagaaggcaatgtgaacaggagcagttacttgacctccttgattggaaggaagcacatccgcctgggggcaggctggccttggaggatgtagggagggcagggagaagacctggaaggtctctacttagctggctggagattagaatcaggagcccagggttgggcctgtgcctcttccccacctccttcgatgtgaatagggccaggggcggcagtgtgcggaggcccctctgcttgcaatccgggtagcgctgatagcgggccagatttacagcatacatgttggagatggagccacctgtcacagggagggggcggtggcaagaggaaggagcagtgggtcaagactggagcttgcctcccttccctttctaccagaagagctcatcaaagaagcaggtatgactggctcccaggccacaattctcaggatcataccatcccagaatggatccaggatcagcagatcctcttgaccacacctctccacatctggggctgcccccaagagacagcccccgtccggagatagcaggaactagaccactgaccccagggaatggtgacaaacatgagcatgaagggaccaggcagccgcctccctggcctggcctgggtccagctggagaggaatcaaagaggaatcatccctccctgccagacactagagcaagagaacggtgggggaggaggaactcataaaaagggcaaagaaaggtcctcctccttctcacaaaccagggcagaagattccgtccccagagctccagcccaccagggcccgcagtttcctcagcacctcctcttccatgagcacaaacacgggggcgatttcatatgtgtacctgccaggagagagaacgacgagaaaggagagatggggagggactgcccagacaggcccttaaactgcacaggagtcacaaaaaggaggcagtgaagagtgagcaaagcaacagtccaaggagaagaacgagttggtgacagaaccagggaagcaagaaagagaaaacaggggtcaggaggcctgagaaagtttggagaaagtgggtccaaaggatatgaggaaaaactctctgccgacagggattcccagaagcagtagagagagggcagaaccattctcctcccctacccctcaggcacctctctagcaaacctaaatcctttgtgggatggtagaggggccttgggatgctcactggctggtgttgaggctctcagtgataatgcgcccggccagagcatggggatccaacccagagaagagctggttgaagaaccgagggtgacctggagaaggagagtaagccagggagctcagagtagagctcagggcaaactcccaagtctcctcctcacagaagccagggcccaccagtcttgacactgtagcgaatcacagcccgacaccgctccaggatctgcttctgtgactcgccctggctccgcagctccaaatccagcagctgcttcagctcctcaggctccttccactcacagacctaggaagagagccggggatgctgggggcctgggatgcctgtggactggctgtcaaaccacacctccacagacacgagacacggccaacctgcactaaaaacaacttcgggatatttccaaagcaaaactctgaaaatgaacaagagtagtgaacacagtaagacccagaatgtaaatccctgaggtacccaggggggcagggatgaattctggggagaaatcttatcaaaggaggaaagttctgagccagatttggaaagagaaagagaaggcttgggccaggcgtggtagctcacgcctgtaacctcagcactttgggaggccgaggcaggcagattacctgaggtcaggagttcgagagcagcctggctaacatggtgaaaccccgtctctactaaaaatacaaaaattagccgggcgtggtggcacatgcctgtaatcccagctactcgggaggctgaggcaggagagctgcttgagcccgggagacggaggttgcagtgagccaagattgtgccactgcactccagcctggccgatagagcgagactctgtcaagaaagaaaggaagaaaggaaaaaaggaaggaagaaagaaggaaggaagggggggggagaaagaaaagaaaggaaaaaagaaaagagaaaagaaaagaaagaaagcttgatgggaaggaggaggaagaaaggactcaccttctgggagacactggttcctttctgaatggcctcatccacaacaaccccaaacacggcccggagcaaggcttccacagccactgggtccccagcaagggaggggagtgcttctgagtcagccatcaggatctgtggcagagcagagtcattccctactcagcctgtcaacccttcccggacctacccagcaggagcctcctctcccaaacgggcctgaggcccaaaccctgcagctcagtctcggcctccagtgcacagacaagggcaagtgagagtgcccagggagaaaaccagtgggaacaggtgggagagaaaaggcagtcagtgctgagcaagtggactctagtggccatttccacctaaggcagagacaagcttacctctctgctcaggagagccggaggcagggtgcacaggtagctcctcaggacagcaggaccaagatggcagaggaagtggggtgaaaagtgtacaattaagtgtttttttcataaattcacaaagttgttgcaaccatcatcactatctaacgccagaacattttcatcacccaaaaaaaaacctcagtagcagtcatttcccattctccccttccccgacccctggcaactactaatctactttgtttctgtagatttgtctagtctggccatttcatgtaaaacgggtcatacaggccaggcgcagtgggtcacgcctgtaatcccagcactttgggaggccgaggcgggcggatcacgaggtcaggagatcgagaccatcctggctaacacggtgaaaccccgtctctactaaaaatacaaaaaattagccgggtgtggtggcgggcccctgtagtcccagctagctactctggaggctgaggcaggagaatggcgtgaacccgggaggcagagcttgcagtgagcagagatcgcgccactgcaccccagcctaggcgacagagcgagactccatctcaaaaaaaaaaaaaagaaaaaaagaaaatactgaaaaagaaggaaaaagacttcaaaatattcatttgtggctatttctgggtgttgttatggatgatttttaagtttattatttatacacatctatatttttataactttatacaatcatttcacattgcttatggaattaaaataacggttctttttaaacaatataaaaattgtccgcgtgtggtggctcacacctgtaatcccagcactttgggatgctgaggtgggtggatcacctgaggtcaggggtttgagaccagcctggccaacatggcgaaacctcatttctactaaaaaatacacaattagccgggcgtggtggcgggtgcctgtaatcccagctactcaggaggctgaggcaggatccacctgaacctgtgaggcggaggttgcactgagccaagatggtaccactgcactccagcctgggcgacagagtgggactccatttcaaaaatatatatatatatggaggaattaagggggtacaagaattctaaaatatacaaatcatcaggctcaaggaatgtcccttgcacatcatgtggtttcccaactcctcaatccactgttatcaaaggtctaatggaaggcaaagggagccacacactgctcatctctattacgcaacccctcaacccccgctggctctcagggaagggaatgggttcagtttgttcagcaaacattgactgagtgttgtctacttctgagcgcctggctggcattaccctaggtgctgcatctgccctgtgggctccagctaacaggctggcaagagagacctgcatgtaaaataaagggaaattgccacaagagggagttgagaggtcaccatggaaaggcaggaaagttcaactggcccaggacaggcttcaaggacaaaacactaaggctctccttaaggcaatagagagctggtgcaggaaaagactcagcaggagtcattgcaatgctatttgaataagtgatggagtgggcctgagggaagagggagttagggaaggtcacacaggaggaggcctgcctggggacaaagggatctaggcaattgtctcctgaagcgctctcagccaggtttatggttagaaagctaaagtactctgtgctatctcccaatcaacaaaccctagtggctccacacccacattaataaaggcacaaactctcctatgtatacaatcttttctctgcttctagactgtactctcctgggtggagagaactaagtcttttccttcattaagtaaactaatagaaaacagggacccctcaaatgttagtttccatcttcttgattgtcctctcccctcccccagggacttgcacagaggcattacataaacatttgttaaatcaatcaatgatttgcaggtactggaaaaaatgctgcattctacttacatttgatttgcatcaaccaagaatctgtagtaatgataatagatttgcaaagggtgtttttccttctcatttattatcttatttgaccttcacaatagtattagaaattagcctaaataggtatttattcattcttgttttcaagatgaggattcttagctgaaagaaggtgaactaattgtccaaaattacaaaggtgacatgggaacaagcctagatcactgactttctgactttaggctacctcttccactgcatcacaggtccgtgtggcatttctcactatttctcatcattgacaaaaattaactgcagctaagataaagacagaaactgaaaatatacaaccataagaatacaagaagggggggtgaggggcgggcacagtggctcaagcctgtaatcccagcacttgggaggccgaggcaggtggatcacctgaggtcacctgaggtcaggagttcgagaccagcctgaccaacatggtgaaaccccgtctctactaaaaatacaaaaattagccgggtgtggtggtgcatgcctgtaatcccagctacttgggaggctgaggcagaagaatcgcttgaacccgggaggcagaggttgcagtgagccaagatcgcaccattgcattccagcctgggcagcaagagcaaaattccatctcaaaaaaaaaaacaagaataccagaaggggctgggagcagtggctcacgcctgtaatcccagcactttgggaggccagggcgggtggatcacgaggtcaggagatcgagaccatcctggctaatatggtgaaaccccatctctactaaaaatacaaaaaattagcccggcatggtggtgggcacctgcagtcccagctactcaggaggctgaggcaggagaacggcgagaacccgggaggcggagcttgcagtgagccgagatcatgccactgcactccagcctgggtgacagagcgagactccatctcaaaaaaaaaaaaaatatttatttattattttagagaataagttttgctgtatcacccaggctgaagtgcagtagcacaatcatgtcttactgcagcttcgaactcttgggctcaaacaattctcccacctcagcctcctgagtagctaggactacaggcacatgccagcatgccgggttaattttttaattttttgtaaacagggtctcactatgttgcccaggctggtcttaaactcttggcttcaagcaatcctcccacctcagcctcccaaagcactgggattacaggtgtgagccacctcgcctggccaaaatataatgtttttattgtgaatcagattatttattctatggtattttagtgttggttatattcttatattttatttatataatttttgtttgttaatctgacatctggtcatgttgctgaactccatagttttgatacattgtcaatcgtttctctttgtaagatgaatatatatgaaatcaaggaggctttagggtggccaggagctctcctaaaatcttagttttaatagtaaacatccctggcttgttcctagcaaagacagaaatgtttcaaatattttcccataaagcatgacttttgtctcaaaagctgaaagataagtgaaaaagagaaaatattttaaatgcagacgacaaagaatagttattatccataacacagacaggatttctaccatcaataagaaatatacaaatgatctacctttttttaatgggcaaaggatatgaacagacagtttacaaaaacaattaaaatggtcaaagagcaataaaatagtcccacctatttggaaggctgaagtgggaggatcacttgagctcacgagttggaaaccagcctaaggcaacaaagcgtggagacccatctatttatttatttatttatttatttattttttgagacagagtttcgctcttgttgcccaggctggagtgcaatggcacaatatgggctcactgcaacccccgcctcccgggttcaagtgattctcctgcctcagccacctggtaactgggattacaggcacgtgccaccaagcccagctaatttttttgtatttttagtagagatggggtttctccatgttggcccagctggtctcaaactcctggcctcaggtgatccgcccacctcggtctcccagagtgctgggattacaggcgtgagccaccgtgcctgtccagagacccatctcttaaaaaaaaaaaaggcaataagagaatattaacttcactattaatgacatgaaaattaaaacaaatactatttttcacccattaaactagtaactgtataaaaaattcatagcatacactaaacattgccaaagttgtaggaatagggaacattcacacatggttctgagtaaacatgggagttgttacaaacttttacaattcattttcacagaatctattaaaatttacatatccggccaggcatggtggctcaatcctgtaatcctagcactctaggaggccgaggccaatggatagcttgagcctaggaattcgagaccagcctgggcaacatggcaaaaccctgtctctacaaaaaacaaaaaaacaaaaaaaaaactacaaaattatccaggcacagttgcccacatctgtagtcccaactacttgggaggctaagatgggaggattccttgagcccaggaggttgaggctgcagtgtgccctgactgcaccattgcactccagcctgggcgacagaccaagaccctatctttaaacagaatgaaaatagggccgggtgtggtggctcacacctggaatcccagcactttgggaggccaaggtgggtagatgacctgaggtcaggagttcaagaccagcctgaccaacatggtgaaactccatctctactaaaaaatacaaaaaaattagccgggctggcagcaggcgccagctactcaggaggctaagccaggagaattgcttgaacctgggaggtggaggttgcagtgagccaagattgtgccattgcactctagcctgggtgacagagtgagactccatctcaaaaaaaaataaaaataaaaataaatttaaataaaagcacatatcctatctataaatccttataaatgcaaaaggtaacttttttttcttttttgagacagagtttcactcttattgcccaggaaaggcacgactctcgcctcaccacaactcccgcctcccgggttcaagtgattctcctgactcagcctctcgagtagctgggattacaggcatgtgccaccacgcccggctaattttgtatttttagaagagacgcggtttctccatgttggtcaggctggtctggaactcccgacctcagatgatccgcccacctcggcttcccaacgtgctgggattacaggtgtgagccaccctgcccggagcaaaaagataactatttaaggatgttcattattgtattgtttataaagcaaaaaaatctgaaacctaaatgttcatcaagatgggacaaggcacacacataaactggaatactgtgcaacagttttttaaatgttagctgactcagatgtctaaaatacactgtatggcgcattacaggtgctcaataaatactggttgaaaagatttttgtatgaacacagaaaaaagcctaaaagcatatataccaaactggtaagaatgattcccttcaggagcatgggataagtagagggggagaataaccattttgtgtcttttatacttttgcgttgtgtcgatttgtaaaataagtaggagctaattttcaaaaaagatttaaaagacttattcctggtgatgtttctttatctctctctttctccattttgtctctattttagaatgatcctaaaacacaaaaaacgtactttcaatggcccaaatcatggagtggctcagggaaatgaaatctgtctacaaaaaaaaaaaagttgagaatccttgtctttttttcatcatacagttttttttttcttttggtatcaccattacttctcctaaagtcacgacataatatcacctacagcagaaatgaggacttcagtggaattgacatctccttccatcaagcgcatttgcagtccatctttagcaggacctctctctaatggctaaggctaggcagaagaatttgaagacagtctggtttccattttcctaatgcagcctggcccaagagccaggactcccataagactagtctactgtgggagtcagggtcttttccacgtgtggaggctagtgtttgatgctggacggcctggagtaaagggcgaaggggagaaggtaaccaaccaggctggcctcgggattcgcagaggagggctggggctttgacttctgcagggaggtgagcagtgtggccaagggctactcaaggaacgcctctgcgagaattcagactgtggttgagcgcacaaagcaagagtgtgcgaagaaaagttaacgcctctcccagctgaccccaaaatctgctaatctgggcctgacggaaaaaattcggagaagaaccacctcggccgagttacgtgaaaaggctgggtacgaactactctggctctacttggggcgccggctcagagcgatgggcaggacgtccgcgaggaagaaagagtgacgatgatttttcaaggagtctgaaccagctcacccagcaaaccctcctcccatcgagcacccagcgtacaatcatcgaagggccgagggtcctgccctcagtctcgatggcggccggggcgcgccccggccacggcgcacgcgccggcctcagcgctccctcctccatgccctcggcgcacggcgccgcccactcacccagctgcacctctccgtgcgtccccaagctcacccgctctgaggctgcccccgctagtctagctgccgagcccggaagtggatgcagccgctcggcggagaggacgagggggagggggaagtgcttccggggaaacgggccggggttggtgtttgtaaacttgcctcggtcccggtgggggcagccgcggcggtggggttggcagggtgtgctggggcctggaggaggcgccgcgcggccagggagccagcgggaggccgcgcctggcaggtaggagcaagccccaaagaccgcagcgtcgtccgtacagacggcagcgcttcagtagctcgcaagccgtgg

SEQ ID NO: 496 - DNA, 10120 bp, Homo sapiens
gccgcggcggtggggttggcagggtgtgctggggcctggaggaggcgccgcgcggccagggagccagcgggaggccgcgcctggcaggtaggagcaagccccaaagaccgcagcgtcgtccgtacagacggcagcgcttcagtagctcgcaagccgtggggtgccgcgcgggaagggggaggggaggggaggaggggcgcgtggcgaagggagggggatctccgggggagggaggggaaaggccgtgcgcgcacaccgccccctgcccgcgcgtcccgccgcgtccccggcccgggagagggctctcggaggggacgcgggcgcgagcacgcatctcgcgcgcttctcggcactctccggctctgctcccggttggtgcagcgggtgcagaggctggctggccggagcgaggcgggcgacacgccgcgccgggcttcgcctgcctgtcctccacctccgcagcaagtttccctaccttcgggcggacggggagaacgcacacgtgtgggcactgccagtcccgtttctgcccgccaccgaagcacccagcgatggcccttgagctttcctccaccctagtcttgccgcctctgtaaagtgcgagcttttcgggccggcccactgggcacaaaagccccaaagggtctccgcccccttcttccattcctgagatggcaaatccaagcaactttccttttggcagagttcctccataggaggccccaattacttttgctcctgttggcttccactccttgcccaggagaccagttcctcctattgacctagaaagaaaactcttcttgactcatgtcctcgttctgagcttcacagagagcgcccagcaaaaaaaaaattcatatcgcacgttgtaatggcctgaagatgttgcatttagcagcccccctcttcctttctggtttcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggtaaaaagctctagagtcctcctccaagataactgggaagcctgtttgcagtttcactcttgaatgctgccttagtcaacatattgaccaaccccagtgatccaagctctgtattaagcaccagggggagatctagaggaaggaaaggagacaggccacagcccctgccttcagggagcttccagtcaaatgaaggaggtaggctatactgcatcacaggcactgatgggacatttgcaaagcaacgtgtactcagtttacatttggtacattaagtgctgaggggtgtaagggagtgaatagtacggtgaatgcttcttttgtttttttccaacaggaatttattgagttcctgttgcatgcaaggcattgtgctgggaatacaaagatgaatacgattgtccttgtccccagtgagcttccaggctagttggggtcgggagagggatggaaagccatttatttttatattcacaatgccttgtatagtggctggctagtagtagagactctgaatctgttgattgaggaatgtgcaataataggggtatgtacataggagagaacagtacttctgcttggatagaaaaagaagatggaggttgaaagatgcataggattttgctaaacaagcgagaagggtgtttggacaaaaggaacagcatgggcaggagcttagagtcatgggaaaatgtgatgaggttccgagtactgcaggttgtttgatagttacggagtaagggatttaaatggggatagttatggaggtagtattgacagtgataggtgaggaagttgttccctgcagtaagcagagtgtaacccaaaggccttttatgcctcgctaagttaagcagcagagtagcatcagatcagtgttatgtagaaggtcattattgtggaggtagaggatggactggagagacagaatgagcagataggctgttgtagtcatctgagtagaatagctatgtgcacacatctccagagcttctcccagcttgcttctagggaacctccctaccagtctcaccaggatggcagtctgattgtagtataattggctttcctccagctgcttctgaatgcacagcttcctcctttccatatagaataggagcctgtcagtttcttcttcctttgtgttttgcaacccacttctcagcattgtattcagtcttctgagaatgctgccttccactaaggactgaactttgtgctagacactgttaagcgttttacgtcttagtttacttttcatcaaccctgtaaggataagcattatgacaggcatttttcatgtaaggaaactaaggcttgcaaaggtggaataacttgcccaagattatagagtgcaaacagctgagctaagattttaactctggatctttcactccaaagtcccagaaggtggagggaggggtcccagaacgtactgatcatctaaaaggaatttcttcataaatttgtgagtttgctgaccaacgatttcttaaaattttttttttcagtaagaaaagtattttctttaatgccggctaaccgaagtcagtttgaagaatgtagcagttttctggaaatttacttaaacataccttacttaagtaattgtttaaattatatatggagcaaggaatgtgaaaaaaaatgtgatcatacaagcacacatataaatggcctaagaggtcaagagaaatgctgaactccaaaaatcatatcagttgcaattggtaaatacttagggagtttaaaatctaaagggagaaatagcctgtagtcccaggaccttaggagactgaggctggaggattgtttaagctcaggagttccacaccagcctaggcaacatggtgaaaccccgtctctataaatacaaaaaaaaatagccgggtgtggtggcattctcctgaagtcccagttactcaggaggtagaggtagaaggatcgcttaagccagggaggtcaagagtgcagtgagccgagatcgtgccactgcactccagcctgggcgacagagtgacaccctgtctcaaccaacaagcaaaaaatgaaacaaaccgatagaaaatacagttggcaccagcaagatctgccaatcaaaagtgggctctgaagctaaggggtgtgtgtgtgtgtgtgtgtgtgtgtgtgtgtgtgtgcgcgcgcgcgctctgaagctaaggggtgtgtgtgtgtgtgtgtgtgtgtgagtgacggagggattctcgctctgttgcccaggctggagtgcagtggcgcgatttcggctcactgcagcctccgcctcccgggttcaagcaattcttctgcctcagcctcccgagtagctgggaccgcaggtgtgtgccaccacacctggctaattcttgtatttttagtatagacaaggtttcacctattgtccaggcttgtctcgaactcctgacttcgtgatccgcccgcctcattctcccaaagtgctgggattataggtgtgagccactgcactcggcccagctgagggctgttgagggaggaaggaggaaggtcctgaaggaatctcctgtgtcagtgggttagcaagatggaacctcatacccactcacagttaaggcctagaaataccttcaaagaaatatgtagccacacactgcctagtgctgatgacaaaggtgtcagtaatacttgattatttacttgatctatatttaaatgctgaaggatgacaagataagtcgttcctggtgagatgagttagggaggactcttgaaggaagcaaggctttggcagtgaggagggacattccctggagagaagcagtttgtagcagggtgtaaaaggtagttctatagaggatggcagtctgtttttgccctgccctgccaggtgacctgacacctcatctcctttcaacttaggcaagtctcctggcttgtgaaggcctagcaggtgtgagtttggttcccactgcagccagcaagaagatgatgctgagccagattgccagcaagcaggccgagaatggcgagcgggcaggtagccctgatgtgctgaggtgctcgagtcaggtacagcgcttgagtccattgtggcacctggggatcgggtggcccaagctctctgccaggagataccaagctctgattccttgatgcttcctcatagggaagtggggcaaggggatccaactggggaatggatgaacattggtatttcagaaagctaaggaaggtcttttgtgtgccttcaactcttttaagaccaggtgcttggagaggaaatagttgtatacttcctctaagctttcggggcaggtggtttactctcatttatgaattttgtctgagagctgcattgggtctcatctcatgttccgagatgggctatgagtttagatttgatttgtcttcaaagggtcaccgaaaagacagtgataagtcccggagccgcaaagatgatgacagcttgtctgaggcctctcattcaaaaaagactgttaaaaaggcaggtaatggggtgatcccccaaactcatacagtttggtaatggggtaatattcctccttcttccctctaccatgtaacctggagctttccctagatgctttgatctctgatagccagtgagtgagtcccccagatttcatccagagactaccttggtagttgatctcctgccttgctggaacagtaatggtacaggttggggagcatgagatcccagatcccgaggcatgggagcaggcaggctccagctcaagtcatactcagactgctgggtttgacaggatagacagcttacccactccacctccttccccaaagggtctcttacctccatggagtacaggagatggcagcacctttagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtaagtctcttgtttatattcaaaagggggagaatagtctatcgcttgtattccatgtctgtttgtggctctagttgggtttattttaatgggtaagtattagaaatgaaggaagaagataagtcaatgaagcagagagattgcatggctttgtatctggtgtcactgagaccagcacctttggggacctctccccatttatgatcacttaggtgtctacacattactaagagttaaagtttctgagaaaactggaatgaggtccctactgtacatacctccccacattcacttctctgtccacctgggccaggtgagaagccatttgaatgcgatatatgtgatatgcgtttcatccagaagtaccacctggaacgccacaagcgtgtgcacagtggtgaaaagccttaccagtgtgaacggtgtcatcaggtaaggctcatccctgctacaataccccacacacacttttccttccccaagaatcagggccaccctccactcctgcctgacaaaagagccaccagcgttactcgccataatagttaacacatcggggtgaagtgcatctgtctggccttatgcagctgatcatggggagcagcaattagaacattgtaataataataataatagcattccatatcacttactctatgccaggcactgtgagagcatactttacatagatgattttatttaatcctcacattgactccctaaggtagctgtattgtccttatttcacgtatgggaaaattgagattcagagaagttaagtttcccagggacaccgcagatcacgaacagagctgggattcagtccaacttcagagctaatgcactttggaggaagagatacaatctttgccctgggggtcagtatctgatctgatgagaatgtaagagctggggccaaaacaagacaagaacaagagatgagaaatgataatagctaacacttcctggatgcattgctaggtcccaagctttgctctgcactcttacactgaatcttcagacgctagaataaaagctccatgagggcagagactttgttcctctggttctctactctgtatctgccttgagatagatactcaataaatctttgatgaataaagcagctgtgctgtgagtaggtacttttagcctcgctttgcagttttgcagatgagtatgcagattctgggctgttaggtaacttgcccaaggtcacacagctgctgagtgatagagccaagattcagccccaggcggtctggcctgagagcttggattctccaccaccgtgtgctcctgctgtctgtgcacgtgctgaggggatggagaatgtggtatctgcctcctgtgagaggaatgagttagccaacaggtagctgcgtttgtctgctcaggcacttaaccctccctttcttctcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaagaaagaatccttatgggaagttttggggtttggttgacccccactgtaacctgacctgacctgtggcgggtacgggaactgtcttagtaatcatggagactggctgaacctgagtgccaagctgtcagtagggtctgagatgggaaactcctgaaagtatgatttcatttcccagaaaatgtaaagaatggataccagcaatgattcctggctgttacctattctggaggggtggggttggggagggggttgtccatacctctgtggtatgagtatttcagggaaaaagaaagcaggcatggcacccattcgattttccctgacagcatctgagatccttttggggagacgctgaggagtgtttgctgccatgtactcttacagctctatgctgacactcccatttgatgtggtccagaacttagacctcagtccttggatcagccctgtggtccctgcaagcaggggcatctttctgcatgtgagccagcccccttcctgttcaagggttctgctggatctgggcttttcctgtccttcacttctgggatgattcaccccacatcttccagtaccctgtaaaccattttaaaatatttagaaaactatcctcccaaaaatgcttttgaaaatgagagccctctgtccctgccacttacagctagtctctttgggataggggtgtatgtggagagattcatgtaagtctcacatgagtgacctgtgcccctatgtgtactaatgtgtgtactgggtcagaaggtgccctgggttcccacagaccttggtttcctgcctgggtgggtgggagggagggaacttcagagagtatgtgcgaacagccatagcagagccacccctgccaaggacccagtgagggaaactcaggagcaggtggttggttcagttcccgcgctgatgtctggggcagtgcatgtgtgagaagagaggcgcaaagcagtgaaaggagtgatttggcatccagagggcccgggagccccacggataccccagggaagccactgactcacaccgctgcagaggctcctgggcccaatgcccgacccctgctggccagcatggggcctagcactggaagatgcctcaggtgtgtttggagtgggggaaacggaagtagggcacgctctcagagaccaggatagagagtcagggaacctgggaaagagtagtgccagttccgggtaggctgctgcaccaggccctaccagctcaggctataaacagtctgctttgccccaagtcttttccgtccacccccaacagccttgtcatcacttagctactgatcacgcccatggcttgacattggagggttacattagtggagtccgccacagcttcgaaccctctccccagatgccctttgcctctgctgtggccctggggttttatcaactgtccccttcctatcctcctctccaccctgttttttgttttttttttttttaaataatattttgctatgggggaggggaatatcaaatggacaagatcacttttaaatggtagtttttataagatgttataaacttgtatctttttaccattaaagtgcagtgtatgttccttcgtgatatatttaggatatttaaataaaaggaaaatggggcttttctacatacta

SEQ ID NO: 497 - DNA, 15894 bp, Homo sapiens
tctgaggtaagactttattgtatacttgggtggggtagcccagatggatgcaaggttgcaggcatgggaagcagccctcttgggtgtcactctgaaaatgaagtagggtggtggccgcacctcgccagtgaattagtcccctaccaaggtcttacagacccacccttcctctcaccctccagttcccactgtcctccaaggagaagagccttgggtaagtgtccctccctccttcagagagtgggactgtctgcctcttgaaagcgaggattgatggtggtcgtgatggcacttttgtagagaggattactgtcctggagaaagatgttgcagattataagcaaaaatcccaggattcctcgtcccctttctagacctaagaggccagccttgagccgaatcctaggagctgatggaagttagcagaggggttggttacatgtgccaggggctgggggaacccagtgggaggaatcagggctggtcttgtggtgggggaacagctaaaaaggggcctaaccaggaagtctcctcacctgcttccagttgagttgttgctgctccttctcaaagcgactgtattcccggcggtcatagatttccaccgagagccggtaagccaggaccagccccagccccactgccacgatgccccctacgcagcccagcacaatggcctgcgtgtggtctgctccctctgtgaacaagaaaccagacacacttgtgggagctggagcatagggacagatcatcagttgctcacagtgtgtccagcctgtccaaccctgtctgtcactgaaagcaaagggaacccagggaggtccaaggttatcctcaccgcccagggccttagcctcgtccacttgctcaattgcctctgcctttgtcctggattcacagttctgcttcagcccccagcctgtttcccattatcttcactctgcatccccagagttgagaccctgcccatcaaacttccagggtttgtggcatccctgcccacttactttcttggggtctcactctgagcacgaccgtgcctctggcgtcatcctccaccaagaagaagaacagctggttgtccagggtccgctctttgcaccagccatcatccaagataggggccaaggccagggtcacattggtatgggcacaagctgtactgcagttggtggccagtgggccagtcctgaaggccccacactctgcacagtccctgtgtagtagatgccaataggttaccagctgggcagttgtcacccaatgccccttgcccaactacaagcaggacggagagtaggcagatgggagtagctcaacaagccccactgtgcccctgctcccaagatgcaagacctgaggcctcaccggtgtctctcgcatggtgtcttgcagcctgggcattggtcgcatagagcaccatagtagccgtccaagcactggcagcggttgcatttgcagcgtccatgcccactgcagagccctccctcgggactgatgcaactgtccatgtccccactgcattcgcatgctctgcccgtgcggttggcatgacagtgacatactccacattggcagcgaccaaagcctggggtagagccatgcagagggtgacaaccatactccacacacacagttggccatcatgtggcacgacaagcccacgcatccaatctttttgaagtatgccaaccacaccctctaacccatacaccggaatcttttgatatttgccttccatgccaggagattcccagagcctaagtgccttgggaaggcctctcagaccccgcccttctccccaaggctccaggtacctccgcagaggatgccctcatgtcgctcacagctggcatcgtcacactcgcacagatgcccagagctctgtccactgcagctgcagcgtccacattgacagtgaccctttccactgcacaggggccctgtgccattgggagcccggcacccagattccaggtctggggaggacagctctgccacagagcactcacagagccgacctaggcggccaggggcacagctggaaggggaaggcaaaggagagaagtaggtcagagggtttgatcacccctgacttgtctctcccaggaacctctaaacccaagttctcaaaagagttggagacagacaaacagctgaaaggatgttaagtatagtgaaacactgaggggtgagagagtggagggagccccagtcagggggagggcctggacatacatgggaagcttcaagggatgaaactgagtggggagtcgggatgtcgaggagactcctgtgggggggatggaaagcagcggaggaatacgggccagggttggttggttgttgggagccaggtggttgaagggaagaggaggccctcacctgcatacaccacattgtaggtgtccctggccatcactgcagtggggagcctggggctgggtgtcactgcaattacagtcacacagcgtgtgcaactccacaatcagctcctctgagaagccaagggcccggagcctcaggagatggggctctgggaggcagtgggtggcttggagagaaacccagaaagtcacctgagaagaggcaggaatcaggccatggttatacacatgcacacacacataccccaaactcaccaatcatccagaacctcaccccttagtaaatgaagggatggggtcatgttaacacccaactcctagaaacatgcctgaggaagccactcagactgctccaggaaggatggatggaggactacctcaggctctcatgtcactccctgtacctgccacccatcttttcctgcctgcttaatttcccactcccacctccccctgcccgccttctgcctgtgcttgctggctctcaccgtctggttgattcggacgtggttgcactgtcctcgatcctcagccttaccctccctcttctcaggaccctcacactgggattcgtaagaaatgtggaccccaggagggagtgaagagtgttcaagggtcacggtggaagacaggctctatgggaagagagcgagtggataaccacgtgaaggcagaaaaggactccaaccccaccttatgtcctctccaggtgttcccaattctgccagcaccctgccctctgccacctggggctccttccattctgcccagtcgaggcatttctggagggaggacccgtgagaaccttgcatagaacatacaggatccagaggcctctaatacagcatttcagtgcagctgccagcaagggccactgagggtcacaggctggccaggtgctgtaaatgtacagagaccatgtttgtgaagccccacatcaggacacataacctgggtgcatgccaggtctaaagggcagattcattacagagtttatcttgggaaatttgatactgtctcagattttcttgccataggtttaggagatgctccctgttatcaagaagcctacagcctagttgcagaggtaagacctaaaccactaagaatttttatggttccttctacctgtaaaattctatggttcttgtgaagaatagctctgaattatttataaacttagtgaaagcaggctccagatctcacattgtttatgtacagactgactggggacaaatgccagcccttctgtttgttatctttgtgaccttggacaagtcacttagcctccttgtgtgggtttcctcatctgtaaaatagggatggtaacagttatgaagcaaggcttttggcagggttaaatgaagtagcaaacagtatgtacacctaggatggtgggcgcatgaaataaaagctcagtgattgaaactttcctttcttgcccagagcagagctccatgctgtctgcatgtcagatgttttaagatttatgaatgtaagattgaacagttaatgacagccacatgcagactataggtaggagctgtggaatgttagaccaaaaagtgaccatttcctcttagttctgccaccccacccaagggcccctttccacctttccctagtgcccaccctcaccatctccccttcccctggcccctcacattataagcatccatgatgagctgtaccacgttgctggagtcctcactcagctccccaactgcagacttaggaatcagtttactcagctcctgagttttggggagttaagggaaatggtgggtcacagctctaggaaaatgggctcccggaggtctggaaggagggcatatgggggacggagaatgtatctttgggggaattgagaaaggttgggatggggctgggggatctgacatgtagacagctctcacctggtagacaggcagtgcggcactggtgacagcaaagatgggctggatatttgctgcagagagggcctgggctacctgacccacagaagggtagtcctgggacagggagcagggacaaggtgagccccacaggtttcccccacaacatgcaaggtgccctcagcccagggaatccaggaaccaaggttccaccagctggaggagccctggaggcttgctatggaataggaaggaggtagggaatggggtgacaaaggtgtcctgtctcggcagctgaaaggaggaactgctggagaagatggcagggtgtctacagggtggttactggtgaggactgtaaggctgggagtgggagtcctggaaggaaagaggtgtggctgaaatggggagaggcagggtgacaatagggactcacaaactctgtgctgcgactgtagaggccattgctgtccaagtggcagtgcccatcactgggcatgaaaatgccgcccaacttcccgtccccagctgtatggaatgtgtcgtctgaagtgaacaccagcagccgggacacatttctccagccaatctgctcctgagttacagtgggggtggtaggctatgcacctgggcatggcccttgagccaccccagccagctctgtgagccaagaatgtggccagcctcactctgagtcagcttgtccatccccttgcctccagtaccttgcttctccctgctctctccagccccctaaagaaggctgctgctagtggaggcttacttgtgaattcgaaaaacatgcctcctcctcaagatattttactccaacccaccaggtaattgctaaatatacaaactacagcaactatggtatgaatggcaccccctagaactgtgcactacacaaccataaggggcagtcctgttcccaaacagacctccaggctcagatccccgccccacctcctcacctggcagagtgcagcctgcagaatggcatcgaagccaccttcaggcgagtccagattgccggacacactctggcgccccacctcccgctcgaaggcttgtgcgtcccccgtcagggacagcacatggtgaaagctgaatggtgactggcagcgctccagccgggtggggcaggggtggcgcagtttggagggtactgtgctcacaaagggcagcaccgttttgtccacaaaggaaccaaaacctgggagaggagaggaatgaaggttgtgccagaagtcgcagggcagcaacagaggacccatgagagcgctctatgggaagtggggtggggaggacggtgatgggagagggtgcacctagggggcagggacctggtaactggcaagcaaagcagtgagaccactggctcagggaagtggcaggtagaagacattaagaggaggacacaacttcctgggcaaatgggaacttccagaaggcggaagaaggcccgggtataggatatggtagcagcatgaggcaaaggaaggaaatttgaatagaggagagttggcacagaatgtggagccagggacagtggcatctaggtcttgtccagggagacttgcatcagggcaggttccaggttggtaggcccagggcagctgtccaggcccagagagtgcctgagcacagtctctccagacgctgggtctcaggcctgtaaaacggatagtctcttgagtcctctccagctctgacctagaagatgggtgtctagggagagatgcaggaacgaacctgtggcctggctaggcctgtcaacaactgggagggcaagttggggcccttgtgagtccaggatgttggcagaggctagggcagtggttgaataggcaagggctaacagggcgggaggcagcgctcggctcaccaatgcgcacagaatgggtgacttcctgcagccggaccagcagagcgtgcccgagctggcgcacgcgttccaggtcgtccttcatggagtagctcaggtccataaggtagtacaggtccaccgggtatccctcagcacgaaggaagcggacctggagctgctggggctcccctagggggtgggcggcgggcgggtcagcagagcgcattggaacgccagcctagacctctggcctggccccgcctcccctaactcaccaggccgcagcgtgacccggacccgctgcggcgccagctgggtggcaccctctccgcgggcgccctggctgagcggctggtcctgcagcacctcctgctggccgcggggctcctccagctcctccagcgggcagcctcgagccagcagctcctctcgtcgggcgcagcgccgcgcctccgcctctcccgacgcggtgaagttctgctcagcaagaaaaggcgcgtcgggacccggtcctgcataggccctgggccccgctcccaaaaacaccctgcaaacccggccacctctaatgcccccacctccagtccactccttgagtccctgattccctcccctcttcctcgccacagctacccttgaactccggtcttttttgttgttttgttttgtttttgagacggagtctcactctgtcacccaggctggagtgctgcggtgctatctccgctcactgcaacctccacctcccgggttcaagtgattctcgtacctcagcctcccggtagctgggactacaggcatgtgccaccacgcccaggttttttgtatttttagtagagacgggatttccccatataggtcaggctggtctcaaacttttgacctcaagtgcgcccacctcagcctcccaaagtgctgggattacagacgtgaaccaccacgccttttttttttttcctactgtaaagacagggtcttgcttttttgcccagtcttgtttcgaactcctggccccaagaaatcctcctgccccagcctcccaaagtactgggattacaggcatgaaccgccaccggtggaactctggtcctttcttccttgtcagagccccacttcctatagcagtcccccacccctcccctatctcaactcccccttgccccagccacctacccctctcctccccaatagagtcacagacttcctgttgagatcttagagacttcactaccacaaaaaaacaggggccttgcctcctaggccaacctccccagcaagctcacaccaaaatgggaaggtggtcagactaagacccacagctccttggaaaggaaaggataagaacagaagaggaggcgtcctccccaccaatatgtctggtatccctgggactggttgggaagccacaggggaaggaaatggttagagcggcttctcagctggccctaggtgtcaggagactggagaagccagacacagacctgaccatctcaagagcgccagctccccagctccagcctggcacctctgcctctctgccttgtgcagactcagtatctacccttcttgtccagtcagattcactgtgtgcctttctcctgggtccctgtgtgcctttctcctgggtcctctaagcatctgtagctctgcttccatgtgaatttgcccccatctcttatctgggctcccacactgatctaaccctccatcttacactgagagaggcagacctgcccccatcccagcttgggcacccctcctgctctgctgctccatgagttctgtctctttaaagcataaacaaacaacagctttgtttgaagagccagggagacacctgctccctagcatccttcttggccacttaggtagctcaagcctttccagtccccctcaagcccatatgcttccaccccttccctttctacctgtccagtcataggctactacacacccaggaacagaatgcctccacccaaaacacagacttagaaatctaaccacacacttgctgctatggactgaactctgcacccctacccctccccacccccaccccatcctctgttgaagccctaaccctccatgtgatggtatttggagatggagcctttgggaggtacctaggcttagatgagggcctaagggtggaaccctcatgatggaattagtgcgcttacaagaagagaggcagttcccacccccatcccccaaccccatccccactatgtgaggacacagcgagaaggtagccagtctgcaagcaaggaagagggccctaactgaggaaccaaatcagccagcactttgatcttggacttcccagcttccaacattaggagaaatgaattcctgttgcttaaaccacccagcttatggtattttgttatggcagcccgcactgggtagtacctttctcccatgtttacatacacaacagctccctctacctatacacaagcatgaattcccacaagcacatactttctcccaattcatggtcacaaattctctccatatatacacaagcaaatggatacagacataatcctaagtgcacaagaaacttgcatgcatgtgtatgcacacacgtatatccacacacaggagtcctatgtgcacaaactcagtcacacatgagactgtggagtgttcccagaaaatcatacatgtgcccacacaatcacacacatatatccaggctgcacatacatatacacatacacatacacatacacatggttcaaagaccataggcccatctttaccagttgcttgcaccatgcacagctggggtgtgagaggatgcacttctggcaggagggggctggctggcaggaccccagcatggacaggtgaggattccgccattctgtggcatcccctgtggatgggatcttggcgtccaattcactctcacctctgctcaggaccagcagcaaaacaaggaccattggcaaagccaccatgccctgtaataggatataaagggggacatgtgggtcctcagggaggactctcaaactctcagtcctctaaacttagcttgtggttatcactctcaaaactctgccccaacactttatctcccctcatagtttcacttcccctgtggattcagcagtttcttcaaaataatgggaaggagcaggtatcacgcaaaggtaggggcctccggacgtggtggctcatgcctgttatctcagcactttaggaagccaaggtgggtggatcacctgagctcaggaattcgaaaccagcctagtcaacatggcgaaaccccatctctactaaaaatacaaaaattagtcaggcatggtggcgtgcacctgtaatcccagttactcaggaagctgaggcaagagaattgcttgaaccagggaggcggaggttgtagtgagccgagatcacaccactgcacaccagcctgggtgacaaagcaagaatctgtcttaaaaaaaaaaaaaataggggcctcagagaagatctgtccttcctgtgtgcagacttcatgtggccaaggtgggcaaaatggcctactaaaggatttggggactgagcctgaaagcactaaagtctgcacccagttctatttaccgagatcccaagccgtagtggtagaagagccaaacaggaaacagaccagattctggtgctgctgcagtcactcactggctgtggggcaagtcagactttctctctgggctttagtttccacatctgcaaagtggagaagttgaataaatagtctgacatacttggcggcttttacaatcttggattctaaataagagaagagggtcagtgactgggaattaaagaaaagaaagctggagcagatgagggagtgtgtgaaagagtcaaggaagaatagttctgcttggttgacatggtagcaagaggaatgaagattagaccacaagaactctctgcaggtctgggataaggggagaaaggccagtgttggcaaaaaaattttctactttctgtactttgcacaaagataatctagattgaagaaagagcctggagacagggtaataccttgagtgaccttcaggaaagccaagcaaattcctgattttaaaaaaacatattaattttttaaaatgagcaggtaattcatttaccacgcttcataagtcaaaaagttaaatcccattggcccttttttttttgcagaaatggaaaagctgatcctaaaatttatatggaattgctcggaaccccaaatagccaaaataatcttgtaaaaaagatactgcaaagctacagtgatcaagacagcattggctggtcgcagtggctcatgcgtgtaatcccagtgctggtgagaagacagcttgaacccagtagtttgaggctgcagtgagctatgatcgtgtcactgtactttgccctgggcaacagagtgaaaccctgtctcttaaaaagaaaaaaagaagacagtgtggtactggcataaggatacacatatattatacatcagtggaatagaattgaaagagtccagaaataaactatgcttctgtggccaattgatttccaacaagggtgccaaaccattcaatgagaaaaactgtcttcaaaaaatggggctggggctgggcacagtggctcatgcctgtaatcccagcactttgggaggccgaggcaggtggatcacttgaggtcaggagttcgagaccagcctggacaacatggtgaaaccccgtctctactaaaaatacaaaaactagctgggtgtggtggtgggcgcctgtaatcccagctactcaggaggctgaggcaggagaatcacatgatcccaggaggcagaggttgcagtgagctgcaattgtgccactgccctgcagcctggacaacagagtgaaactctgtcttttttgttttgttttgtttttttgagatggagtcttgctcaggctggagtgcagtcgcgccatctcagctcactgcaacctctgcctcccagattcaagcaattctctggcctcaggcgcccaagtatctgggactacaggcatgcgccaccacacccgactagtttttgtatttttagtagagagagggtttgaccacattggccgggctggtctcaaactcctgacctcaagtgatccacctgcctcaggctcccaaagtgctgggattacaggcatgagctgggattacatgcccagctgaaactccatctttaaaaaaaggccaggtaccgtggctcatgcctgtaatcccaacactttgggaggccgagacaggcagatcacaaggtcaggagttcaagaccagcctggctaacatagtgaaaccccgtctctactaaaaatacaaaaattagccgggtgtagtggcacacgccaccactttttctcaaaaaataaaaggtgctttcaacatgcaaaagaatgaagttggaccccctccccacctcacaccatatacaaaggttaactgaaaagagatcaaagccctaaatataactactaaaactataaattcttagaagaaagtatataggtaaatcttcataatcttggacttggtaatggattcttagctgtaataccaaaagcacaaacaacaaaaggaaaaacagatacattggacttcatcaaaaatttaaagttttgtgcatcaaagacaatgtcaagagagcgaagacaacccacagaatgggagaaaatatttgcagattatatatcagatgagtatccttaatatataacgaactcttacaattcaacaacaaaaagacaacccaactttcaaaatgagcaaaagacttaaaaagacatttcttcaaagaagatagacaaatagccacccagcaaatgaaaagatgctcaacactattaatcattaggaaaatgcaaatgaaacccacaatgatctgggtatggtggctcacacctgtaatcctagcactttgggaggctgaggtgggtggatcacttgaggtcaggagttcaagaccggcctgggcaacatggtgaaaccccatctttgctaaaaatacaaaacttaactgggcatggtggtacatgcctgtagctccagctactcgggaaactgaggcacaagaatcgcttgaacccgggaggcagaggcttcagtgagccaagatcgggccactgcactccagcctaggcgacagagcgagaccctgtctcaaaaaaaaaaaaaaaaaaaaaaaagaaagaaagaaaagaaaagaagaagaaaaaaaccacaatgagataccacttcacttctactagaatgactatcaaaaaatgaaaaacaatgagtgttgatgagaacatggagaaattgggatctttatacattaccgtgtaaggaatgtaaagtggtacaatctctgtggaaaacaatttggttcctcaataaattgagcataggattatcctataacctggcaatttcactcttaggtatatactcagaagaattgaaaacaggtgttcaaacaaaaactggtacagaaatgttcacagcagcactactcacaatagctaaaaggtagaaagaacccagatgtccatcaactgatgaatggataaagaaaaggtggtatatccatacagcagaacgttatttggccataaaaagcaatgaaatgggtctgggcacagtggctcacgactgtaatcccagcactttgggaggccgaggcgggtggatcacttgagatcaggagttcaaaaccagccataccaacatggtgaaaccccatatctactaaaaatacaaaaattatccaggcatggtggtggtctcctgtaaccctagctacttgggaggctgaggcaggaaaatcgcttgaacccaggaggcggaggttgcagtgagccgagattgtgccatttcattccagcctgggcaacaagagcaaaactcggtctcaaaaaaaaaaaaaaaatgaagtactgatacatacatgctacaacatggatgaaccttgaaaacatgctcagtgaacaaaaccattcatgaaaggtcacatattgtatgattccacatatggaacatatccaaactagaaaaatccacagagacagaaggtagattagtggttaccagagcttgggagaaggggaagtggggaatgactgcttaatgggcagtttcattttagggtgatgaataagttctggaattagtgaatgtacttaatgccactgaattgtacacttaaaaggggtaaaaatgataaatgtttgtgtatcttaccattttaaaaatcaaaaagttaaataagatggtgagaaatctcctactccatatgccatacccagttcccacacctaccctaaataaatatcatttactactatctttgtttcttttttctttaccttttttttttttttttttttggcagagtcccactctgtcgaccaggctggaatgcagtggcgtgatgtacaacctctgcctcctgggttcaagtgagtcgtgtgcctcatcctcctgagtagctgggattacaggtgtgagccaccacacccagctaatttttgtgtttttagtagagacagagtttcactatgttggccaggctggtctcgaacccctgacttcaagtgatccacccacctcggcctcccaaagtgctggaattacaggcatgagccactgtgcctggccttaaattgtttctagttccctatgacaaataatgctgaaatgaaaagtaatgtatgtatttatttatttattcatttgagagatagggtcttgctctgtcacccggctgtagtgtactggtgcaatcatggctcactgctgccttgaccttgccggctcaattgatccttccacctcagcctcccgagtagctggtactacaggcgcatgctaccatgtctggctaattatttttgtattattttgcagagatggggcttccccatgttgcccaggctggtctagaactcctgagctcaagcgacccacctgcctcggcctcccaaattgccgtgattacaggcgtgagccatcacccccagccaaatgtcatgtatttatcatttcacacgtctgcaactgaatctgtaggataaatccctagcagaggacgtgcaggataactagataggtatcatttgtaatactggtgtgtatttcatctacattctcatgctaagaaatatatatatataggtgggtattgccaacataaactcttcaggacttgtactggtccacattcccatcagcaatgtatgagaaaggccaactaactccttgtcataaaccatttgcatcttcttcagcctgggcccagagtcaggtccagatactctgcacagagtgtgggaaaggggtggggtgttgagtccttgaatgtcctggtcctgctccccaccacctgtgacctcaggcgccatatataacggagcctccacccctcggggagaggccagtcccagctcagcctcagcgtaacctcagccctgcttgctctgcatgcctgtggtcagggaggctggagatgctgcaacccaaagccgggttttgactcatctctcacaagtggagccccggctgccgcataggtttttcagagaccttaggcccactcatctccccttaaagggggccctgggacttcctggacagccctttcctacctttctttccaattatcctctcttctcccctccttgagaatacatgttctgccacctatttctctgtctgcttctctgtctctctctggctcctttcatttcaaaacttctattgcatctctctgctgcttttctctgctccacttcttcatagggctattttacttccttttcccctctgttcctaactatagaatggctgaatctactactccatcccactctttttacaaatggaaacctaaattccatgaggccagggtcacccagtgaactaggggcagggcaggacagggcagggccaggcctctgctgtgctttctcctttcctccctccaacccaggcactatctccatcaaaagttgtgttctctccccactagccctggtgggctctgcctaatcccatttctctttccttaggggtattctgcagtcttcccttctctctctgggaccaagtggttatttccatttttctggactccattctgactccagtacacaccctgtgacccccctcagcagctgagaaacagagcctcttccaaacccatccctaccttccaaatcaagcagaaccctctgctgcccactgggagtcacaaggaggggacggaactgagctgctgggcctcagtgtcccaggacagtggagtctgtgaccaaggtgccgattaggaagaagtctgagctgaaggcagagcattagggatagcagctgggggtgatgttggaagaaccctccctcagtataatcggtatacctgccctacttcggtatagtccttggcacatggcaggcactcagatgacagcactcatatacatccctgcctccagacccactcatgggaaactgatgcaggagagattgggcttttggagaggtggaggtgggggtactgtgaaactggaggagggaaccaggtcaggggatcttaggaatgcagaaaggagttcagagcctttctcaagtctggacaggaccctcggtatccaggtcagagccctcttcccaagaggttgggaccaggtgggccagagcttgtaaggagaggaggcagaagggctggtgccctggtactcacaggtgcgtgcagagc

SEQ ID NO: 498 - DNA, 9848 bp, Homo sapiens
tcatgagtttccatcactttattttgcaaaaatagaaaactcagcaatatgcgatacagcggggtagaggggagatgtaaacagaggggaggggacagcaccctgaccccccaagagaacacagggagccaatgggaatcttatttggcagctaaatacaaactggggattggaggaagaaaggaggggtcacaggggccctgggctcccccacccaagacccctggaggaaggggtcaattccacggtgtaaacaaaagctaataaataaatagaggcttcctctgggtcagggcgggatcagctaagcagcatcccccctccctgggccaagctgctctggggagtaaagggtggaaggcactagggagagagggatcccctggcccctctgtagtgtaggagggtccctgccccaatggctgagatggagggcaggaggagcccaaggcacatgacagggctgggggagggacttataacggagggcacagggtgaactctgcacccgagccaagaggtgcagaatggacctgcatctatctgtccctttcaccctctgttcctgccccagaaatgcagggcccagcctgcccccaccttgacctggcacaaggacggggcacagaggctagcacacaccctgcaggtgcatcacacagcattaggcaccaagggtaggagcaagaaggtgggctcagcccttctcctttgtcccctttttggtctctagtgttcctgtttgctctcagagagccaagcacctggcagaggaaggggctgtggaatggcagggtcttcctcttgccctgggaagtctaggacccatggggcagtgctgagattttagagtccaaacccaggctcatccctttgccctctctcctggtgggagcagggcaggcccccgggactggcgagggagccggttagatcaggaaggggatgaacacagaggcacccctagaaactttggcaaaaacaaggagctcattggaaggggtggggagagggcagagcaggtcctcccccagtcactggcggtctgggagatggtcagtctgctgcctgaagccccaacccccacagcggggaggtcaggggccctggtcaggctggggacttcaggccccctttgccctggcccccaggaacctcatcctcgctagaggcattggggtggggaccaggctgcgaggagtcatcctcaaacatttcagggttctccagcatctctcggattaagggaggcatcgggcctggaatctccatcttcagagtaatggccctttcagctcctacaatggagagagaaagagagaggctcaggaggacagaggcacatggcccttaaggccatctccctaacctttctcaactgcccctgactcccctagggggcgcccagcacaggcccaccacctctccgtccccagctcatcctcttctcactaggcttcctgggtgccactcctctgcctggaacctctacctggccttctctaccaggcttgctgcccattcatcccattctttcaggctgtctcttcagcgagcgcaatgcacacaacttccaaccccactccccaagtaccccactctcgaatgtccagagcttgtcacttgttcctagtcctgttctcttaataacatttattaccacagctaatatttatcaaacactatgttccagacatccttctaagcctggactgtccaatagaactttgcaatgataggaatacagtagtcattggccacatgtggcaatctgaaatgtgactactgcaactgcagaatggaatttttaattcagcacaattctaagtacactgtatatgttacaggttttttttgttgtgttgttgttgttgttgttgttttagaggcagggtcttgctgggttacccaggctggactgcagtggctattcacaggtacaatcatagctcactgcagcttccaacttctggcctcaactgatctttctgcctcagcctcctgagtagctggaactacagatgtgcaccatggtgcctggctttacattgtatattaactaatttagtcctcaagacagcgttacaaggtacgtgaagaatagcccagtttacaaacaagattaaaaaagtaaagcaatttgcccaagactttgtctctaaatatatatatacacacacacacacacacacacacacacacacacacacacacatacttggaattgtgctgaattaaaaattcaattctgcagttgcagtagtcacatttcagatgcttaatagccacatgtggctaatgactattgtattcccatcattgcagaaagttctactggacagtactggtttagaagcaatttgcccaaagtctcccactactatgtggcagagctaggattccagtgtagattgcctggttctcaactactctgttcttgtctctgtgtgtcctcctgtccgacctgggagaccaacagccctgggaagacagagaggggacacccactcatgactcacccttagtgctgatgccccggaggtcggtgattttcattagcatccttgggaacatgtagggctggctgggccgccggcgccgggcgtacagcctcagggcttccagcagtggctcctgcagcttgtccactttttcgggctcctccaggtccatgcggtctatggggacaagtatactggagtgagaggggaaggaagagatggggaagacacagtgacagatggctgatcaccaaccggcgttttgggaagcctgtacagggtttcagaactctctggatggggccaggtgcaagaattaccagcagaagagaccactgggtcctccacgccccctcccagacagattccgcatggagtggtgggaaaggagactgagcactgagcagacgccagggggcgcccccgcacctccgcagatgaggcagatggcgctgagcagccctgtctcggtgtcatccatctccaggggcaggagctgcccagcaaaggcaaagacaaggtctgtgaggggcccgaagccggcattgtgcatctgggtccggttcagggtcagcccgtcggagaaggtcatggtgtcctgctctggggtgtaccttgtgcagatacgcagcatctggaggtggggggtggaggagggttagtgctgtttctgggggatggggaaaagagggaatgagtggaaagtgaggaggttaggtccccagtgagtgcaacctgaagcaggcatggagaaggcagaggtggaggatctgaggcttggcaggggtagtcccgggaagtcaggaggagacagggcatccaaaagtctaggatcaggtcataggggcagaggctaagacgaaaagagagctgaggagtcccacatgtgtggcagggggtgcagggtaaggaaatctttgcatggatcaaggaattgttgagggtcccatatgtgggtcgggctgtggcaggacccacagggcctaacttaccaggatatctaggcaggcagctttgagcagagtgatctggtcagcaatgctgagccctgtaaagccaggcaaccgcttggcaaactccacgatcttgatgatgcacttggtagccagctcactgaacttgtcccacagccccagatccagctgcacgcggtggtctgcactggagttctgcagaggggaggggtagaaggttggaaggcaagctaaggcccacctctgggggctgtcttctctctaccaatatcccaagctctctcctctgcattctgatgccctccttgtcctcagcaccagtcgatgatagcctccaacacaacccagccccattccccaaagtgaagagtgccctgccctcactgggctctgcccattcctcaccgtggtatacttgcccagctggcagagcgaggggaaagtctcctgatgggctttgctgaccttggtgatgagctcttctaactgagggctcagctcatagctgtcaggtgacccttcttccttcacctctttcttcttcttgttccggtcatttcgcacagcttgtgggtggaggcgcaaggagagggtcaggaccctcagagcctccctttgggtgtcctctctcaccctaatttaatatgctcagtccttatcatgaatatctattctctggcactgtaattactgcctcagtttccctatcacctataatagctcctattcccaggctggttctccccagccccacccagggcctgcagcccctgctccttccccaggccattcggctccatcctgtccttcctgtcaccctgcaggagctgggggagggggggcaggatatgcaggcggcaggatatccacttatagccttggcagcacaatgggggcgaggggggggtggagaggaggagccaccccatatccatctctggctcagtccaggggagggaaagggactggcaagcccactggcttcatttcccccatgaaacagggggaatgtgagaccctacttattcacccattcagaggaagagtcaagctccctgagagggagaatgggaaatggtggggcctcctggttgaatggagctaatcaaataagactggcctgggagaaggcagcaccccagggcaggccaagtctcagaggtcagggaagtgggagtggccagaggaaagagggccacagccatagggtaggaccgaagtgctcctgcccaagccaaggatggcagcctaccttccttggacatgcccacttcgaagcacttctgtagccggcagtactggcagcgattcctggtcaccttgttgatgatacagtttttgtcgcggtgacacgtgtacaccatgttcttctggatgcttcggcgaaagaagccctggagttgagggaaagagagagggcctctgaagcacaatgctgggagtaccagcctctcactggccttgcaggttgccccaagcctgacctaatctattaaccacctatgtgcaaagcagtgctgctcagacacagcatctgtgtgcctggtctctcatcttactagggtaactggatcccccgtctgcccactcccaccacgtacacaccttgcagccttcacaagagctgaccccatagtggtagccagaggacttgtcattgcacacgaagcatggcttgtagacccgaggaggcggagggggcgagggcgagctgggcaccatctcctctgagctggtgctctgtgtctccaccgctgggagggaagcagtgatgtgagggtcaggggagaaggaccccacagacctccaggcttcctcatcacacacaccccatgtgcatttgttccttggcccactggtgacagccatcactaccacagtgcactagttccagcagtaagcactgtcagaatcctcttaatgaccactattaccacagcttgttgtgaccctagttcaccctctaccctccacagtctaaccaacttgttcacaagaatgccagccctcatcctatatgacatgtttaatcctccaaattccagaccaaggccattccggaaattgacttctctgggcctgtttccctaactatccaggaggtgggtagaagagttaaagccctgcagctctgagctctctagtcactctctgtctctttggtatatctttgtcaggtagtctacttcccactgtcctccctgtggggcaataactctgggggcaggtaggcaatgacaggcttcctgtagctgctactggccaaatgacctgctgggatgcttagcaggtaaaccaggacctcatttcctttccagtagtacaggggggataactcctcaggcttatctctctcacactacccctgaataaccatcagagacagtggagcaaatggggcaaaggtctcaggggagtgagtgagaggatgcaccacagccttggttcacgcctgaagaaactgaggccacgagaggggaagtgaccagctcagtgccacaccaccagcagatccaagtggctgtgagtcagagaagctggggaagcagaggctgaggtgtttgctcagtttctcaggtctggaagccgttggaggtgtagcaaactggagaagtcaggtgacagtaggtaaacaggactgatgggggagggaacctgtttctggaccctctctgagcttatgtcttcactctgaaaatacccaattgcagctcaaaaggggtctcagccccacagtatggggaggacatgctctgctctgttcaaaaggctgctgggtaagtgtgtgtgtgtgtgtgtgtgcgcgcgcgcgcgcgcgcgcgtgtggttggtcttcagaggctcggaaaatttgtaaattattcaacctgtaggacctgttgcccaaacctggagggcccaagttaatgcaaaaaaattcctaagaccctccctaaggtgtgtcccacgcacccacctcatgaacaccttctcccttctaaccctctgcagcccacctggtcagaagcccgccccaacgcagccagaagggcggaaggaatgcccaggatgccagggttccacgctagctccacccaccccacaggagggaagccctacccacccccaacacacatacaatcaattagcataagaatcctgccagagtgagattacccaaagaaaaaggagagaggagaggggggaaagaagggtgcctggagtctattcaagactagggatgggggctccaggaggggctggtgctgagagatgtgaggagggctggaacgcctttcccaacctctcctcactcctcagacccaccactgtgtcctccaagggcacgtgttctgcccaaggcctgtgcgtggggtggtgctcactctggcactgacgccctccctgcccgcagagcgctgcctcatttcctctcttgcgcaagggcctgggtgcggtcagactggcatggggcagtgccagccaattataagactgggggccttagggagacaggcccgggggcaacttttcctgtctaagtgatactgtcacatccccaccccctgaaccctaaagtgcagcctagtggctccgaggtcaatctgtgaggtcaaggccccagaaagctaactgggtctactccaatcagatcccctccccagactcgggcttagaccccaccattgggatgcagctcctgggttaggcaggggcccctgctggggaggatgggggtgggctctggggttttctccttttaaagcccaaattgctgaaattgaggaaattcctgaccaggctgcgcggagcttcaaacaaactctttataaccggctgtaaacgctcccagctgcgaggctcagagctgagcagcctggactcacaatctagcacacacctccttggagacacacacactcacaggttaacaacacataaggcaccaaagcaggcatattacaatgggatcctagaaccctcactggattctggcacagacacacagccagaatagagacacactcactccagctacaccgtggaggtagatgtaccagtcacaaggctgacacacaacagccagcacttggccacacaagggaacagccctaccaccagacaaacaccccagcctgccaacgcagcaccaggacaccaaagcctccaaacaggcacacacacacacacatccagcccacctccaccccccaagcacccttccctctgaaagtgtgtgcgggcaggcctgaagctggctttgtgtgtccaccaggatcccagaggccaaaattattggtcccaattaaaactcaaaaacctagggccagtcaagcccaaagggcttcttccataggcctgaaaaaagacagggtctctgcccagcccccagaagcccttcctgaaagattctttccatctcagcacccccacaacatataacataccccaactccccatcctattgggcaatgagaggaaagttaagaattcacagggatttggtgcaaagcaatagttccatgctttctcggttctttaaatgacacacttttaaattcttcccccaccccacccaaaagtaaagtcaagtccggtctcctggtttgccatctccctcttccagcttcccagttgttaaatttgagcagctctgctctggaaccaaaaaaaaaaatccgaacttgtaaacagcactgcttggtgccaaggagcgaggcgcgttggcgggggcttggtgacctggcgtgcgcactcccccagcgcccgccgccccgcccgctgcccgccccttcccacccttcccagcgtgcccccaagcccctcatccccgggccgtccgcacccaggcagcgagcacatcccagcccagggtaaatttggggggtgttccaggctgcgctcctggcccctccccacaccccacccccgccaggcactgcggcccaagcttcaaagccgcctctcatctggacttcatttttactgcctctcagtccccagctttttattactgctctggaaaggggttccagggccccaggcctggcatctcccatttcacggagggggaagatagatatttggggacccagtaatggtgctcgccctgccgctgtcaacttcaggccaccccccaccacacacacagactttgctttaaacttttcgcttcctgctgaagttgttgtgtgttggagccataggaaaaagtaatctctgcatataaccgcatacacgtttccaaacatttctttttttatatgggggtggcgtacaaaactcagccttctccctcttgtgtgcacaaccttttccacccggcatgagaacacacaggatgcactctcgaacacagcactttccaaaaccgcccccgcagccacgcaggggcacacgccctcccggcctcacgccacaaacatcccctcacaggccatgtggacctggcagctgtcgcaggcgacactggtggagagacccttgctcccacacccacaccacctaggcaaggcgctgcacactccagggattcacacgctctgcaaacgatatttttaacactgccagcttcccacatgggctttacaaacgccacccacggtcctgagtgtcatatccttccagggccacggacgtgaaggcgcaaactacccacacacctcggtctctccctatccccaggaactctggagtggcatcaaccacaggttcgagctaaacacccaccataaaaaccacacacactccaaacactactgcacacacgcaaaggagacgctgaggcccccacgtttaaagggccagtaccttacatagaaagggccagaagctcctccttgcacctcagttccactctttacacacggaaagagtaaatcccaccctctcctgcaccctacaccccagccccggactccggtacctacattgcaggctggcgggttgcggccaggcaaaagattcaagtccggcgaaacaggagccgccggtggctctgcgcagcaagccggccccgggcccggccgccccgtacagccgtcgcggacccggggcaaacgtttccatacagtcgtacatcgcgacccggcttgaagggaaactgggtgctggaaacaccaaggacccgcagccgattccccctcctcccccggcggcgccccgctccagcagggggggagggggagggctagcatagggcgctgggctgcatgcgggtaaggggtgggcggggaagaggggggatccccagcaggggaaagggactgggcggggcgcgaagctggggctgccgctttagcctccgtccagctcttatctgggtgcttcggcagctagcactggggagaccttttttaaaagcgaagcctggaggggtggggggtggggcttg

SEQ ID NO: 499 - DNA, 9848 bp, Homo sapiens; identical to SEQ ID NO: 498

SEQ ID NO: 500 - DNA, 21691 bp, Homo sapiens
tcatgagtttccatcactttattttgcaaaaatagaaaactcagcaatatgcgatacagcggggtagaggggagatgtaaacagaggggaggggacagcaccctgaccccccaagagaacacagggagccaatgggaatcttatttggcagctaaatacaaactggggattggaggaagaaaggaggggtcacaggggccctgggctcccccacccaagacccctggaggaaggggtcaattccacggtgtaaacaaaagctaataaataaatagaggcttcctctgggtcagggcgggatcagctaagcagcatcccccctccctgggccaagctgctctggggagtaaagggtggaaggcactagggagagagggatcccctggcccctctgtagtgtaggagggtccctgccccaatggctgagatggagggcaggaggagcccaaggcacatgacagggctgggggagggacttataacggagggcacagggtgaactctgcacccgagccaagaggtgcagaatggacctgcatctatctgtccctttcaccctctgttcctgccccagaaatgcagggcccagcctgcccccaccttgacctggcacaaggacggggcacagaggctagcacacaccctgcaggtgcatcacacagcattaggcaccaagggtaggagcaagaaggtgggctcagcccttctcctttgtcccctttttggtctctagtgttcctgtttgctctcagagagccaagcacctggcagaggaaggggctgtggaatggcagggtcttcctcttgccctgggaagtctaggacccatggggcagtgctgagattttagagtccaaacccaggctcatccctttgccctctctcctggtgggagcagggcaggcccccgggactggcgagggagccggttagatcaggaaggggatgaacacagaggcacccctagaaactttggcaaaaacaaggagctcattggaaggggtggggagagggcagagcaggtcctcccccagtcactggcggtctgggagatggtcagtctgctgcctgaagccccaacccccacagcggggaggtcaggggccctggtcaggctggggacttcaggccccctttgccctggcccccaggaacctcatcctcgctagaggcattggggtggggaccaggctgcgaggagtcatcctcaaacatttcagggttctccagcatctctcggattaagggaggcatcgggcctggaatctccatcttcagagtaatggccctttcagctcctacaatggagagagaaagagagaggctcaggaggacagaggcacatggcccttaaggccatctccctaacctttctcaactgcccctgactcccctagggggcgcccagcacaggcccaccacctctccgtccccagctcatcctcttctcactaggcttcctgggtgccactcctctgcctggaacctctacctggccttctctaccaggcttgctgcccattcatcccattctttcaggctgtctcttcagcgagcgcaatgcacacaacttccaaccccactccccaagtaccccactctcgaatgtccagagcttgtcacttgttcctagtcctgttctcttaataacatttattaccacagctaatatttatcaaacactatgttccagacatccttctaagcctggactgtccaatagaactttgcaatgataggaatacagtagtcattggccacatgtggcaatctgaaatgtgactactgcaactgcagaatggaatttttaattcagcacaattctaagtacactgtatatgttacaggttttttttgttgtgttgttgttgttgttgttgttttagaggcagggtcttgctgggttacccaggctggactgcagtggctattcacaggtacaatcatagctcactgcagcttccaacttctggcctcaactgatctttctgcctcagcctcctgagtagctggaactacagatgtgcaccatggtgcctggctttacattgtatattaactaatttagtcctcaagacagcgttacaaggtacgtgaagaatagcccagtttacaaacaagattaaaaaagtaaagcaatttgcccaagactttgtctctaaatatatatatacacacacacacacacacacacacacacacacacacacacacatacttggaattgtgctgaattaaaaattcaattctgcagttgcagtagtcacatttcagatgcttaatagccacatgtggctaatgactattgtattcccatcattgcagaaagttctactggacagtactggtttagaagcaatttgcccaaagtctcccactactatgtggcagagctaggattccagtgtagattgcctggttctcaactactctgttcttgtctctgtgtgtcctcctgtccgacctgggagaccaacagccctgggaagacagagaggggacacccactcatgactcacccttagtgctgatgccccggaggtcggtgattttcattagcatccttgggaacatgtagggctggctgggccgccggcgccgggcgtacagcctcagggcttccagcagtggctcctgcagcttgtccactttttcgggctcctccaggtccatgcggtctatggggacaagtatactggagtgagaggggaaggaagagatggggaagacacagtgacagatggctgatcaccaaccggcgttttgggaagcctgtacagggtttcagaactctctggatggggccaggtgcaagaattaccagcagaagagaccactgggtcctccacgccccctcccagacagattccgcatggagtggtgggaaaggagactgagcactgagcagacgccagggggcgcccccgcacctccgcagatgaggcagatggcgctgagcagccctgtctcggtgtcatccatctccaggggcaggagctgcccagcaaaggcaaagacaaggtctgtgaggggcccgaagccggcattgtgcatctgggtccggttcagggtcagcccgtcggagaaggtcatggtgtcctgctctggggtgtaccttgtgcagatacgcagcatctggaggtggggggtggaggagggttagtgctgtttctgggggatggggaaaagagggaatgagtggaaagtgaggaggttaggtccccagtgagtgcaacctgaagcaggcatggagaaggcagaggtggaggatctgaggcttggcaggggtagtcccgggaagtcaggaggagacagggcatccaaaagtctaggatcaggtcataggggcagaggctaagacgaaaagagagctgaggagtcccacatgtgtggcagggggtgcagggtaaggaaatctttgcatggatcaaggaattgttgagggtcccatatgtgggtcgggctgtggcaggacccacagggcctaacttaccaggatatctaggcaggcagctttgagcagagtgatctggtcagcaatgctgagccctgtaaagccaggcaaccgcttggcaaactccacgatcttgatgatgcacttggtagccagctcactgaacttgtcccacagccccagatccagctgcacgcggtggtctgcactggagttctgcagaggggaggggtagaaggttggaaggcaagctaaggcccacctctgggggctgtcttctctctaccaatatcccaagctctctcctctgcattctgatgccctccttgtcctcagcaccagtcgatgatagcctccaacacaacccagccccattccccaaagtgaagagtgccctgccctcactgggctctgcccattcctcaccgtggtatacttgcccagctggcagagcgaggggaaagtctcctgatgggctttgctgaccttggtgatgagctcttctaactgagggctcagctcatagctgtcaggtgacccttcttccttcacctctttcttcttcttgttccggtcatttcgcacagcttgtgggtggaggcgcaaggagagggtcaggaccctcagagcctccctttgggtgtcctctctcaccctaatttaatatgctcagtccttatcatgaatatctattctctggcactgtaattactgcctcagtttccctatcacctataatagctcctattcccaggctggttctccccagccccacccagggcctgcagcccctgctccttccccaggccattcggctccatcctgtccttcctgtcaccctgcaggagctgggggagggggggcaggatatgcaggcggcaggatatccacttatagccttggcagcacaatgggggcgaggggggggtggagaggaggagccaccccatatccatctctggctcagtccaggggagggaaagggactggcaagcccactggcttcatttcccccatgaaacagggggaatgtgagaccctacttattcacccattcagaggaagagtcaagctccctgagagggagaatgggaaatggtggggcctcctggttgaatggagctaatcaaataagactggcctgggagaaggcagcaccccagggcaggccaagtctcagaggtcagggaagtgggagtggccagaggaaagagggccacagccatagggtaggaccgaagtgctcctgcccaagccaaggatggcagcctaccttccttggacatgcccacttcgaagcacttctgtagccggcagtactggcagcgattcctggtcaccttgttgatgatacagtttttgtcgcggtgacacgtgtacaccatgttcttctggatgcttcggcgaaagaagccctggagttgagggaaagagagagggcctctgaagcacaatgctgggagtaccagcctctcactggccttgcaggttgccccaagcctgacctaatctattaaccacctatgtgcaaagcagtgctgctcagacacagcatctgtgtgcctggtctctcatcttactagggtaactggatcccccgtctgcccactcccaccacgtacacaccttgcagccttcacaagagctgaccccatagtggtagccagaggacttgtcattgcacacgaagcatggcttgtagacccgaggaggcggagggggcgagggcgagctgggcaccatctcctctgagctggtgctctgtgtctccaccgctgggagggaagcagtgatgtgagggtcaggggagaaggaccccacagacctccaggcttcctcatcacacacaccccatgtgcatttgttccttggcccactggtgacagccatcactaccacagtgcactagttccagcagtaagcactgtcagaatcctcttaatgaccactattaccacagcttgttgtgaccctagttcaccctctaccctccacagtctaaccaacttgttcacaagaatgccagccctcatcctatatgacatgtttaatcctccaaattccagaccaaggccattccggaaattgacttctctgggcctgtttccctaactatccaggaggtgggtagaagagttaaagccctgcagctctgagctctctagtcactctctgtctctttggtatatctttgtcaggtagtctacttcccactgtcctccctgtggggcaataactctgggggcaggtaggcaatgacaggcttcctgtagctgctactggccaaatgacctgctgggatgcttagcaggtaaaccaggacctcatttcctttccagtagtacaggggggataactcctcaggcttatctctctcacactacccctgaataaccatcagagacagtggagcaaatggggcaaaggtctcaggggagtgagtgagaggatgcaccacagccttggttcacgcctgaagaaactgaggccacgagaggggaagtgaccagctcagtgccacaccaccagcagatccaagtggctgtgagtcagagaagctggggaagcagaggctgaggtgtttgctcagtttctcaggtctggaagccgttggaggtgtagcaaactggagaagtcaggtgacagtaggtaaacaggactgatgggggagggaacctgtttctggaccctctctgagcttatgtcttcactctgaaaatacccaattgcagctcaaaaggggtctcagccccacagtatggggaggacatgctctgctctgttcaaaaggctgctgggtaagtgtgtgtgtgtgtgtgtgtgcgcgcgcgcgcgcgcgcgcgtgtggttggtcttcagaggctcggaaaatttgtaaattattcaacctgtaggacctgttgcccaaacctggagggcccaagttaatgcaaaaaaattcctaagaccctccctaaggtgtgtcccacgcacccacctcatgaacaccttctcccttctaaccctctgcagcccacctggtcagaagcccgccccaacgcagccagaagggcggaaggaatgcccaggatgccagggttccacgctagctccacccaccccacaggagggaagccctacccacccccaacacacatacaatcaattagcataagaatcctgccagagtgagattacccaaagaaaaaggagagaggagaggggggaaagaagggtgcctggagtctattcaagactagggatgggggctccaggaggggctggtgctgagagatgtgaggagggctggaacgcctttcccaacctctcctcactcctcagacccaccactgtgtcctccaagggcacgtgttctgcccaaggcctgtgcgtggggtggtgctcactctggcactgacgccctccctgcccgcagagcgctgcctcatttcctctcttgcgcaagggcctgggtgcggtcagactggcatggggcagtgccagccaattataagactgggggccttagggagacaggcccgggggcaacttttcctgtctaagtgatactgtcacatccccaccccctgaaccctaaagtgcagcctagtggctccgaggtcaatctgtgaggtcaaggccccagaaagctaactgggtctactccaatcagatcccctccccagactcgggcttagaccccaccattgggatgcagctcctgggttaggcaggggcccctgctggggaggatgggggtgggctctggggttttctccttttaaagcccaaattgctgaaattgaggaaattcctgaccaggctgcgcggagcttcaaacaaactctttataaccggctgtaaacgctcccagctgcgaggctcagagctgagcagcctggactcacaatctagcacacacctccttggagacacacacactcacaggttaacaacacataaggcaccaaagcaggcatattacaatgggatcctagaaccctcactggattctggcacagacacacagccagaatagagacacactcactccagctacaccgtggaggtagatgtaccagtcacaaggctgacacacaacagccagcacttggccacacaagggaacagccctaccaccagacaaacaccccagcctgccaacgcagcaccaggacaccaaagcctccaaacaggcacacacacacacacatccagcccacctccaccccccaagcacccttccctctgaaagtgtgtgcgggcaggcctgaagctggctttgtgtgtccaccaggatcccagaggccaaaattattggtcccaattaaaactcaaaaacctagggccagtcaagcccaaagggcttcttccataggcctgaaaaaagacagggtctctgcccagcccccagaagcccttcctgaaagattctttccatctcagcacccccacaacatataacataccccaactccccatcctattgggcaatgagaggaaagttaagaattcacagggatttggtgcaaagcaatagttccatgctttctcggttctttaaatgacacacttttaaattcttcccccaccccacccaaaagtaaagtcaagtccggtctcctggtttgccatctccctcttccagcttcccagttgttaaatttgagcagctctgctctggaaccaaaaaaaaaaatccgaacttgtaaacagcactgcttggtgccaaggagcgaggcgcgttggcgggggcttggtgacctggcgtgcgcactcccccagcgcccgccgccccgcccgctgcccgccccttcccacccttcccagcgtgcccccaagcccctcatccccgggccgtccgcacccaggcagcgagcacatcccagcccagggtaaatttggggggtgttccaggctgcgctcctggcccctccccacaccccacccccgccaggcactgcggcccaagcttcaaagccgcctctcatctggacttcatttttactgcctctcagtccccagctttttattactgctctggaaaggggttccagggccccaggcctggcatctcccatttcacggagggggaagatagatatttggggacccagtaatggtgctcgccctgccgctgtcaacttcaggccaccccccaccacacacacagactttgctttaaacttttcgcttcctgctgaagttgttgtgtgttggagccataggaaaaagtaatctctgcatataaccgcatacacgtttccaaacatttctttttttatatgggggtggcgtacaaaactcagccttctccctcttgtgtgcacaaccttttccacccggcatgagaacacacaggatgcactctcgaacacagcactttccaaaaccgcccccgcagccacgcaggggcacacgccctcccggcctcacgccacaaacatcccctcacaggccatgtggacctggcagctgtcgcaggcgacactggtggagagacccttgctcccacacccacaccacctaggcaaggcgctgcacactccagggattcacacgctctgcaaacgatatttttaacactgccagcttcccacatgggctttacaaacgccacccacggtcctgagtgtcatatccttccagggccacggacgtgaaggcgcaaactacccacacacctcggtctctccctatccccaggaactctggagtggcatcaaccacaggttcgagctaaacacccaccataaaaaccacacacactccaaacactactgcacacacgcaaaggagacgctgaggcccccacgtttaaagggccagtaccttacatagaaagggccagaagctcctccttgcacctcagttccactctttacacacggaaagagtaaatcccaccctctcctgcaccctacaccccagccccggactccggtacctacattgcaggctggcgggttgcggccaggcaaaagattcaagtccggcgaaacaggagccgccggtggctctgcgcagcaagccggccccgggcccggccgccccgtacagccgtcgcggacccggggcaaacgtttccatacagtcgtacatcgcgacccggcttgaagggaaactgggtgctggaaacaccaaggacccgcagccgattccccctcctcccccggcggcgccccgctccagcagggggggagggggagggctagcatagggcgctgggctgcatgcgggtaaggggtgggcggggaagaggggggatccccagcaggggaaagggactgggcggggcgcgaagctggggctgccgctttagcctccgtccagctcttatctgggtgcttcggcagctagcactggggagaccttttttaaaagcgaagcctggaggggtggggggtggggcttggagagcgaagggggccgggcaccgagatgagcaaagctgagagtggagcgcacacatacacatacgtacactcgctccgcggcgcgcgcgcttgcttagacacacatccgtgcatgcatttatcttatcaggcaccaagaatttgcaaatatgcaagagtgaacatacatgtgagcacgcatataaaatcataggtgcacacacgtttgtgcaaacacaccttgctcgggagaatgcttgcaggcatactctccacagctcataggctttgcatgcatttgcactgaggcgcgtgcccaggtcggggttggaagaaggagaggaggaaccaagcataagcatttcctttcagagttttccctctccccaaactctccctttttcacactagtcaatacaggggtgttaaggatgactggggagaggggaacgtggaggtccccgcgcgcagctgctctcctgaggctcgggacctgcactacctccacccctctcattcccaggcctggctccgccctcgccctccgcgcgcccgcttcagggccgaaaagtgcattcctgcggctcggcgcgcgctgcctcctccttccttcccgtctccccacccgcggtcctagggccggagcgcgctcccgccgtgaactctctgggaacccccctcggggcgggtggccgagcgcgctcacctcctcctgacccggccccgccccaccccgcccaggccgtcttcagcgctgccgcggagtccccccgccccctccagcgcagccagagtctacccctcctagcccgagcagtccgccctccgccgcggcccgggccgcctccctccgagtccccgaagccttatcccgcaactgacgccccctaagcgcctcgaccgtctctctcgatgctccttcttcgaacataacttcacttttagagcacaaaactaccccataagctgtgcctgccgtgccaactgcgcctcgatgaatctgcccctgatggccaactcccctcctccagtttctcactgccaagggctccctcggcaataggggcgcttctggtcactgactgttctcagggtctttaaataccctctagcctaggcataactgccctcccttcggttagtgcccctcagctctccaaggccgcaacactgttccctgggttgccccttccggcactgagcgccctcgcccggcggagaagggggtgaggtgggcggggggctggccacgtcagaagtttgccctggcccggcagggccgaatggggggaccctggccccggacagcgccagcagcggcgactcccggaaatccccccctcccccgcgccccgccctcagccgccgggccgcccggcctgcctgcccagccggctctgtcagcgccgctcacacgggcagcgccgcggagcgggagcggcgcccggcccggcccttcccccgccaggcggctgtggctgggccagggcggggcgcgcttttctaagaatctgttgtaccgggtggggggcgcactggggtgctgcaggagtggggcgcctgttggaagaataaagggcaggaaggggtgccagagtaggcgagggatggcgggcgcgggggaggggcggggggctgccggggctgggaaaaggcctgacttgtggatggcgaggaaacctcggggtggcaaggctgactagggggcttgaagcagggatggagagggaatgcactgctctttccaacccagtgtaaactcccttctcctcccccaaccccaaatacccatttctgaatccagtcacccgaaccccacaaaaaaaagaaagaaagagagagaaagaaaagaaagagaaagaaagaagaaagaaaaaggaagaaagagaaaggaggagaaagaaagagagagagagagagagaaagaaagaactttctgaatcagaatctgaccagcagcaaacaacaacaaaaacagttaagtgcaaaatagggagtaccccgaaaacaagagggaaagagccttgattagtcaacttcaagctgtcagtaccccccttccccctcagaaatctgaaaggtcccaattaagtcaggcctgcctggttggtaattagaaccagaagtggccaggccacagggaggggggttgggaggagggcacaggaggagttgggggagggctccaggaagccatgagtcctcaatagcccccgtttctcttcaccagatgcaccccactcatcaccccatctgtgtgtgcatcccaggcattgcatggagggggtccttaggaccaggcattacggtgtcaggcccgccctccccatcaaccctgacccccccattctagacagacttagtacagccttggggagaaggtaagagggtgggggatctagtgccccctcttttccccaaagtttccccagcccttattgcagcaattagacccattagccttctagcatttcatgggaaccagatgttctccaccatcctggtgggagtatgaaggggggctgctgcctgactcacccccttccctatgatccccaccaccagggcatacccccctcccagctagagccccacaaaggcatagccctagaggcaaagaggagagtaccccttcccaactaacaaagccattagcactcagattctttcggggtcaccccttagagtccctgccaccctggcaaggatgagtttggccaggacgaggcagggcagggacagctaactcctcatgcaccctgcctttccctccttgccaccttctggatggggcttgaggataactggctctgaattcctcacgctaaattctcccttttttctaaaaccttccctcgaaaagctgaaaagggggcatttcaaagtaaagcaggccctgccagaagggtaagtcctgaggtaggagtcccacctgaagggcaatgggaggggggtctctggaggagggggcagcagaagagcagaagaatagcgaggtgtgaatgagagtggggcccaaagcagggatgtgaggcgcgttgggcaggatgggggctgggaccgggtagggggccaggagaggggggtgcagcctgggccctggcggcggcggcttgcccggctccccccgccccccccccgcccaagaggtttcctgttgcaatcaaagccccgtttgtgtcggcctggagctggagcctgtgccggaggaggagagaccggggaggggaggggaaaagaggcagtcgactggggttttttcctggaggaggcctcactgcccttacccgcctgcttgttctccttgcttctcccagtgcctggcttctctgtgtctgcacctttgggcctgggtagctgtcccttgtcttgtctgtgagtctctctttttcagtttcttttaagcaagactttctctgtgccaacctgtcctcagtttctccatgtgtggtgacttagtgtggtgaaatctgggctccttgccccagggacagtggccccatggccagggcagcatcaccaggttcagaggacaaattgggctaggtcatcaggaccacagctatctgctcaggggtgggaggacggcaaggcttcccttctctttcatcacactctgttccctatagaaagcaaatctagaacacactaagattcacaaacatagagatacatagggacacagacacctgaggtttcatgcacatgcatgaacacacacgcacgcacacacacgtacacacacccctctgctttccatgagcacaggcctgtgcttgcctcagcagcacgtgctccctgagcctcccctccaccaccagacagttctgagatgcctgtctcaccccccttcagaccccgagacagccccaggaagtagagcaagacttcacttctcaacaaggatgtccccaaggtgccagggacccagcaataagatccaagagccagccccagggagaagtgccagacctcttcaagggccacctctcttagtctatgtgtgagagagaatgtgtgtgtgtcatccatagaataagggagagggtgatgagatgcacaaactcaatgtgagtatgcctttggcatcagatttaagcctctaaaccctctccactagatgctcccagccaaaaagggacagcaggtcggagaaatgagagaggacactctctcatccttctgctactctcccactctggaaggtttcccagactcctggatctcttcgtctcccctatgtcttcctctctgctaccactaggtgctgcatgccccacccccattaaagccgcatagcaacccacccccaagccttcccctcctccctcctcctgccacttccctgcccaggcctgtccttccaggctagccgcaccctccccagctacctgccctggctctggctcctcccttggatttctcctttcagccccctccttcagcatggccttcgaagatggagcccggcctgaccacttccctaccttaatctcactttgaaccctgaccttgatctcagtgtgtccatggcacaggggcgcaagggggacgtcactggggactgggtactagctctagcattatccccactaccattctctctcctctccctctccactccatctcctttacttgcctctcccagaacctgagaaaatcaagtcccaagaggctgagttgtagggttctctgccagaagtacattcatgtggggagggtggttccttcccacttccccaggtccctaggacagattcatggggtgaaaatgaagtctggggaagcccagctgtagtttccaaaaagggtactttgtgctgtcttgttcacctacatgccactcaaataacccctgttggactacagacatgccaccagcaggcttcaccaaacgccagccacagcgtcagcagcactacaaaatccctcctcactcctcacactgactctttgttgcacacactggaattctgtacatgagcagaggcccagggagatgctgggcacacacaactgcatcaagtctggaggcaccacacactcaccccttctccgatgaacacactctttccagtggagctgccagcccagcctagtcacccctttcacatacagacacacaaccctctgcgtgccccctcctggaagcagggcgccttctcttctacctctgtctctgcgctcgtggagccatgaaggatgtgcgtttatctttttgtctttttctctccaactctgtctctgaaattgctctttcccccgcccttcaatcaccttctcttggccccagttgaagccttctcttaaccagcttggaacccccacctgtaatggcctggccaggaggaatgactaccaactgggaggagaggggtcccagagggaggaggagaggagaggcccaagccttggctgctgtcagcactcaaaggcttaacccaaagagggcaggcctggggaacaagtagggatctgcacagcatgcaggctctatgccagacctgcagggagaggaggagcccagatccacatcgctggaggagaggatgcttctggaacaccccctctgcctctctggattacttatggtacaaaagctacctcctttgcagtcatttccatcctccccagaaccaagaagcacagtctcctgaccccacacatctttggggacctggcacaggatttctttcccctttttgcagcctccatgtaattcaaagcaatttcacctttttttctctctctctcagacagaatcttgctctgtcgcccaggctagagtgcagtggcgcgatcttggctcactgcaaccttcgcttctgggttcaagtgcttctcctccctcagcctcctgagtagctgggattacatgcatgcgccaccacgcccactaatttttgtatttttagtaatgatggggtttctttttttattttttatctttttgagatggagtcttgctctgtcacccaggctggagtgcagtggcacgatctcagctcaccgcaacctctgcctcccaggttcaagcgattctcctgcctcagcctcccaagtagctgggattacaggcacacgccaccatacccggctaatttttgtaattttaaagacggggtttcactatgttggtcaggctggtctcgaactcctgacctcaggtgatctgccctccttggcctcccaaagtgctgggattacaggcgtgagcctttttctttttttttttttagacagattctcactctatcgcccagactggggtgcagtggcaagatcttggctcactgcaacctctgcttcctgtgttcaagcaattctcgtgcctcagcctcccaagtagctgggactacaagtgtgcgccactacgcccagctaatttttgcatttttaacagagggggagtttcaccatgttggccaggctggtctcgaactcctggcctcaagtgacccacccacctcggcctcccaaagtgctgggattacaggcgttagccactgcacccaacccaatttcacctcttgatcacagagccaggtgactggcctcccagactcctctgcttcccagtttggctccctccaactccccactgcaagcaagcagcagattcacgctgcaccagacccacccccagctgcccacacaaaggtattcccctctactagttgactgacccaggaggcagttttagatacccaccccccaagttttaggcctgctacctccctatcctatttgacaggagaactctcatttgcaaacacttccattgagtccacatccaaactccttcctcaccaccactaccaccctccattattcactactactccattaggccaaacccctgtcccctgcctgccttcctaactggggtgccaactcttttaccatccaccctcctgatgccttcttgttaacatttgccttcattccccaagatccctgagactcacacagagaggccatctccttggggaggtcaggctggcccaggccccggaagctagggctcagcatctcgaaaggcggagaccccctgagtgcccctgggaaggcgaaggggaaacctgcccctgggtagccagatccaggccccagggcaccagccgcaaagagtcgctccttattggtggccatggcagctgcggtgtgagagtcccctggggtctgcagtgggcgggcgaggtcttcagccacagcccctgcccatgcccactgccccagcctgggaggctccgtacccgccctgcctggcctgcccactgggcctccaaaagtcctagggagaaagagagagaaaggagagatgagagaatgaccactctgaggttccaagccctgtgaccctctctcagttgcagtcttctccctctgtgctgctacagtttatcctgccctggctcagggcccttgcagtgtggtagagagggcacggcagggggttatgcaggctctgagaaactctccagaggagctccaggaaaggttaaactgaggtcccaaggtgaatgatggtctaaggacttctggtggagagaactcctagattgggaagtgatcatgaatcaccacaactgggctaagcatttgacctaaacctcacatcagtcctgtgaactgggagttatgattctcatttcacatatgaggaaactgaggtgaagtgactggcttaaggtcacatggctgcaagtgggggagcccagattcaaactctttaccatcctggagaaggcaaacataactctgttataacctgggagccctacagctctctggagaggagtacaaggcaaaggttagggggacagactctagagccagactacctggactgtaccccaccacttgctagctgtgggacttcaggcatgtcacttaatctctctgtgcctcagtttcttcatgcgtcacttgggactaataatagggcctacctcatatggttattgtgaggactaaataaattaaccaatgtcaagtgtctggcataatgtagggcacataggaaatgtgatgtaaatgtctcatattagttctctttgtaccttattttcctccatactctgcttcagtaagcacttccctctctgttttcctcaacactccctcttccagtttcctctcccaattcttcctgtctccaatttttcctcaccctgtaagccctcttgtacccactgcttcaaatctaaggatgttgatggagcccccacttgtgccaagtgtatgatgccaaggagctgcttcttggtcagctgactttacttctctgcctccttttttctctctctctctctctttttttgttttgttttgttgagacagctaatgtttatatttttagtagagatggggtttctccaggttggtcaggctggtctcgaactcccaacctcagatgatccgcccaccttggcctctcaaagtgctgggattacaggcgtgagcgacacgcccgggcattctgcctccttttctttcttatccctgggctccctgtttctaggaagttctccctgcaacctctcctcccccaaaagtaggcttccctctaagagtttaaacctgagcccaggggaaggggaggagaaggaggtagagagaggagatgggaatcctagtgctaagtaggtggttcctatcttcatcccctgacaaaggaaaagtttggctttcctaggagccccagaacttctcacctctctaggcagttagtgggctagggaggaaaagtcaccccagcctgggtatctccaccagtcagagccataacagactgctatgaagggcagagaagggccaagagactaaaatgcagagagaccatggggtgggcaggcccagaggtaggggatgggtatatctgcctttctttccatcagtatttgcttctaggatgtatagctctcagtctttatacctctggtttttatttttgtttttgcttgtttttctttctctcctctaccttggccttcaagcccttgagggtaaactgtcatggaggttacaagaacccagaccccaacgccatcacatttcactcagcccttatgaatgaagcatcccctgcccctcaccatggcaccacccatacacccagcaccctcaaactctttagcccagtgtcttcgcaggccctaaaagtctgagctccaagcctccagggtccctctccttttccttctcctattcccctccgaagttctcatccctagttaagccctgatggagccaggagtttgggggcccctgaggcccctgggccacagctcaactggccaggccacattccaggtggattaacccctccaatgacaagggtgagaagctactagaggactcccccatccccatgttccccagacttggcttagactgggaacagggctctctgccttagccctccttgtctttgcttctcacctaccaatgggaaacacaggcaggtagggcagtgggggtccccacagagggatgctcagctcctgatcctcaccaaggaatgatgctgcatgtgagccaatgagagttgtccttggccttcctcttattttgcctcagagaagggacttgggagttgagtgaagagaggaagggggtagagattcctcccatttctgagccttggttctgtcgtggctgggaagagaaggggagggtcttaaacccagggtaggagaatggactaaggaattgaaggcagtgcagagtaaaaggaagtcctaaactgaggccccaggtgccttggttctttgggggactcatggaaagtagagaacattcttcctctactaagatgccatctcaaatggtggggcagcggggatgacagactaggggagaggggctcttacaaagctgcttctcttagagctgaggtggagttgaggggagggcatggatgaagggggctgccggatggaggggggtgtgtttccctgtcgccctgcccgctccagagcctggaacaaagctgctcttgtcggccactctccacccgctgcccccctcccctctgtataaacacgaccacctttttccatgaccccatctccagcctgggcagagaacccaggcatcctctgctctagcctgggcccccagcctgctccccaggaggcagcagtgggccaggcttccttggcattgtgccatccctgggggagtccagacccttgagtctccacctctcatccccaggtgccctccctccaccctactagccccagggaggggcagtgcccaggaggcaggcaggcaatgccagtggaatgtgtgtgggcatcagagggcatggacagggtggggcagaggggggaactggaggtgccagttaggtggctttctgagccaggggtgggggtgtgccggggtgtgggggggcgtgccccatgctgcctactaggctgtaggccacagtgcgtgtgtgtgtgtgtgtgtgtgtgtgtgtgtgtgtgtgtgtgtgtgtatgtctgtctatatgggatacccaagctccaggctccctgcacacactacccccactcccctgtcttctctctacttgcctcaaggatatgagatgctggctatggtccttgaccccaactcagcatctgaccctaagggcagaagcctcagacttgaggattgggattccagctgcccaggaccagagccctaaagcgggacagtcatctcagtttcttgccctgaagacctcctactcaggctcccctgcccccaccaccactaacaaccaagcatcttcttacccgctggccgcctgcagagactggcttctacatactgggtcaggttgagggaactgggccgtagctgctaaagacagagaggcagcgtcagtggaactctgggaccagcactcctgggtccctgtcccggtcttcctgctctttctttgttccatttgggcttccctcaagaatactccagaggtgccccccaccttggctggagggagccaaggctcgcacctgggctgggaacgtgtgggagggaatccagcgcttcaaggaaagttcacagatccctatcctatgcaccagtccttcggaactcctggacgcggagggccaggctcacttgcctctggacgttttccttgccttctgatgtccaagctgtcccattccactggggagggaggaacttggaccagcatggaacatcaaatctacccctcagagcccgggggtaagggggtggtagtctttccccgcgagaggaaaccctgtcttctctcacattcccagcacaaaaatataaggaggaatgccccctggctgaagacttccccaaatgctgtcctctgctatgcaccaaaatgaagggcagatgacccagcccatcctcagcctgttaaaatcttccccattcccttcccacagcaggactggcctgggtcggggcaagaagcccccctcaagcccggcggccagcctggccagcctcgggagggcattcgcccgtgcagctcctccgcgccccctcccccagccgcctcgccggaggacccaggcgacggggcgggcgagcctgcttccccgcctgactcacctggagtgggagggggaagggaggcggcggagccccgaggtcccggcgtcgggcagtctcttggatggagcgtcgcaatgtccggggctcgccgtactggggggctcctgggggggcacggctctaggctgggactgtcccggggcctctcggagcccgcccgcccacgtgaccgccccaaaatatccgacacattttctcccaaaccgcacactgactctgcaggcggggacacggaaaatattttctttctttttctccctccccaccccccccccaacct

SEQ ID NO: 501 - DNA, 21691 bp, Homo sapiens; identical to SEQ ID NO: 500

SEQ ID NO: 502 - DNA, 21691 bp, Homo sapiens; identical to SEQ ID NO: 500

SEQ ID NO: 503 - DNA, 2821 bp, Homo sapiens
actgggaagttatgcggcttgcccaaggccacacagctggtaagtgacaggggcaggactgcgccttagtctgtctgcagcccgactccaagttctttacaccacaccgcctccctcaggtgtctggaccatactggcttctcttgcatggaggtcactgcagtgggagaggaggcaaaccaaggagaccttctcggcttcgggcagcggtgctgttccttaggaagctccaacccttggctctaccggactgcgggcatctttcccgagcactgcacggaagaaaagaaaattggcacttatttcagggtggcccctcaggcatccaagagccagaggagcaggtgtcacgggatggcagcgagcgaggccaggccaggagaagcaaccgcagcctcctatggtcgccccttcccgacccaccccaggcgtcaggagttccgcgcccgggtaagggaaggagggcgggcgggcggggcggggcggggttttggcgccgcgcccccgtcacgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtgaggcggagtctgggcgaggtgcaagtggatgtggcagggctgggcaggggctagggggcgcagtggggtgccagtgacctggaggagtgggcctctgagatgcacacgcatgaccctgaagcaactcgagaggcctgcgcgggtgggagggatgcccgggacagaggatgagacactgagggcaaaaagaggctccgcagcgaggacgggaggtaatagaaggaagtgtacgggagctgctgtgggaaagggcagtagaatttgcgggagcgggattattgaaagggactccctcttcacaggcaaggatgggttgagtgcccagtcctctcccctgtcttcttacccctccctgccccacagtgtcctaggagacagctttggcgtggccactcctcccacccacccaactggtccctccggtctgagatcttggggagtggagttggcagcggggttgggtggagctgccatctgcttaagacagccccttgaccgtgctgcccgaaggatggatatggctctgactcccacctctcttcccaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatca

SEQ ID NO: 504 - DNA, 2315 bp, Homo sapiens
gtcacgtgatgaagccatcatggcggcggccagaggcctgcccggctcccggaagcaggctgtgaggggcgggagcgctgctggaacccgagccggagccggagccacagcggggagggtggcctggcggcctggagccggacgtgtccggggcgtccccgcagaccggggcagcaggtgaggcggagtctgggcgaggtgcaagtggatgtggcagggctgggcaggggctagggggcgcagtggggtgccagtgacctggaggagtgggcctctgagatgcacacgcatgaccctgaagcaactcgagaggcctgcgcgggtgggagggatgcccgggacagaggatgagacactgagggcaaaaagaggctccgcagcgaggacgggaggtaatagaaggaagtgtacgggagctgctgtgggaaagggcagtagaatttgcgggagcgggattattgaaagggactccctcttcacaggcaaggatgggttgagtgcccagtcctctcccctgtcttcttacccctccctgccccacagtgtcctaggagacagctttggcgtggccactcctcccacccacccaactggtccctccggtctgagatcttggggagtggagttggcagcggggttgggtggagctgccatctgcttaagacagccccttgaccgtgctgcccgaaggatggatatggctctgactcccacctctcttcccaggtcgtccgggggcccaccatgctggtgactgcctaccttgcttttgtaggcctcctggcctcctgcctggggctggaactgtcaagatgccgggctaaaccccctggaagggcctgcagcaatccctccttccttcggtttcaactggacttctatcaggtctacttcctggccctggcagctgattggcttcaggccccctacctctataaactctaccagcattactacttcctggaaggtcaaattgccatcctctatgtctgtggccttgcctctacagtcctctttggcctagtggcctcctcccttgtggattggctgggtcgcaagaattcttgtgtcctcttctccctgacttactcactatgctgcttaaccaaactctctcaagactactttgtgctgctagtggggcgagcacttggtgggctgtccacagccctgctcttctcagccttcgaggcctggtatatccatgagcacgtggaacggcatgacttccctgctgagtggatcccagctacctttgctcgagctgccttctggaaccatgtgctggctgtagtggcaggtgtggcagctgaggctgtagccagctggatagggctggggcctgtagcgccctttgtggctgccatccctctcctggctctggcaggggccttggcccttcgaaactggggggagaactatgaccggcagcgtgccttctcaaggacctgtgctggaggcctgcgctgcctcctgtcggaccgccgcgtgctgctgttgggcaccatacaagctctatttgagagtgtcatcttcatctttgtcttcctctggacacctgtgctggacccacacggggcccctctgggcattatcttctccagcttcatggcagccagcctgcttggctcttccctgtaccgtatcgccacctccaagaggtaccaccttcagcccatgcacctgctgtcccttgctgtgctcatcgtcgtcttctctctcttcatgttgactttctctaccagcccaggccaggagagtccggtggagtccttcatagcctttctacttattgagttggcttgtggattatactttcccagcatgagcttcctacggagaaaggtgatccctgagacagagcaggctggtgtactcaactggttccgggtacctctgcactcactggcttgcctagggctccttgtcctccatgacagtgatcgaaaaacaggcactcggaatatgttcagcatttgctctgctgtcatggtgatggctctgctggcagtggtgggactcttcaccgtggtaaggcatgatgctgagctgcgggtaccttcacctactgaggagccctatgcccctgagctgtaaccccactccaggacaagatagctgggacagactcttgaattccagctatccgggattgtacagatctctctgtgactgactttgtgactgtcctgtggtttctcctgccattgctttgtgtttgggaggacatgatgggggtgatggactggaaagaaggtgccaaaagttccctctgtgttactcccatttagaaaataaacacttttaaatgatca

SEQ ID NO: 505 - DNA, 25345 bp, Homo sapiens
ggttacattttggatcctcgcggagtactggtcaggcggttaagtcctgtacctaggaaagagggcgagctctggggcggtaaggccggaagggactcgtgagcgtgggtacgtgctgaagtgaaggggatccccagcgctgacgcgaggagaggcgtgggtggctcctggagggagtgtcgggaggccttgggactgccccgggccgctgaagggctgggccgaggcctctggggtagcgcggcgagtggtgtggtagtgcggtcggggatctgcccggaggaaggaagagcggaatcgtccttttataacgggagcacggcgtcctggcgtgggttttctccccgatgaaatttctgatgtgattctttgcctccttccacgaccttcagccctcttcccttcctccagttagcttcattaacaatcttctctaattggtctccttttccctagctctccggtgtcatgaggagcttcaaaagagtcaactttgggactctgctaagcagccagaaggaggctgaagagttgctgcccgccttgaaggtgggggtgctgcctggctcgggatacacctggctttccaaactgagctgttttgtgtttgccttttgaagagatggataagtaggcgaccctctctgagtaaccctatttctagttactttctctacctctttcctgcctttgctagccccattcatatctttctctactcctaggagttcctgtccaaccctccagctggttttcccagcagccgatctgatgctgagaggagacaagcttgtgatgccatcctgagggcttgcaaccagcagctgactgctaagctagcttgccctaggcatctggggagcctgctggagctggcagagctggcctgtgatggctacttagtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgcagctcggctgaaggccttgagcttcctagtactcttggaggatgaaagtaccccttgtgaggttcctcactttgcttctccaacagcctgtcgagcggtagctgcccatcagctatttgatgccagtggccatggtctaaatgaagcagatgctgatttcctagatgacctgctctccaggcacgtgatcagagccttggtgggtgagagagggagctcttctgggcttctttctccccagagggccctctgcctcttggagctcaccttggaacactgccgtcgcttttgctggagccgccaccatgacaaagccatcagcgcagtggagaaggctcacagttacctaaggaacaccaatctagcccctagccttcagctatgtcagctgggggttaagctgctgcaggttggggaggaaggacctcaggcagtggccaagcttctgatcaaggcatcagctgtcctgagcaagagtatggaggcaccatcacccccacttcgggcattgtatgagagctgccagttcttcctttcaggcctggaacgaggcaccaagaggcgctatagacttgatgccattctgagcctctttgcttttcttggagggtactgctctcttctgcagcagctgcgggatgatggtgtgagttaaggacctggaggtagggtggggacgtggtctgtggactcactaccagcctagggtatttggcaagatctggaggtcctggctccctccttgttaagctgctctctggacagtgcctagcgagccagcaaacagcctagtctatcctgagagggcagtggcccttctggatgtccttcctcgtgctccctgggctctgtcagctctccaggactccgggtcagtcttcagcttggagccctctttatctctactcctcataccaaccttccgcttccttcctcaggtgtatgggggctcctccaagcaacagcagtcttttcttcagatgtactttcagggacttcacctctacactgtggtggtttatgactttgcccaaggctgtcaggtactgtctgggaatcaaggtacctggactaggctcatagggtttggggttgctccactgccctcaaacagctttggggttgctccactgccctcaaacagctttggggttgcttggctttgggtgtggagtgcggtggaggtcatcttggacccagcatgactcctcactctcaaacccttcttgtcccttcagatagttgatttggctgacctgacccaactagtggacagttgtaaatctaccgttgtctggatgctggaggccttagagggcctgtcgggccaagagctgacggaccacatggggatgaccggttagtgccctgggtcccaggcacagagtttgtgggagggtcatcacccattaggcaggtgaatagtacttgctgcgtggttctgaccactgtgagggttccttatggttcaaggaggcagtgagagaaatgtttataagtaccagctactctgtgtttaacaccagtagagaagtgatgaagctaacttacaacagcagacactatttcctcgactggaatctaacttggcattaacagttgcacctaatatgcaaccttatgacctttcaacatatttttttatttctatattttttaatgtttttttttccttttcttcacttatcagaatccagaaatcattacaaatgacctttctgtatatttaagtgtttttttttttttttttttgagacaaggtcttgctctgtcacctaggctggagtgcactggcacaatcacggctcaacacagtctcaacctcccaggctcaagcgatcctcccacctcagccccgcaacgagctcaccttgcaggttcaagcgactctcctgcctcagcctcccaagtagctgggactgcaggcgcgcaccactatgcctggctaatttttgtattttttgtagagatgatgtctggccatattgtccaggctggtcttgaactcctggactcgagtgatctgcccaccttggcttccctgaaaccctgtctctactaaaaatagaaaactagccaggcaaggtggtgcatgcctgtaatcccagctacttggtaggctgaggcaggagagtcgcttgaacctgcaaggtggaggttgcagtgagccaagattgcaccactgcactccagcctgggcaagagggcactccagcctgggcaacaagagcgaaactccatctcaaaaaaaaaggagaattcttcccacagagtactgaagactgactttattttctcccagtcatctatgttgatggccaagaagctgcataaataagttattatcatttattcagcaaatatttgttgccgggcgcagtggctcacgcctgtaatcccagcactttgggaggccgaggcgggcggataacgaggtcaggagatcgagaccatcctggctaacagtgaaaccccgtctctactaaaaatacaaaaaattagccgggcgtggtggcaggcgcctgtactcccagctactcaggaggctgaggcaggagaatggtgtgaacccgggaggtggagcttgcagtgagccaagatcgtgccactgctctccagtctgagcgacagagcaagactctgtctcaaaaaaaaaaaaaaaaaatttgttgagtactcactgtgtgcaacgcactatttggagtacttggatgtgtcggtaagcaaaacaaagtttccttccctcatggagccacgttctagtttggggggaaaagataaacagattcagtaaataagtgaattatcaacatattagaacgtgataagaaatgtgggggaaaggaaaagtagagcaggataagaaagggaattgggagtctaaggtgcatgacggggggcaagttaccaccttaaatcaggtggtcagggtagacctcattgagagggtgacatgagcaaaggcttggaggatgtgagggagtcagccatgtgggttcctggaaaagaacatccctggcagaagaaacagccagtgctgaggcaggagggggtctcgtttgtaaaatgagtgcagatgggctgagtggtgtgaagggcatgggcctatttggggcaggaaggggagagccgccccttccccattcctagcagtaggggttcctgtctgatctggaagctgctgaactgaccacagatccagctgatctctgctgcctctccaggaggagagggtggtgggagcctttcctatggtcaattgtgccttttctcccctgcagcttcttacaccagtaatttggcctacagcttctatagtcacaagctctatgccgaggcctgtgccatctctgagccgctctgtcagcacctgggtttggtgaagccaggcacttatcccgaggtgcctcctgagaaggtacaagggaatgagagatgcaggaaaggagcttatgtggttggggagcggggggagcggggaagggcctcaccagcaccctgccttggagtgggaggttaatagcagcatgttgacaccagtatctggagcagtgtttcccaaacctcactgtactgttacttactgttgactcatttttttttttttttttttttgagacgagtctcgctctgtcgcccaggctggagtgcagtggcacaatcttggctcactgcaacctttgcctcagcaaaggttcaagcaattctcctgcctcagcctcccaagtagctgggattacaggtgcccaccaccacgcccagctaatttttgtattttttgtagagacggggtttcaccattttggttggccaggctggtctcaaactccagacctcaggtgatccgcctgcctcagcctcccaaagtgctgggattacaggtgtgagccaccgcagccggcctgactcactttttatatttagcctggtcctaagctactggtttccagccaagctgcacattagaatcacctgagtgacctttaagaaaattctaatgtctgccccgagttaattgcatcagaatctctagtgtttgccgggcgtgatggctcacgcctataattccagcactttgggaggctgaggcaggtggatcacctgaggtctggagtttgagaccagcctgtccaacatggtgaaaccccgtctctactgaaaatacaaacattagccaggcgtggtggcatgtgcctgtaatcccagctactttggaggctgaggcaggagaattgcctgaacccaggaggtggagtttgcagtgagccgagattgtgctactgtactccagcctgggctacagagcaagactccatctcacatctgaatattttcaaagatcccccaggtggtcctttgagcaaggagagtgagaacctgggttcttggttttttggttttttttttttttttttttttttttttttggagactgagtcttgctcttgctttgtcacccaggctggagtgcagtggcacgatctcggctcactgcaacctccacctcctgggttcaagcaattctctgcctcagcctcctgagtagctgggattataggcatgcgccaccatgcctggctaatttttgtatttttagtagagacgggggtttcatcatcttggccgggctggtcttgaactcctgacctcatgatccacccgcctcggcctcccaaagtgctgggattaccggcgcaagccaccgcgctgggcaagaaccagtgttcttaagcaagaatacctgtgaactgatgcattggcgggattggcaagcaagatgagtcatagaggggcttgggtttcatcttaactgagatgataagcctctaaaggatttaagtggaggcatgacagcagacaggcattttggatttccctgacttcgctgtgatgaatggagtgcaggagaaaagaccgggtaatcaggctgctatagtattctaggcagggaagggtgggctgaactgaagcagctgcacgagggatggaatgcagtggatcggtgcgagaagccaaggattaacctggtaggtgactggcgggagggagagcgagagaagggaacatcagagatggccccacatttcttactcaggagaaggcagtgccatttgctgagaaggattacaggagaagcaggttttcaagggtgtggatgatgaacataggggtggagtggattgcagcctctgagttgaaggcactcagagtatttcattcttaggtgtctcctgccttgggtgggtgtggctcaggaggcccacctgccaaccccgccccctcatgtggtgtatgtacctattgcatgcatatccccttccaccatacacactcactggttcctctccagtttggtctgttccctttctctggtcagttgcacaggtgcttccggctacaagtagagagtttgaagaaactgggtaaacaggcccagggctgcaagatggtgattttgtggctggcagccctgcaaccctgtagccctgaacacatggctgagccagtcactttctgggttcgggtcaagatggatgcggccagggctggagacaaggagctacagctaaagtgagttgagggccagacgcagtggctcatgcttgtaatcccagcactttgggaagccgaggcgggtggatcacttgaggtcaggagtttgagaccatggccaacatggtgaaaccccgtctctactacaaatacaaaaattagctgggcattggccgtgcacagtggctcacacatgtaatcccagcacacatgtaatcccagcactttgggaggccgaggcgggcagatcatgaggtcaggagatcgagaccatcctggctaatacggtgaaaccccatctctactaaaaatacaaaaattagctgggcgtggtggcgggtgcctgtagtcccagctactcgggaggctgaggcaggagaatggcgtgaacccgggaggcggaggttgcagtgagccgagatcgtgccactgcactccagcctgggtgacagagggagactccatctcaaaaaaaaagtgagttggggagggggtcaaccatgtttctcccatggatagggtggcttttggtactcatggtcatgtcctttcatctttatgtctgaaaaatactaattccttcattcattagttattcattgagtgcccactgtatgctagccactgtgctacttggggggtatagtggtgacagtggtcttgctttcatggagcttatattctacttggggagatatttttaaaaagtacattttgcattttgtgtctgttcctttttttttttttttttttaatagagacaaggtctcactatgttgcctaggctggtcttgaactcctgagctcaagtgatccttccaccttggcctcccaaagtgctaggattacaggcatgagccagtgcgcccagccttcacgtatgctctatgaagacaattaaactgatttgctaaaagagggagcaacttgaggtgggttatttaggaaaaccctttttgaagaagtgatagatgagacctgaggatgtgaaggaatctactttgtaaagatctcagggagcctgggcaacaaagcgagaccttgactctacttaaaaaatattagccgaatgtggtggcatgaacctatagtctatttacacttggttaggaggctgaagtgggaggatcacatgagcctggaagatcaaggctgtagtgaaccgtgatcacgctattgcactccagcctgggcaacagagtgagactgtctaaaaaaaaacaaacaaaaaactcagggaagagaattccttgcagagagagtagtaaatacaaaggttgcaaagtgggaacaaacttgggaccatgcttgagaaagccggcatgctgggggtagtagaatagcggtataggatggggaaccatatggaatgaaggtggtcaaagtgggaagcggccagatcacacagggccttataggccatggtcagggctttggaaatgattcctagtgggagcccactgccgtttgttaaacagaggagcaatgcaatctgatttaaatttttaaagccatgactggaaacctactgagcaagccaaggctggggctcctcagcatgggagcaggtagcagaggctttatgcctcctgggttccaccctggtgctgagcatgccctctctcaggactctgcgagacagcctcagtggctgggacccggagaccctggccctcctgctgagggaggagctgcaggcctacaaggcggtgcgggccgacactggacaggaacgcttcaacatcatctgtgacctcctggagctgagccccgaggagacaccagccggggcctgggcacgagccacccacctggtagaactggctcaggtgctctgctaccacgactttacgcagcagaccaactggtaaggagtagtagctgcagaggccactcttgctccttgccctaggtcctctcaccctcttgagaaccagtttccctctccacagccctgagctctcccttcatcttgtggccatgggagcacatgcaaagggcgaggccagctgttctgcagctagcccttcccagggcgctatggcagatactcatagtaggcccagcttaagcacatcttctccctgcagctctgctctggatgctatccgggaagccctgcagcttctggactctgtgaggcctgaggcccaggccagagatcagcttctggacgataaagcacaggccttgctgtggctttacatctgtactctggaagccaaaatgcaggaagtgagtgtggctgctgtggggctcaccagaactgggtgtaggaattactgtccctgggcccccaacaagttggtatcagcccttttttttgttcgttatttttagagatggggtctctctgttgcccaggctggtcttgaactcctgggctccaacaatcctcccacctcagcctgccgagtagccaggacgataggcccacaccactgtgccctgttttataccccgatcttcccatccagggtatcgagcgggatcggagagcccaggcccctggtaacttggaggaatttgaagtcaatgacctgaactatgaagataaactccaggaagatcgtttcctatacagtaacattgccttcaacctggctgcagatgctggtgaggggtaaatggagtgtggcatgggcatctccatggcttcctaagagtggaacagggacccctggtgagggaaaccctgaccttgtagggtaggaggttgtggaagcagtgggaggttggcgtaaagggcagaggatgttatggaggaagggaagttctctccagatggcccatgctgagacagcagtcattttcttctggcttaacagctcagtccaaatgcctggaccaagccctggccctgtggaaggagctgcttacaaaggggcaggccccagctgtacggtgtctccagcagacagcagcctcactgcagatcctagcagccctctaccagctggtggcaaaggtaatggggtggggcattgagggggacccatataaacaaggactagaccagaaacagctccctcgccttctttggcctgtgatcctcctgagaagccatgaaagccagtgatggaagcgcagggctgtatcaccagtcttattttaaatccaagctccctcattcattagtgtatggccttgggcaagttgcttaacctaagcccaagtttccttatctctaaaataggggccatgctactgcctcgtggcgttattattcagtgcagcagtgcatggaagaggtattgtgtaaatggtatgctcaaatgttagctttagtctgggcaacacggcgaaaccccgtctctacaagaaataaaaaaaatatagcccggtgcggtggcatgtgcctgtaatcccagctactcaggtggctgaggcaggagaatcccttgagccaggaggtagaggttgcagtgagccaagatcgcgccactgcactccatcctgggggacagagcaagatgctgtttcacgctatttcattaaaaaaaaaaaagttagctttaattattagatgatttgttacctatcagaaaaatacatagatgcctttagacacaattttacattcttacattcttatgtgtgccttctttttttttttcaagatggagtctcactctgtcgcccaggctggagtgcagtggcgcaatctgggctcactgcaacttccgccatctgggttcaagtgattctcctgcctcagcctcctgagtagctgggactacaggcacgcaaccacgcctggctacttttttgtatttttagtatagacagggtttcaccatattggccaggccggtctcgatctcctcaggtgatccacccgcctcagcctcccaaagtgctgggattacaggcgtgagccaccgcacccagctttccgccccgcccccccgccgagatagagtcttgctctgttacccaggctggagtgcagtggcgtgatctcagctcactgcaacctccacctcctgggttcaagcgattctcctggctcactcagcctcctgagtagctgggactacaggcgcataccaccacaccctgctaattttgtattattggtagagatggggtttcactatgttggccaggctgatctcgaactcctgatctcaggtgacccgtctgcctcagcctttcaaagtgctggggttacaggcatgagccactgtgcctggcctataaggccatgtacattcttatttcagggagtttcacaaaattcctgaagctctaccctagactccacattaggaaacaaacaaacaaacaaaaagcctttatacatgctgttaactatgagctattaaaccatatttctagcaggggaagctacctcagccctagatttgagacttggttctgccacatacctgttatatgaacttagacaagcaacttaacccatgtgagtcttagcttcctgtactgtaaaattgggattagacttgttatgaaggttaaatgcactgatgcatgtaagcctgggcacagtgcctggcacatagtaagaactcagaaaatcctggctattgatgatgaatggcatctaggctttaaaacagtaggggtggggtgatgattgcttcatctgggtaactacattccacccaggccctgaggtcaaactacagtccaaggtcccaaagggctggggagcagagggtagaaatagaggcttgagcaggggtggagtaaacttggctgcttctgctgaccagcccatgcaggctctggaggtcctcctgctgctacggattgtctctgagagactgaaggaccactcgaaggcagctggctcctcctgccacatcacccagctcctcctgaccctcggctgtcccagctatgcccaggtgagtgcccaaccagcctagtctggggactgcagggggcccgtagctttagaggcccacctctgagaagacaggatatcaaaggggcagcttctcggccttttaccaccacaactggctggagaattgtggagtgtggagcagttggaggcagctgtaagaaggggagtcatctttgtccttcctgcaaaaccagttgttcattaagtttacagactgctgcaggaacctaccgccagtcttgtatttcctaactggttctgttgccctagttgatgcttcattgctcatgtaaagctatcacagtgtctcctggttggtctccttgcctccagtttctcccttttctacttcgtcttcttaacgaccactggtaggcacaggtgtgatgtaatctctttcctgcttaaccctgttcccttttgccccaataatacttgccagcgcttacggctgcagtgtttacccctggataactttgccacaaaatatctcactcttactatttttgcatcactctagtatattgactttggaaacagaagacatcattctgtttatagcattctgtttttagtggtgtcatttccatttccatttccatttccacttccacgtcaccctcccgagtaactgggactacaggtacatgccaccacacctggctaatttttaaatgttttgtagagacagagtctcactatgttgcccaggctggtcttgaactcctgggctcaagtgatctcccacctcagcctcccaaagtactgataatacaggcatgagccaccgtgcccagctactgcttactctgtatatagctttaatctaaaagtggttaaccaggctgagcgcagtggctcacacgtgtaatcccagcattttgggaggctgaggtgggcagatcacctgaggtcaggagttggagaccagcctgaccaacatggagaaaccccgtctctactaaaaatacaaaattagccaggtatggtggcgcatgcccgtaatcccagctacctgggaggctgagacaggagagcacttgatcccgggaggcggaggttgcggtgagctgagatcacaccattgcactccagcctgggcaacaagagcgaaactccgtcctaaaaaaaaaaaagtggttaaccaagtgttaaatggacattttagagagtgaatcaataactcctatgcagattataatatctgaaataatgtaatatttattggacatgttgaacattttgcttgtaaatactttactccactttttttttttttttttttttgagacggagtctcactctgttgcccaggctggagtgcagtggcgcgatctccattcactgcaacctctgcctctcgggttcaagtgattctcatgcctcagcctcccgagtagctgggattacaggcgcgtgccaccacacctggctaatttttgtatttttagtagagatgggggtgtcaccatgttggccaggctggtcttgaactcctgacctcaggtgatccgcccaccttggcctcccaaagtgctgggattacaggtgtgagccacatggccacccttatttactccagttttgtttgaagagcctggctgcctttcctcatgtgccctctgattgcttccttagttacacctggaagaggcagcatcgagcctgaagcatctcgatcagactactgacacatacctgctcctttccctgacctgtgatctgcttcgaagtcaactctactggactcaccagaaggtatttctcactttcttaaactccgaaggccctgggtattagaaagaatttaggattttcttgatatttgcctggcttttgagatttccctggagctaggcagtatgttcctgaccctgagaggcaggcatatttcctagccttgccctcgccagcgatttgctcaccagtcctcctctggtagagatacagtccttttccttcttcaggggcaagggggaaagtctgtcctgtgacgaaaagctgggacaatggtgatcctgggaaggcatgggagctctggactagaaatccaggggatggcaaagacttgagttttctcccaaactagttgtgtgacttgggcacgtcttctaccttctcatgctctagtttcttctctacgtttttatcattcctaaattggcggacaagtcactggtgagggcaaagctaggaactgttactgcttctcagggtcaggaacattctgcctaggtccagggagatctcgaaagccaggcaaatattcagaaaattctaaaatctttctaatacccagggccttcagggatggggccacgtaatctccagggcctctcaagctctggagtgcctgactgccttactgcctcctctggctccttctctccttcaggtgaccaagggtgtctctctgctgctgtctgtgcttcgggatcctgccctccagaagtcctccaaggcttggtacttgctgcgtgtccaggtcctgcagctggtggcagcttaccttagcctcccgtcaaacaacctctcacactccctgtgggagcagctctgtgcccaaggtgaaagaatagggtggatggccccccttggatgacatgtatggtctgtctgctgtcagctcttctcaaacctcatcccctctgctggctaactatgtggcccagcctacctagaacctgcacagagtaggcctgggatagcagatgggtttcagtttgcctgctgactctaaacaattggtgactgcctggaatactaggctgaaaggatttttttttcttttcttttttttctaagacggagtttcgctgttgtcacccaggctggagtgcaatggtgcaatctcagctcactgcaacctctgcctcctgggttcaaacgattctcctgcctcaacctcctgagtagctgggattactggcatgcgccactacgcccgactaatttttgtattattagtagaggtggggtttcaccatgttggccaggctggtctcaaactcctgacctcgggtgatccgtctgcctcagcctcccaaaatgctgggattacaggcttgggccactgcgcccagccagctgaaaggattctgagaccccaggggatctcagagggaaggagttatgagattgattagctctgcctgccttaatgcagaaggaagcatgggaagcaggctttgctgccttagtagctaaaagtggtgaagttctggctgcatcttctccctttttcaccccacccaccacaggctggcagacacctgagatagctctcatagactcccataagctcctccgaagcatcatcctcctgctgatgggcagtgacattctctcaactcagaaagcagctgtggagacatcgtttttggactatggtgagtctggggaggacagcagggccctcttggaatggacaggctatgtgagagggctgcggttttttctccagaggatccacactgtggctgagtgatggtggtcttgtctcttttgctacaggtgaaaatctggtacaaaaatggcaggttctttcagaggtgctgagctgctcagagaagctggtctgccacctgggccgcctgggtagtgtgagtgaagccaaggccttttgcttggaggccctaaaacttacaacaaagctgcagataccacgccagtaagtacagggccagaggatatggcaatgatggcaccaaagtgccatgcacccttgaacatggattccaaactgttccacagattacatgctatgtttagatacattcgtggaaaaaggcattccacagctaaataagtgggaaatgctgagttaatcaaggttagatgtttttatttcctgtaggactctcgtgtccttcagtatgcggatgtgccttgcaaatctccaaaagggagatctagtgtacagtgtttccctaagaatgttttcccacaggattcttttattgaggaatgcagtttgggaaatcctgtcccaaggcacaaggagagttgggattagagagaagtgtagagggttttccccagggagcctttaagtcagcttaagggagtgaatgccttttggaggcagggaaggactcaggtagcttggcctgggaaagaggcaaagagaaagactctccaggaaaacaaaggattcctctgattggttctcctctcctctctcaacaaggtgtgccctgttcctggtgctgaagggcgagctggagctggcccgcaatgacattgatctctgtcagtcggacctgcagcaggttctgttcttgcttgagtcttgcacaggtgagcagccatgtccccatgaccataggcggtgctgaaatgacacacactacagcacatctttctatgtaaaggtttcgttgcctttttttatttttgagacagagtctcactttattacccaggctggagtgcagtggcgtgatcttggctcactgcaacccctgcctcctgcctcctaggttcaggtgattctcctgcttcagcctcccaagtagctgggactacaggcatgcgccaccacacccggataattttttttatttgtagtagagatgaggtttcactatgttggccaggctggtctcgaactcctgacctcaggtgatccacccgcctcggcctcctaaagtgctgggattacaggcatgagccaccgctcccggcctttgttccctttttaatcagatactgacttctggtcccagggcaacattcccttgactttagtccaaccattggtctccctctttcagagagcctgtcccagacttaccctagttctagttttcagtgcttcctaatacattttggctatttaaatttgatttagataatatttagggccgggctcggtggctcatgcctgtaatcctagcactttgggaggctgaggcaggcggatcatggggtcaggagttcaagaccagcctggccaacaaagtgaaaccccatctctactaataatacaaaaattagccaggcatggtggcgggcacctgtaatcccagctactcagaaggctgaggcaggagaatagcttgaacctgggaggcggaggttgcagtgaggaagattgcaccattgcactccagcccgggtgacagtgcgagactctgactcaaaaaaaaaaaaaaaaagaagaaagaaagaaagaaagataatatttagaattcagtcctcagtcacactagccacacttcatgtgctcaatagccacatggctagtggctaccgtattgagtagcacaaacatatcctcaggagggctgaagctaataataaaacattgcattgatggcacattttgtctccccaatcacatatacttctagtacttcatttgccccacactagacctcataaagctgagtgggagcatagattattttcatttgttaaatgagaaagttgagaagtctatgtttggggccagcatcacagggtaggaggcaggattcaggtgtgggcctgctggggccagcctgcttttctcagccatgtggcccctgagctgcaggtgtgggggctttgtggcctgcatttgatccattgttggttggaaagaaaacaaaaattttacctccaaggcgggcggatcacaaggtcaggagatcgagaccattctggctaacacggtgaaaccccgtctccactaaaaaatacaaaaaattagccgggcgtggtggtgggcgcctgtagtcccagctactcgggaggctgaggcaggagaatggcatgaacccgggaggcggagcttgcagtgagctgagattgtgccactgcactccagcctgggcgacagagagagactccatctcaaaaaaaaaagaaaaaaagaaaaagattttacctaaaaaataataagccatactaatatttgatatgttatacagtaatacatatatatacacacatatatatacacgtacgtatataaaacacatatattagagaattgggccccaaggtcgctcaggaagtgcttgatgccatttctccccgttttgtaattcttgttctgccttctccccagagtttggtggggtgactcagcacctggactctgtgaagaaggtccacctgcagaaggggaagcagcaggcccaggtcccctgtcctccacagctcccagaggaggagctcttcctaagaggccctgctctagagctggtggccactgtggccaaggagcctggccccatagcaccttctacaaactcctccccagtcttgaaaaccaagccccagcccatacccaacttcctgtcccattcacccacctgtgactgctcgctctgcgccagccctgtcctcacagcagtctgtctgcgctgggtattggtcacggcaggggtgaggctggccatgggccaccaagcccagggtctggatctgctgcaggtcgtgctgaagggctgtcctgaagccgctgagcgcctcacccaagctctccaagcttccctgaatcataaaacacccccctccttggttccaagcctcttggatgagatcttggctcaagcatacacactgttggcactggagggcctgaaccagccatcaaacgagagcctgcagaaggttctacagtcagggctgaagtttgtagcagcacggataccccacctagagccctggcgagccagcctgctcttgatttgggccctcacaaaactaggtggcctcagctgctgtactacccaactttttgcaagctcctggggctggcagccaccattaataaaaagtgtccctggctcagagccctctaagactcagggccaaaaacgttctggacgagggcgccaaaagttagcctctgctcccctgcgcctcaataatacctctcagaaaggtctggaaggtagaggactgccctgcacacctaaacccccagaccggatcaggcaagctggccctcatgtccccttcacggtgtttgaggaagtctgccctacagagagcaagcctgaagtaccccaggcccccagggtacaacagagagtccagacgcgcctcaaggtgaggtgggactgttgctaggtggtggtgatggtgttggatggggttagtcctggaggagagtgttttatagagcaggtgtccctgtggaatagctccccagggcctagtggaactttaatctcctgctatctgcagtaccccaatatcttgcttttttgttttttgttgtttttttgagaaggagtctcgctctgtcgcccaggctggagtgcagtggcgcaatctcagctcactgcaagctccgcctcttgggttcacgccattctcctgcctcagcttcccgagtagctgggactacaagcgcctgccaccatgcccagctaattttttgtattttcagtagagacggggtttcactgtgttaaccaggatggtcttgatctcctgacttcgtgatccacccgcctcggcctcccaaagtgctggggattaccggcgtgagccaccatgctcagcctctttttttttttgagacggactctcactctgtcgcccaggctggagtacaatggtgcgatctcggcttactgcaacctccacctcccgggttcaagcaattttgcctcagcctcccgagtagctgggattacaggcgggtgccaccacacccagcttatttatgtatttttagtaaagacggggttttaccatgatggccaggctggtctcaaactcctgacctcaggtgatccgcctgcctcagcctcccaaagtgctgggattacagacgtgagccactgtgccaggccaacatctttcacagcaagacctatttccaagtctccctttgtttcagacagagacattttccttaactctaatgtttcttttaccttttcatcccaccttctgttccctcattttctccctccttccacacccaagagtcgctgcccctgatctagagtgttggctgtcatgtgagaagttagttctgaaatcttccagggtcctgtgtgatggtgcctgatggtgcctccactacgccacctgctgtcacaaggtgtcttgtcactgaagacctcttagcccttcaccctttcactctgatctcaggtgaacttcagtgatgacagtgacttggaagaccctgtctcagctgaggcctggctggcagaggagcctaagagacggggcactgcttcccggggccgggggcgagcaaggaagggcctgagcctaaagacggatgccgtggttgccccaggtagtgcccctgggaaccctggcctgaatggcaggagccggagggccaagaaggtggcatcaagacattgtgaggagcggcgtccccagagggccagtgaccaggccaggcctggccctgagatcatgaggaccatccctgaggaagaactgactgacaactggagaaaaatgagctttgagatcctcaggggctctgacggggaagactcagcctcaggtaggacagcaagggtgaggtggaaggtgcatgttttgggggtttgttctggggcaaagcacaagcagtaagtgctgccaaggaagtacaggaagaatgttcttttgctgactctaagggagtggattacagaaggaagaacaaagagaatggcagggggagggagcactgtgaaaaaggcctgctctctccccaggtgggaagactccagctccgggccctgaggcagcttctggagaatgggagctgctgaggctggattccagcaagaagaagctgcccagcccatgcccagacaaggagagtgacaaggaccttggtcctcggctccggctcccctcagcccccgtagccactggtgaatatgcgacccctgatgttggtcacttggagagggctgagcctctagggcttttgacccctctgtctttccaggctgggttcggatctggatccagtagcctctgaacctgtgtttgaaccccagcactctgtctatgagctgtgtgcaggtcacttaacctctccaagcttctattccttctgtaaaaatggggtttagggagcatggtggaataagttgatgcctgttagttgcatggcaccccacttggcacattgcccttcataaatggtagttgctgtttgccatgtgggagatgagatagggactgttccttcttggaaagttcctatcaactatgaaataaggaattcagctgtaccaagtgtcctgacgttcttctaggtctttctaccctggactccatctgtgactccctgagtgttgctttccggggcattagtcactgtcctcctagtgggctctatgcccacctctgccgcttcctggccttgtgcctgggccaccgggatccttatgccactgctttccttgtcaccgagtctgtctccatcacctgtcgccaccagctgctcacccacctccacagacagctcaggtgggtgctgaccatccccaagactcctgctggggcagactagagagaaggtccagactttgaaggaatgggacctcacccctccccgtgttgcttgcagcaaggcccagaagcaccgaggatcacttgaaatagcagaccagctgcaggggctgagccttcaggagatgcctggagatgtccccctggcccgcatccagcgcctcttttccttcagggctttggaatctggccacttcccccagcctgaaaaggagagtttccaggagcgcctggctctgatccccagtggtatgcgggcagccttctggccggctcctctgtcctcttctgcatcttcttacttgggagctgggtgaaggagttttaggcattggttagtttacatagatttatgacccttatgtcataccttttcacctgttagcatcttacatcaggaaggtttgttgttttttttaaacctcaactttgaattaccagcaaattcagtgtctttcctcagaggtgagttcagatgactggggtcttctgtgctaacatgaaacatattcacatgatttgagtgcctcactttgttagttgctgtgagggacacaaagtacaagtcatggtctctgtgcacagggagctattagagcaagggagagcaccttgacctctagtgaccagggaaggcttcttgatgctggcttgagtgatggataggaattgagtgcccaagacagggaagggaattcctttaacagctgaatgagtctggctgtatcctgtgtgtcaggggtgactgtgtgtgtgttggccctggccaccctccagcccggaaccgtgggcaacaccctcctgctgacccggctggaaaaggacagtcccccagtcagtgtgcagattcccactggccagaacaaggtaggattcctgggccatggagcaaagttgggctggattgggcttcgggtcaagctgctcacattctgtgttgagggagggagagatggtgatcacgtggacaagcagagctctcacagccccatctcccaaagcttcatctgcgttcagtcctgaatgagtttgatgccatccagaaggcacagaaagagaacagcagctgtactgacaagcgagaatggtggacagggcggctggcactggaccacaggatggaggtgtgtgcttctggggtggggtcaggcctgctctaggaatgacccggggggtcccagtgacttctctaccagacggcctgggtcagtgctaaagccacttcaaatcccttctggaagtgtagacctaaatttaaaaatatgtcacctggggagaacttcagagcccagaacttgaagaatatatgggaatggatatttaaagatacgcagaaaaaaaacgacttaaacccaactatcagcttcccagcagaaagatacgtaagacagacatgcacattggaaaacgcattttctcatctccaaaatgtcagtgcctgtgagaaagaagcttggtttcctctctgactgaagggtctgccctctgcattcaggttctcatcgcttccctagagaagtctgtgctgggctgctggaaggggctgctgctgccgtccagtgaggagcccggccctgcccaggaggcctcccgcctacaggagctgctacaggactgtggctggaaatatcctgaccgcactctgctgaaagtgagtgaggaaagcagggaagggggccaggcccagtggcttgcacctgtaatcccagcactttgggaggccaaggcagatggattgcttgagctcaggagctcgagaccagcctggccaacatggtgaaaccctgtctctacgaaaatacaaaaattagctgggcatggtggcaggcacctgtaattccagcttctcgggaggctgtagcaggagaattgcttgaacctgggaggcggaggttgcagtgagctgagatcgccgcactccagcctgggtgacagagtgagactccatctcaaaaaaaaaaaaaaggataggccccttggcttacgcctataatcccagcactttgggaggccgaggcaggtgggtcacaaggtcaagaggtgaagaccatcctggccaacagggtgaaaccccatctctactaaaaatacaaaaattagctgggcttggtggcacatgcctgtagtccgagctactcaggaggctgaggcaggagaatcgcttgaacctgggaggtggaggttgcagtgagctgagattgcgccactgcactccagcctgggcgacagagcaagactctgtcaaaaaaaaaagaaaacagggaaagggaagaaactggacttaatcctttcccagcagctatcatgaatgaagatggtgctcaccaccactgtttccctgcagatcatgctcagtggtgccggtgccctcacccctcaggacattcaggccctggcctacgggctgtgcccaacccagccagagcgagcccaggagctcctgaatgaggcagtaggacgtctacagggcctgacagtaccaagcaatagccaccttgtcttggtcctagacaaggtaaggagctggggcagaggggcagtgtctagtggggagtgaataccaactcatccccatgccccttctgacttctgcatatacctggctggggacagtaacctcttagtgctttttgcccaggacttgcagaagctgccgtgggaaagcatgcccagcctccaagcactgcctgtcacccggctgccctccttccgcttcctactcagctactccatcatcaaagaggtggggttcagggcgtagtgtctggggatgactggcgactggggaagacgtcaacaaagaagggcagagaaacctgagaagataggagagggtcctaggaatggctcagacatggaaaggggctgagattgttagagcttgggcctcttggtgagacaagcatcctaatcgccagtgtctcctcctcagtatggggcctcgccagtgctgagtcaaggggtggatccacgaagtaccttctatgtcctgaaccctcacaataacctgtcaagcacagaggagcaatttcgagccaatttcagcaggtcaggggcgcgaagacaagaagacgtgtggggaagggtagacaacatacaggggcaacaagccttttctccagaaacagctgttgcagcccaccttctatctaatgatccctctgctgtctttgccacctgacccctgccatgcatttccctattctcacacctgccttttccctgcagtgaagctggctggagaggagtggttggggaggtgccaagacctgaacaggtgcaggaagccctgacaaagcatgatttgtatatgtgagtgcttaaggcagggatgtggggagaggggcagtcctgaggatggtatcaccatgggttgctttgggacttgagagcctctgaagacacaggcagaggccaggtattactagctcaagactcatctcacctccttctgccttagctatgcagggcatggggctggtgcccgcttccttgatgggcaggctgtcctgcggctgagctgtcgggcagtggccctgctgtttggctgtagcagtgcggccctggctgtgcgtggaaacctggagggggctggcatcgtgctcaagtacatcatggctggttggtgagtctccaagggcaagacccatcctagggcattaggactcctgccctcaccccaggttctttcccaggtctgaatcttgcctctcttgtgccccattttcctcctatcctagttagttccctggcatgcctggaccattaacccttagctcccttctgttcttctcttgtaaccaagggccaaaggagtttctcattggttcaatcctctccactcacccacccccaccaccaatggtgttttcctatgtattctgttttagagcccttactttgtatttcctccttttcttttcccagccccttgtttctgggtaatctctgggatgtgactgaccgcgacattgaccgctacacggaagctctgctgcaaggctggcttggagcaggcccaggggccccccttctctactatgtaaaccaggcccgccaagctccccgactcaagtatcttattggggctgcacctatagcctatggcttgcctgtctctctgcggtaaccccatggagctgtcttattgatgctagaagcctcataactgttctacctccaaggttagatttaatccttaggataactcttttaaagtgattttccccagtgttttatatgaaacatttccttttgatttaacctcagtataataaagatacatcatttaaaccctg

SEQ ID NO: 506 - DNA, 4000 bp, Homo sapiens
gaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggtggggacgggccccagaggcacctctttcctgctctacatcccccttgcccacgcgtacttctcgcgcccggttccaagttggcagcctacctttcccaggcgaaacctctatccgatcccaggacctgccccctccccggccgcgctcctttctccccttagtcctctcattgacccgctatcccggtcctctgtaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgagacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtagagttgggggtttcaccatattggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccctgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaaggtgagtgagagcatgtggatgcccctctaaacagggaagggaaattcaggggaagctctagagcgcagcatggccagagggagtctccttttagccccttattcacctctgatcttgtagacagctgaggatgccaaggacttcttcaagaggaagatagattttctaaccaagcagatggagaaaatccaaccagctcttcaggagaagcacgccatgaaacagggtaagtttttcctggggcacctcttgaccctatctccataataaggaacatggattgcagtgtgaaccacgggggtgtcccctttgctggagtaaaactatgtcttagtttctctttggcatctttagaatctgtgtattgcataatcactatctgtagattcctgggttgagcgtttgagaaatttagaggaaggaaatcatgtttgtgctttggtggagctcctatttaatgacgatggaatgggggaatgagatgaacacacaggaaggaatcatgatccaaacgaactaaataccagcaattataaccccgactgcacatgagaatcactcaggaagtttaaaaagaaagcttgggcccattccagattgactaaatcaacttggaagtcaaaggaggggaagttgtaccaaggtctgtttttttttaaaaaagctcccctctgttataatcaggattcagaaccagtgttccaaaggtaaaaatctttccccatcatagttttctgattatgtcagactcatttaataccatattgtgttcgtttttatatctttggttagcaggttttttttttttccgagaagagtctcattctcaccacacccagctgtgttagcatattgaccgatgcattgtagaccctaaatttgtgttagtgaccccacagtggatcactgagttaaagttttattaacaatgccaggcgcagtggctgacgcctgtaatcccagcactttgggaggccaaggcaggtggatcacctgaggttaggagttcaagaccagcctggccaccatggtgaaaccccatctctactaaaaatacaaagttagcccgggcatggtggtgcatgcctgtaatcccagctgttcgggaggatgaggcaggagaatcgcttgaacccgggagacggaggttgctgtgagccaagatcgtgccactgcactccagcctcggtgacaagagcaggattctgtctcaaaaaaaaaaaaaaaaggttattaacaaactgtagttagtcggtcgcctgtccttaaacttgcctgtcacttctccttaactctaggttctcctttttgcttctaacctttgactcttatttttttccacagccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaa

SEQ ID NO: 507 - DNA, 4000 bp, Homo sapiens; identical to SEQ ID NO: 506

SEQ ID NO: 508 - DNA, 7496 bp, Homo sapiens
tggcgcttcctcttccgggtcggcgctcctgcctccctgcagggagctgcttatgggacaccaattcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggtacggtccgcgaaaagtgaccctgggactgcgtgcatgcatgcctccggggtggatggcattccgccaacagggtcactccgatagcgcccggcagcccaagcacccttcctacccttcctgcctccctgaagtccagcattaatcccctacccggcgacacccggcagccccttcacccctgtgtacctcgcaggatgcagagattgtgcggacccgggatcccgaaaaactcgcttcctgtgacatcgtggtggacgtggggggcgagtacgaccctcggagacaccgatatgaccatcaccagaggtaggttctcagataccatttatttaacttccttgacctcagctttcctctgtgctccaattcagccatccactgccgtagtccgcgtcagcgaaaagaactgcttcatcactgaaatcaaactcccactaggactacatcatccttccggccctgcctgttcttcacccatctccctggcctgggacctcctttggttcccagggagtccctcaggccccttatctcatctccttccttagccaaggctttttttccatcagcaacttcatcaccccaactaaataaacccatctgtgattaatccattctggtgcccttgctgctgcacctaactgctgggcccacatgattgtggcagttggtgacagttcagatgtgtgaagttttctacttcatttacacccttccaaagggaaatccttcttgctcaagggtagcccattccaatccttttcttctccctcaagcctctaccgcatcaaactgagtgtccctgcctcttttcaaaagaagttgagcatttcctcagtctcccacctcaaacatcctcagctccctcctaccaactaagggaaatttcttcccttctattggaggttaatcctctgtcctgtttccagtctattactttcttctctgggattcttttttcttttctttttttttttttttgagacggagtctcccactgtcgcccaagctggagtgtagtggcacgatctcggctcactgcaacctctgtctcccaggttcaagcgattctcctgtctcagcctcccgagtagctgggactacaggcacccaccaccacacccggctaatttttgtatttttagtagagacgggtttcaccatattggccagagtggtctcgaactcctggccttgtgatctgccccgccttggcctcccaaagtgctgggattacaggtgtgagccactgttggcctatcctctgggatttcatgtcacagttccactagtgtctctgcctctccttccctacagcctaaaacccttctcaagtatcttccatcttgaaaagaaacacaggtgtaaaaacaaaaccctccctcaattataccacaccacgagaagtaattatcttggagagagggattatgatgttttaagtctctctccttttttctttttttagcatacatattataaatgatgtcaggaagaaaccctcccaatatttacagcctaagctctcacccttgcttctcagccacccttcaaaaaacagctgaccgtggcttcacctgttcctttccagttcattcccctcaagcccactctcccagtgtcttctctggaactgctcggcagaagggcaccagttacctcagcaccaaaccagggagctggtaaagggtctcaactgatctctttagcacttggcattattgaccacttccttttatcaaattgtttttaagatggagtctcgtctgtcacccaggctggagtgcagtgatgtgatctcgactcactgcaacctccgtctgctgggttcaagtgattctcctgcctcagcctcccaagtagctgagactacaggcgcccagctaatttttgtatttttaggagagacagtgtttcactatgttggccagtctggtcttgaactcctaacctcaggtgatccacccgcctcagtctcccaaagtgctaggattgcaggtgtgagccaccatgcccagcctcattttttttatttttactttttttgagatggagtttcgctattgttgcccaggctggagtgcagtggcactcagctcacttcaacctccacctcccagattcaagtaattctcctgcctcagcttcccaagaagctgggactacaggcgtgtgccaccatgtccggctaatttttccattcttagtagaaacagagtttcagcatgttggccaggctggtctcaaactactgacctcaagtgatcacgccttggcctcccaaagtgttgggattagaggtgtgagccactgagcccagcctgtatttactcaatatttaataataaaagtcagttaacaaatggagctccctaggtaattctgagatggactggtatttagaaatcatggctgtagtttctgcttccctaacatctgttatatcttttctctattttctgccccactgctgttcaaattcttgccttctttattcacctgaaccattgcaggtaatctccttgcatctgttctccatgctggctggtgcaatgctgtaacatgcacctgcctgcttaaaatcccccaatgacttcgattacccacagataaagtccgatggtctggccctgcctgcccttccagctttttcttttgccattcacttctcacacctgagctgcctttgctgaagttccatcaagacacttgtctctcagccatcattcatgttgttctctctgcttggaatgctttttctctttcaccccttgtctatctggtggacacccactaattcatctttcagaactgacctgaaggctctcctctgaaccctttcctcatcccttccttcctttcccttgtctcgtctagtgagagtactcagggggttgtgtttgtcggcctccggcagatgaatctgaaagcaaggacagtgtcttggttttttatccttaatgtctaataaaacataaaatgtggcagataggaagcattgagttaaccattgaatgaatgcatggagactctagccaaggtccctcacctcagccccacctccctatgctcctcaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggtggggacctgaggacagagatgccccccacatgcatttccagcaggccgcctgggagcagtgctcacacagcactcagcactgggcctcgggtcagggttcctggcctatagcaggcccaacactcatcctctccctcagtcaggctcatctcacaagggaatggtgatacctcccctgtctacatcctggggtggttgtgagaagtggatgctgtaatatatggggaagggctttgaaaaccataaagcagcatggccccgtctttttattgacacacacaaacagcaattgctcagcacctttgggtaaacagaggggaggctgcttatgtgtggaagcagatggctcagaggttctggctgccctgaaggttgaggggagtgtatgttaggcaccactgtagttcactagtggcacataaattgggaagctcagctgagaagagttttattatgaaactgtctttggattccaccagtgtcccctgcaagcagcttcctgctcttagggaaagaatatggctagtggccctggcatgcaagtcaggtcgcacagtactgaggacacttacttgtttacaagtcaaagcccaggttcagtcagctgtatttcttgcaggtaggctgttgaattcagttctcagtttttttgttgttttttgttttgagatggagtcttgctctgtcgcccaggctggagtgcagtggcgcaatcttggctcactgcaagctccgcctcccgggttcacgccattctcctgcctcagcctcccgagtagctgggactacaggcgcccatcaccatgcccggctaattttttgtatttttagtagaggtggggtttcaccgtgttagccaggatggtcttgatctcctgacctcgtgatctgcccacctcagcctcccaaagtgctgggattacaggtctgagccactgcacccggcccatcagttctcagttttagcttgcccattttctgccctctgtaactatagagtttttggaatatcaagattttagactgcctgggtcagttttcccttccactgctgaagggtttctaaacaactgactaaatttttgttgttgtttttttttgtttttttgagacggggtcttgctctgtcatccaggctggagtgcagtggcacaatctcagctcactgctacctccgcctcctgggttcaagcgattctcctgcctcagcctcccaagtaggtgagattacaggcgcctgccaccacgcctggctaattttttatttttagtagaaacggggtttcaccgtgttagccaggctggtctcaaactcctgacctcaagtaacgcacccaccttggcctcccaaagtgctgggattacaggcgtgagccactaatcccagcaacaattgactaaatttaacccgtatttttttttgagagactgttgcccaggttggagtccagtggtgccatcatggcttgctgctgctttgaactcctgggctcaagcagtcttcccacctcagccccccaagtagctgagactacaggtgcatgccaccatgcctggctaattatatatcttaatttttttgtagagagggtcttgctatgctgcccaggctggactcaaaaactcctgggctcaagtgatcctcccacctcagcctaaacccatgtttttttttttttttttttttttttgagacggagtctcgctctgtcgcccaggctggagtgcagtggcgggatctcggctcactgcaagctgcgcctcccaggttcacgccattgtcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacccatgttttaactgagcatcaggttgggatccaaaccaagaagagctgggcataggagttactttctcagtgctctgagagtagcacttttctacataccacaggtgtactgttatggaggcctattttgtagggtaattttgcataaagtttctgccccgagactcttgaggcattatcctaccatttattcagacccaggagacaactgctgatgtcatgaggcacattatgggcttccctggaaccctaacccagcaaccagcttttggtgtctagtctcacactcattttctcccacttgacttgtgttctcaaccagagccgctcctgcacctcattaaccgtgtcactgaatacctactcaccccacctggagatttaccagccttcagccacagggacccactcccacagagagcctctagcacctagagaccttccttgttcaaaagttagcagtcccctccctacacgtgttggctttggtttgggctttgtgcagcagaatgagcatggattagaaatcaggtgatctgaattccagtcacagcacaacgagctgtctgagcttcagcgagctgctgaacttgccaattctcccttttctcatccagttaatgttgagagatcctcacagggctgaaagagtgtgtatgaacatactttgaatcatgtaagatttcacataagtagcaggtagcctcaagaaggtttcccctgctgctgccttagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggtaaggtggcctgggaggagacccggagacctgtaagaaccttgggtggggggaaaatgggagcatttgctcctcctaagccctagcaaattccaagtttgggccagcatcatggttctaattctcatcattcccaggcagggttcaagcgtgcaatggatctggttcaagaggagtttctgcagagattagatttctaccaacacagctggctgccagcccgggccttggtggaagaggcccttgcccagcgattccaggtataggccttggaggaggcattatggcttgaggattactgactgccaatcaacaggaactcctgcttcttctaccctaaaccctggagtgcagtggcagacaacctcaacctcttaggctcaagcagtcctcccacctcagcctcctgagtagctgggactacaggcacacaccacctcacccagctaatttttgtattttttgtagagacagggtcttactttgttgcctaggctagtctcaaattcctgggctcaactgatcctcccacctcagcctcccaaaatgttgtgactacaaacatgatcaccatgcccagcctaccttaaaccttctagctatgctctccctctttcaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggtgaggccctagggaaccactctgcagaccttcaggcttgtctcagccttgttaagagaaggctgccaactctgacccctgctgtactccctctttctgcccaggctgcccctgccagagccatggcggggtcttcgggacgaggccctggaccaggtcagtgggatccctggctgcatcttcgtccatgcaagcggcttcactggcggtcaccacacccgagagggtgccttgagcatggcccgtgccaccttggcccagcgctcatacctcccacaaatctcctagtctaataaaaccttccatctcatactgaccca

SEQ ID NO: 509 - DNA, 14173 bp, Homo sapiens
tgagtggaaaacaaaaggaaaacttatttattcttagaggtgggaatgtggggagtggggcagaacaggtggtggccctgggagagggtcccaaggggcagaggttggggatgtctcagtaaagaggggcaggtcatgaatagagcctccacccccagcagggggttcctgggcccgcccaagcactgggctaaaacgtggaaactgggcattgacaaagtacagcgggatgtgggcaattcggcctgtggaccagccctgcagagaagggaaagaaaaggatcagagtctgggcccaaagaagggccacctggcagagccatacagcagccaaggccctcagcttctccatccaactcctggaagccccagcagcctggcgcactcaccacactgagcagggcccctttgttgaaggaaggatggaaagtgatgagctggggctgggctcctggctccccctggataatgccactagaagaaaaggtgagcaggcaaccggaggcaagaagggagctgaatgtagtgggatgtgggtttgtttgtgcaggaaggctggtgagaagtccagacctaagggcccacatggcacttaccagggaaggagctcaaacacagggctgtttcgagtgcgaaaaaggaggatgactggtttaccatcctgtacccttggctttcctgtaagaaatggatccagggataggggaggaactctgaaggcagagtcccaggacatgggcagaggagaactccaggccagggcacggcctcattagattaactgggaagatggctgtgggctgagcccttcatccttgcctctcacctttcataagcacagccagacgttccccactggggtcccagaccatggagtgagcctctcccccaagcctgtgggtaaggacaggttaggagagtttcagtgtggtccctcccacctgcttttcactgccactccctcaaccactcagctcacctctcctcaccatctggtgtctgtattgttgtctcagacagatctgccacaatcgttgctgactttgcacctccaacgcacccctttccctcacctgtggacaaataagagcagagaggttcttgcaagaaacaggcctctcactggtcccctgccagctcaccaaaggcatcaacacctcgaaatctcctaagcttctatatttccctttatccctcagagctgcatcttaccaaaggttgctgcctccctctgaccaccccaaatactgaagtgttgccctaactcaccacaacgttctggaaaagacagggagtaaatcagtggctctcccaatacagtgaacagcagtcggctgccatctgggctccagcagccagtctggggtcagggagcaaaaggcaggagaaggtatgtctatagtagaatgcaggagggaaagtagaggtggccaggtttgggagcatcaggggcccattggaatcatctcctccccagtgtctgtgaatcagagtcccctcttacctgacagcgccctgatagagtaggccacctctcacaagtccacatctgggcctcccagactctgagccagagaaaagcaaattacagctcaggacctctaagttctaaaagttggacctacctcccttgacagagcttccaggagctaagtgcctttctctaggtccttgccctccctccatccttgtcccactcaccgaaagacagctgaaggagtggtagccaggattttgctgccgtctggggaccagagcaggttggtcaccccacctcctcggaaccagggaagggggacacaggtctctgttgagacatcccatacctaggagagtggggcaggagataagggaaaactcaagcaccccatcatctcacagtgggctggcctctctaatgtacaaagagccagaaacgagaggaagcgggagagggactgtgaaacatgaggcacgggttcatgctgacaattacagacagcggaattttaaacctcacgagtctgatggcaaagctcctctctgggtaagtttaagactgaatggaccaaggtccctcctccttcccccaagatgtttccacaaccgagtgaggaacacttttgccaggactgaaatgtgcatgaggggcagggacccactcacccggatagcagcatccacgggtgaagctgagagcagccgccccccactgggggcccaggccaagctggtaacaggtgtatgcccagggtgagacagcacttgggcacagccagaagagggtctggaggggaacacagaggatgtggagtcagaagatgacaagaagccatccccaaaattctatttctttgcctcctgctaaaacctcctatcctgatggcccactctgggctcaaatccaggttgtgaaaaaggaataaggattgtgaaagttaaaagaaaaaaacagcgaaggggaaaaacgaccaagtcaccacgagcaggtcaacagagaagaggtaatctgcaaggtctcaggccagggtgaaagagtgctttcacgagataggccatgaggcaaaacctaaccagtaacctagaaggtactgcccctggggcgatatcaggccctaccccagaacacagctctctgcccacaggccatccagcctggccatccatctatccaggattaataatctatgacattacttcaaggttccaaccttttctctccagttatctaacactcctcagaacacatcctgtgctcccaaacagccctcctgccttgccttatcaaagtacctcccaactctgcagctcccgcgtttgctccttatcataaagatgctgcaggctgggcgcagtggctcacgcctgtaatcccagcactttgggaggccgaggtgggcggatcacgaggtcaagagatcgagaccattctggccaacatggtgaaaccccgtctctactaaaagtacaaaaaaattagctgggcgtggtggtgttcgcctgtagtcccagctacttgggaggctgaggcaggagaattgcttgaacccgggaggcggaggttgcagtgagccgagattgcaccactgcactccagcctggcgacagagcgagactccgtctcaaaaaaaaaaaaaaaaaagatgcagcatgtggctcggcctccatcaccagcagggaactacctgagggcacctgccatgtgtctgcagctgtgtatttccagagccatgtgcctggcctgacagacgaaggctactacctgaattaatgccacctctctttccacctaactataaccaccttcagctccagtgaagtcttagtcatggatgtacaatttaattctcttgaactttatgataaatcacagctgcctttgcaggtgggttcagattcatctcattcttttcagtggctccattgtataccactcaatagatgaactataatttattgagtcatgcctctacaaatggacatttgacttgtttgtaattttttattatacataatgctgtaaaaaatatttcctgggccaggcatggtggttcacactccaggatggagtgcagtgacacagtcatagcacactgcagcctcaaagtcctgaggctcctgcctcagcctctaaagtagctaggactacaggcgtacaccccacgcccagctagtttttttatttttattttttgtatagacagcatctatgttgaccaagctagtctcaaactcctaggctcaagcgatccatctgcctcagcctccgaaagtgctggaattacacgcatgagccatcacgcctggccttgttttttgttcatttatttaaaaaaatttttttaaatcgagttccgctcttgtcacccaggctagagtacaatggcattatctcagctcactgaaacgtccacctcctgggttcaagtgaattctcctgcctcagcctcctgagtagctgggattataggcgcacgccaccacacccagctaatttttgtatttttagtagaaacaaaaaaaaccaacaaccttccaggcgtggtgtacgcacctatagtcccagctacttggcaaggggctcacttgagcccaggtgttcaaggctgtagtgtgcaatgattgagtctgtgaatagccactgtattccagcctgggcaacataatgaaaccccatctctaaaaaaaccaaaaaacaggccagttgcagcggctcatgcctgtaatctcagcacttcgggaggccgaggcaggcggatcacctgaggtcaagagtttgagaccagcctggccaatatggtgaaacccctgtctctactaaaaataaaaaattagccggtgtggtggcacgcacctgtagtcccagctacttgggaggctgaggcaggagaatcgcttgaacccaggaggcagaggttgttgcagtgagctgagatggcgccactgcactccagcctgggcgacagagtgagattccatccccccccaaaaaaaatctgtgatcacgtgtttttttcttatagtacctattgtcaaggtttaggtatcagggttacattagctttataaaaataaatcaggaagatcctgcaacaaaaaaaagggaggacaggccgggcatggtggctcacgcctgtaatcccagcactctgggatgctgaggcgggcggatcacgaagtcaagaggagaatcacttgaacccgggaggcagaggttgcagtgagccgagattgcaccactgcactccatccagcctgggcaacaaaagtggaactccatctcaaaaaaaaaaaatctcattattttcttctacaatccactttggtaacttatattttgctagaaaatcaaacatttccacagggcacggtggctcacttctataatcccagcactttgggaagccaaggcgggcggatcacaaggtcaggagttcaagaccagcctggccaatatggtgaaaccctatctctactaaaaatacaaaaattagctagtgcgtgcctgtagtcccagctacttgggaggctgaggcagaagaatcacttgaacccgggaggctgaggttgcagtgagtcgagatcgtgccactgcactccagcctgggcaacaggagtgaaactccttctcaaaaaaaaaaaagaaatcaaacatttccttcagattttcaaatctgttggcctaaacaagtccacaatattcttttataattcttctattttctcccgtatctatatctttccacttctgaaaatagtatactttggttttctttttctccttaattaggctaaccaagaggttttcttctttattcatatatatacgtatatacacgtatacatacacgtatatatatatatacgtgtatatatatgtgtatatatataaaacatatatgtgtgtgtgtgtgtatatatatatatattttttttttttgagacagagtcttgctttgttgcccaggctggagtacagtggcgtgatctcagttcactgcaacctccgcctcccaggttcaagtgactctcctgcctcagcctgccaagtagctgagactacaggcgagcaccaccacgcccagctgattttttgtatttttagtaaagatggggtttcaccgtgttagccaggatggtctctatctcctgacctcatgatccacccgcctcagcctcccaaagtgctgggattacaggcgtgagccaccgcgcctggccttttttttttttttttttttgagacagggtctcactctgttgcccagaccagagtacagctgtagtggcatgatgtcaactcactgcaacctccgcttcccgggttcaagtgattcttgtgtctcagcctcccaagtagctgggatcacaggcacgcaccaccacgtccagctaatttttttgtatttttagtagagatggggtttcgccatgttggccaggctggtttcgaactcctggcctcaagaaatccacccaccttggtctcccaaagtgctgagattacaggcatgagccactgcgcctggcctaatttttgtatttttagcagagacgggttttaccatgttggccaggctggtctcaaactcctgacctcaggtgatcctcacgccttggcctcccaaaatgctgggattacaggtgtgagccactgttcccagcctttattcataatttttttttttttttgagacagagtctcgctctgttgcccaggctggagtacagtggcatgatcttggctcactgcaacctccgcctcccagattcaagcgattctcctgcctcagcttcccgagtagctgggactacaggtgtgtaccaccatgcccagctaattttcatatttttagtagagacaaggttttgctatgttggccaggctggtctcgaactcctgacctcaggtgatccaaccgcctccacatcccaaagtgttggaattacaggcatgagccaccgcacccagcttagtcataatttaaagaaccagtttctggttttatttttagttagttttcacaggtattctttttctaattttattagtttctgatcttattagtactaattttctttacacttcctttaagtgtaaaggaagtgtatagtcctctgaaagagtctttccaccccgtaacccacagacacattgtccccacaatccaaaaagcccctagttctctttctccagattagagtattctcagcaacccaccttgatcttacttctgcttttcccatagccctgggaagtgctgtgaggacaaagaacttctcctttcagacgtcctcaccacccaccatgcctagcattgcacaactctcaggccaaggtaaggcaggctactaggacttaccgggtagacaaggaggtagggtccagggtccagataagaatgcagctctggcaggccacagccaagacagaggcactaaggggcttccaggccagagacgccacatttcgctgcagccggtgcttcagggaggggactatggtgctagggtgaaggggcaggaaactgagtcaaggcaggaacactaaggctccagggaccagagtgcagttaaggagggaaagccacagagaagaaggatgatccatccaggggccaggggcaccataggacaggaggggataaaggttaggtctagaagaagcacgcatccagttatggagcttccctgaccccagttctggaaggagccccatgaatcaggttcaagaactacaggactccccggaaccaaggctggcaagggaaggtgatattgacaagtcagagcccacctggtgtccccacacacacctgctggcattatacacacggactgagtcatctagcagggccactgcaaacttgttggtgtgggggtgccatgcaaagacacgcaagcagcagctggacctaaggaaggggttaacatgaagagttcctgcacctatccctaccctagcccagaagctcacattcatttccagtaaggacatggttttttcctactttttcttgtattcttttttgggggaacaggaggaatgagaatatggtgagcaatcagaaaaggagtaggagtctttgccttctccccaaagggagttttgaggttcaggacttcctttccacaaagctccagggcttgtgcactcaccaatttgtgacttgggcaaattcagcgatcagatcttcgctcctgagctgtaagaacaagatagacacaggacacactggggcaaaaggagtccatctcctcaatattccaacaggggagctggaccactcctaccctctgaagtcatcacacccaaccctgacctgcaaggataggaatgagggcagagtaggatggggacacagcaaatgcagagggctggggaggaagccaaacttacagacagatgggggaacagggacccatggagggaagaggcccatcgacagagtgccagggcccagccggatgccgtcttcacccactcaaacactgtagggttgaggaagcagctctgattaaaccattcacaggcctcttaccaggtaccttctaggtgaaagacaaggaaggacaggcactccccaggtccttctgcccagtaagtgctctcaacaccacactctggacacccactctggacacccactctgggttatttgggtaggtagaggagaggacaggaaaaatagggctaaaagaggctgagccaacaggtgtcgggggtgagttcaagaatatggagaggagataaccacaaaactagggaaggctggagggaaaaatacttaccctcttcttctgagtttgcaatttcatttagcaccccaaaaaggcccacatcacgcctgataagggaggaaaatgtgggtcagcttactctgatcccctctgtccctctctaccagtttcattcattcaatatacatgtattaaaaatatgggcactcacatttaatgagtgccaactatgtaccaggcactctacgggctgtcctttcatttacatatctcacaaatctgaacgagattctacccatttacggatgagacaaccaaggctcagaggacttttggggctttgtgagcaggttaaggagttgggacttgctctaagacaatgaatggaaagccatggaagggttctaaggagaagaataaacagatcacacagcagcattttagaaagagcagtctggctgcagattagagagtgataagaatagaaaaggccaggctggctgtggtggctcacgcctataatcccagcactttgggaggctgaggtgggtggatcacgaggtcaggaaactgagaccatcctggccaacatggtaaaaccccgtctctactaaaaatgcagaaattagccaggtgtggtggtgcgtacctgtagtcccagctactcaggaggctgaggcagggcaggagaatcacttgaacccaggaagcggaggctgcagtaagccgagattgtgccactgcactccagcctgggcgacagagtgagactctgcctcaaaaaagaagaaaaaaaaaaaagaatagaaaaggccaggcgcggtggctcacacctgtaatcacagcactttgggaggccaaggtgggcggatcacgaggtcaggagatcaagaccatcctggccaacatggtgaaacatgttgaaaaatatgaaaattagccaggtgtggtggtccatgcctataatcccagctactccataggctgaggcaggagaatcgcctgaacccgggaggtggcgattgcagtgagccaacatcgtgccaccacactccagcctgggcaacagagcaagactccatctcagacaaaaaaaaaaaaaaaaaaaaagaagagaaaaaatagaaaaagtccaggtgcagtggctcaaccctagcactttgggaggccaaggcaggtggatcgcctgagctcaagagcttgagaccagcctaggcaacatagggaaatgctgtctctacaaaaaaaaatacaaaacttaggcaggtgtggtggcacatgcctgtagtcccagctacttgggaggctgaggaaggagcatcacttgagccctgggggctgacaatgcagtgagccgtgttccatgtttgcgccactgcactccacactgggcaacagagcaagatgctgtctcaaaaaataataataataatagagaaaaataaatcagttaagaatctacttcagggccgggtgcggtggctcacacctgtaatcccagcacgctgggaggccaaggcaggtggatcacgaggtcaggagttcgagaccagcctggtcaagatggtgaaacctcatctctattaaaaatacaaaaattggccaggtgcggtggctcacacctgtaatcccagcactttgggaggctgaggcgggcggatcacaaggtcaagagatcaagaccatcctggctaacacggtgaaaccccatctctactaaaaatacaaaaaattagccaggtgtggtggtgggcgcctgtagtcccagctactcgggaggctgaggcacgagaatggagtgaactcgggaggcgaagcttgcagtgagccgagatcgtgccactgcactccagcctgggcaacagagcgagactccgtctcaaaaaaaaaaaaccaaaaaaataaaacaaaacaaaaattaaccaggcgtggtggtgtgcacctgtagtcccagctactcagaggctgaggcagaagaattgcttgaacccaggaggcggaggttgcagcgagctgagatcacgccactgcactccagcctgggtgacaaagtgagactctgtctcaaaaaaaaaaaaagaatctacttcaggaacctaggaaaaaggtgaaagtggcctgaactggtggggatgaagaaaaagagacagatttgagagatttaggaattagcataaacaagatgtgaagactaatcagacattagtaaaggaaagagcaatacaacagaaacacctaggtaataattacatcagctaatatgcttacaatgtgccagctctggactaggtgcctcacattaactaatcaagccattatgacaatcctacaagataggtattgttatcactgcatttatttttattttattgagacagggtcttgctctgtgacccaggctggagtgcaatatcaccatcacggctcgctgcagcctcaatctcctgagctcaggtattcttgcctcggcctcccgaggagctgagactacgggtgcacaccatcatgcccagctaatttttaaattttttgtagagatggggtttcagtgtgtgtgtgtgtgtgtgtgcgtgtgtgtgtgtgtgtgtgtgtgtgtgttaagacggagtctcactctgtcacccaggctggagtgcagtggtgtgaactcggctcactgcaacctctacctcctgggtgcaagcaattcttgcacctcagcctcctgagtaattaggattacacacggagtttcaccacattggccaggctggtctcgaactcctgacctcaagtgatacacccgccttggcctcccaaagtgctgggattacaggcatgagcttccgcgcccagactatcactgcatttttagatgagagaacaaaggtgtgaagaggctaattaatatgaacaaggtaatctaagtagaaagtagcagtcaggattcaaccatctatctaccccagaacctatactcaaaccactttttcctgaatgagtaatatgatcattccttaaagtgaaccatccagagaagcagatttggagagagaaataaagagactggatttgagcatgctgaatatatgaagtctgcgaaatattcaagcaggataatttggcaaacacgtgaacaccaggtctgatgcatcaactggaaatctagccccaagaacaccaacatttaagggacatcaggaagaggagccaccaaaaaccctgagaagcagcagccacagaagtaggagacaaggagcctgggaatgaatggcttttcaacaaactgatattcaacttcacacacacaggcatgcccattaaactgtactgaagtaccaaagatcaaagcttgacagcacatgtgttggaaaacaggcactcccatacactgctggtgggaccatatacatgtaccattttgacagagggctatttggaacagctcacaaaattacagatgaacataccctctgagccagcaacttaatttctaggaatttatcctacaaatggtaatggtattaataaaaatattaagtaaccctttttttttttttgagacaaggtctcactcagtgccactgcactggcacaatcttggctcactacaacctccacctcccaggctcaagtgatcctcctatacataagcctcccaagtagctgggaataaaggtgcatgccaccatacccagctaatttttgtacttttcttgtagagaaaagaacatggtttcgccatgttccccaggctagtctcaaactactaagctcaagcaatctgctggcctcagcctaccaaagcgctgggattataggcgtgagtcactgtgcctggcataaataacccttaaaggaattaatatgtgccattaataggtccaggtgcagtagctgtaatctcagcactttgggaggccaaggcaggcctgaggtcaggaggccagaccaccctggccaacatggtgaaatctcatctctactaaaatacaaaaagttagctgggcgtggtggcacatgcctatagtaccagctactcgggaggctgaggcaggggaactgcttgaaccagagaggcggaggctgcagtgagccgagatcgcacctctgcactccagcctggcaacacagcaagactccgtctcaaaaaaaaaaaaaaaaaaaaaaagaaaaagaaaatgagccgggcgcggtggctcacgcctgtaatcccagcactttgggaggccaaggcgggcacatcatctgaggtcggaagttcaagaccagcctgaccaacatggagaaaccctgtctctactaaaaatacaaaattagctgggcgtggtggcacatgcctgtaatcctagctactcgggagactgaggcagaagaatcgcttgaacctgggaggtggaagttgcagtgagctgagcacgccactgcactccagcctgggcaacaagagtgaaactccatctcaaaaaaaaaaaagaaaatgaaaccaggtagtgtagctccactcctacaagtgcaaagtggatgacctatgtaggagattattcagtgcaaccttatatctgatcttgctgagcttcaggtaaaagctcagaagtggtaatgccatgaggtgggggcagggagcaggttcacctaatcaagccagaaagcaaggcaagttactagagatgaaatggaagtactttttccatagtgttcctgggaagggcaaggaagggaacctgacatttattgagcatttgagttctataataaggactaaaaatttcatatgatttaggatatacagctctcgtggagacagcctgaataaaagtcttttgaagaacaccccaaggtaaaggggtgttgactcattttccaggatctgcagactgtgacccaggaaaccctttgccatgcctcaccaaatgttgatgcatctcttccacacttgctcccggtgatggatgaaggcagttcttgtgccatggtccagccttccaggggtctttaggggatcctttgtcagttgtaggacaggaagattgatccactatagcacaaaagtgaggagtgtgacggtgattcagtctcttcccaaatctttaattccgtgccatctccaacccaccgctgggctaagtataagagattccagaggtctgtttcccatttccacaaagctaacacttgtgagaatgggaaacaagtcttagctcccgtatctgtgcaactagaataatatttcatagggttgctgtgattatgaaaccatatgacatttttagaaaacacctgactcagcctctttcttacatagcaaacgctcaataaatgtcagtttcccttccttgtccttcccaggaacaccatggaaaaaagttccatgttgtatccttctgatcctccccagatactgtccccaacttttagatagttctcccgcatcctcacactccctagattctccctcattctctccattccctctaggcctcctccacagctccttaaccgttcccccgttatactccaatcccagtcctaaaacagattccagcccttctagcctcctgccggggccaagctgtttccactccgccagactctgtgaccctgcccctgtcacactgcctcctttccccagtagtccccgactccgcccccatgcctgtaggtcccctccctcctcgccctggccacctggccccggaagtcggggggcgggctctcatagctactgcccgtcaccagctcgttattgtgctcatatagggtgacttgaccccgaggcggtggaggagggaacaaccccagagagcacatcttgccggttcgcaggacgtctgcagtcggcaaactcctggccggaacggcacagaccgcactcccgcaactcggttcccgggctagattcgtatgcggacgggtaccgcaagggacaaacggcgaggcggaactcaacggaagtgaagaaaagactaacggg

SEQ ID NO: 510 - DNA, 14173 bp, Homo sapiens; identical to SEQ ID NO: 509

SEQ ID NO: 511 - DNA, 28702 bp, Homo sapiens
ttccgcgggagacagagcatttaatgagagcaagagctggacagtgtggtcaggaatcgtcccacccaaggaaccagacacatactcggtccttgatggggtttcctgaggctctcatactttctcctgccctggaaaatgccatccaggagctcatctctttgctactgcctctcttccagagcagcacaagaaggaaataaaatggacttgcgggggaaagaagatgcttgtctctcatgtctgtctcttacaggggggttctgaagattcccacagcctctctggagttgttgccccactttggggtctttgtccgagtaacttcaagtagattggcccacgggcaggggttgtttgctgagagatcaccaagcgctgctcaatctcaacgatcctctgttgtcaccagccatggctgtgaaggccagtcaacaaagggaagattttacccagaggagctcaaacgctggcatgaaagactctgaagtggcatagccagtggaaattaacagctgtgtccactctgggcctcaggtgagggagggcctagatagcccactgtggcccccagagcgccatcactgcccatacttggagtgtgatcctagctatttggggatggcaggggaagcatctcccagaaaagatgacctgcctgggagaaaagggggaccccagagggtgccagccaaggcgtctcggcaaatgttgacccagacaacaggggaccaaggagttgaaggaggctcactggagaggtgggacagggggccagtcgattaaaacagaaccaagtgatgaagggcgtaggttggcctgtggtgcactgtgggtggcaagccaggtgtcgtcctgaagttggcaactcagattcctcatcctttggtggtggccacaggaggagttcccagaggcttcaggaggctctgattcccactcgcactccagcagtgggaggttgctcaagaccaggcattccgtccctggctggggtgtcccttccagagtgacagagatgatctgaggctgctcaaggtgagctggaagggacatgggcactggtaggtggttgtcttagctctcaaccaggggatccgattcccatttaaactatctaggacgaagcgagtgaaaaccagagccctgtgtgggggatgcttgaggcagagcgggtacagcagcctgcatcctgatccctcggctacctggcctccctcacagagataatggcaaggcttgggaaagatgggtccagcagcccactgaggggttcccttcatttctgagcctaccctccagctgcccatgaccatctctgcatctgggcttggaggaagaggtggcccattggctgggttttggtggtgtgtggacatcgttgggtcattttggggtgtgaaccccaaaactctgtacaaggtgtgccagaaggttcggtagtcctgaggagggtaagggctgtgtgtgtggtcttgtggctcttcctaagtctcaatatgtgtcacattagcccagtcagggaaatgatccaagtcaaatatggcccgtccccaggtgttgacagccaaaaacacacagaagactccaattatgttcattatgactcctgttttcacctggaaaagagacagagtcagcaccctgaggcctgctggggactagtgctctcagagaggaggacaaagggtcggctcactgggcctcgatgtccctgtgccatgctctgtccctggctggggtgtcccgacccccaggacagtgcgacttcatgtcccccaggtatcctcagtgctcaaggcatccctgggaagtaggcagagtggatgggttctctatgcccgtgcgcatttggaaaatgacctcagagaagtgacaggaggcaacagcttaggccattcagggaaacggtcacagagcccagtgttccgtgagtccaggttcattgctcaccccagtgccttaactatcctacaaggacgtgccagcttccctgtggacctcctcaggctctttctgatgcctgctctgcaagcttccctcatggtcactaaccatcgcttcactaccctgttgtagatattttactggggattggagtcaagtttgcagtccatggtttctgggacccacctttttttttgaaaatgctcatggagtccctgagatacccagcagaggctctgagataacgaacacccgattggtcccaggtacatttctggcctcttgggctcaaacacttgcctctttcccagcccagagctgcaaagctgcccttctcccagcaaaggtgacagagctaatgaagagttcttcctctgactacatttgtttccaaggcatcatctactcccaggcagtgctctctctctccctctccctgcttctacctcttcaggcacccctacaaatctctgtgactgtcattagcatccccctgctgcctaagcctgccctgcctatcttcatggttcttgctaatttgtcaagttcatccttggccatatgagtccctcagccccaccttcaccccttccaaggactcccctggtgcctgcacaggcttctccaggtgggagagtctataacccacctcagagaaagaacagtgtgtgaggcttgagatcatctcagaaaaagaagaaaagctgcattataaatgtcaacaatggctacaggtctggatgttccgtggcattcccaagtcacatgacatcgttttgaaactctgtcattcataaatggggcatcccttatgacaacagcgttatagtccgacgggagtaaataaaaacagctgtgttaccatgtcagcaaccttgaggtgcccataggtgaacacgatggcatttggaggggtggccacaggcaacatgaaggcaaaggaggcactcagggtacagggcagcatgatgtacagcggattgaggccgatggagcgagactgcggaaaaacagcactgcaacatcaccgtacagaacacagaagctcttggggacgtgattctgaaaaggattctctgaatgtgccgggtacgtttgaacctctgtgcctcagtcttggttcctctcccttttgccacgtctctggcagataattccacctacggaacactgaaggctgaggtcagaggccacctgccctagaaggccttaccccctcaattcattcgacatgtatttcttgggcacctactatgtgccagagaccatgctgagtacttagactgtgctcaaccttacagtgccgcgtgcacatgtctgtctgtcttgccacagactgagagagcctagaggccagggaccacatcttctctcccgcatataaatctgtggatgtgtgtgtttttatacatgcgtggggtcattttgcacatggaatttggtagccaccttttaaattctacactttaaaatttagccacatccaacagcacctatcagagagtaggcactcattaaatatttgctgagtgtatgaatgaatgatgtaattcctaaaatctatcaaatcaatcatgtatcatgcacatgagggcagacacatgcaaacatgtttgttgcaaccatgtaacggcaaaacacaggaagccaactcaatggtcactaatagcaggatggttaaataaaatatgacacatacaaataatggaatagtatgcagctgtaaagaattggatttttttttctttttgtgctaatcaggaaagctctccaagataaccaaggcttcatggttagattttttaaaaattaagatgaatggccgggcgcagtggctcacgcctgtaatcccagcactttgggaggccaaggcaggcggatcacctgaggtcaggagtttgagaccagcctgaccaatgtggtgaaaccccgtctctactaaaaatacaaaaaattagccaggcaaggtggcaggcacctgtaatcccagctactcgggaggctgaggcaggagaatctcttgaacccgggaggtggaggttgcagtgagccaagatcacaccattgcactccagcctgggtgacaagagtgaaactctgtctcaaaaaaagtgtgtgagtgtgtaaaatatccagaaaaatatttgagaaattaacagaggtcatctctagggaggaggctagaggattaaggtctgtatacatctttgcattattagacatttttagccatataccatctgcaattttaaaaaactatactatgagcatgttcccattttattactctttgaaactgtgatttttaatggcctgataatgtcatattatatgaatatatgataatttatttcagcaaaccccctgttactatggatatatttgtataataattctgtcatacatcatcatcacatatgttggtaggcatctctgattattttcctaagatatattcccagacatgaaattgctgagtcaaggggtctgagcaggtttaatgttacggttcctgttggtaaacagccctctgaaaggactgcgcaagtcccacgccccctgggaaccactgaggggtcccacgcaggggcccagctcttcgctggcgcgtctccccgaccatcctcgttttcctggctgtgggtacctcatggtgtctgcacctcacactcctctgcagcccagctcaatgaccatcaccttttcctttctcataggtgggcgtgagacaggagtgtgatgggccttagaggtagctgggggagtttttacttgaggttcctggttctagaaaagcccgttttcaaagagcccgttagggcctgcatttgcctggttggaaccctcggtgctcccagttagggctggagatgacaaagccacggcctgtgctaggagagaggaggcatcaccaccacgtgcccagtatcaaaaggtgctccttctactgggcgtctgtttggacagtctgcttaggagaagaggagacaggccactttgctattttgaacactttcacctccttgctatttttaacactttcatcttcacttggaggagaaaaaaaccacttaggtttgctttttatacatgcagacgcccaggcagccgaatggaaattcaccaccttcaatcctgtgttcaggccctctgtaaatctgtctcccaattccagaataatgacagcctctcccatgctcattttgcagtctacagaggcttttcatagccctcatcttacttggccatcagcacagctctcggaagaaagaactgaagggccatgttcagagatcccacatcttgaactcgggtcttctgactgcgagaccagggatctttccatactaccctgaagctggtacgtctttgcaatggatgacagaaggaaatgcaaaaaaaaaaaaaaaaaaaaaaaaaaaaaaaaaaccatagccactgattttcctataagctctgctttcttctcactcccaactcaaaaacatgctagtccatagaacagaatgccttagcctggcactcagcagcttttcccacaaccgacagctacctctctccactccccaggatcccttatccctgtgctcaccaagccaggcttccaggagtcctcagtcatgtgcaccattgcctttccttgtgctgctccatcttcccagaattctctctcccttcctacctactcccaagtccccactcctccaaggcctcttcctggggtttccagccagtggtgctcccagtctgcagtcctcctgcacacctgtgctacatgctcagagaccacggcactggcctgctcctccttagcccaagtcctgtctccccagcttgaaaaataatccaattagatttataaaataaatttgagcacttggtccatggttggtgctttggtcagcaggaggggtacaaagaggagtggcaaagcagtggaggcctcaggggcagaggcatccagggtccacaaatccacgtcacagtcagacctgggtctccaaagcctggtctgagtctggcctggacattgctgcctcgtcagggacccacaatatggccatgtgttcctgtgaaatggaagggctcctccccactgtcaggttacttaccatggaggcaaagatgggcaggaacaaggtggtggtggccacgttgcttgtgcactcagtgaacacggcaacgagcaaggacaagatcaaggtgatggctgccgggggcactgcgtgcaagggctccatctgcttccccatccacacggacagccccgaggcctgggaagcaccaggagggcagtcatctcagcgctcccagcttgcagttccttcagggccagggcaagcttggcccatcctcccctcccgaccctctctctctacacctcataggtgacctcatccattcccaccattttcatccccgtcctcactctgctgtctcctaaatctgtatttccagccagctggcctactatgtggatttacatacccatatgccttctggaaatgtccatccagatgtcccaagagcacaacagactcaacatgctccaccctgcattcatcctccatagcccagaatctgcttctctctctgggcctcccagtttggtgaatggactcaccatccaccagccatccagcccagcaggctgggagtcatgctgccggtctctgttcccctccttccttatacccagtcagtcaccaagtcacccaaatgtctcacatccatctcctcctcttcagtgctccacagttttggaagctcaggagaatgatttcaaccagaaattgaaggtttagatttagggctttgggctgagaagagattgtccagggagagaatgaagtgtaaaaagaggagaggccaaggacagagcctgggcagacactcctgtttcagggagaacagagaagtcagcaacgaaggctgagcaggaatagtctgagtccgaagtaaagctggagactgtgctgagctgggggccaaaggaggagagaatgtccacagagtccaaagttctgagcctgagtgagatggaaggctgcagagtctcagctagttctcctccaagccctgcccagcccaggcccccactccagacatcagagtgatttcctcatgtgcagatctgaccaactcaccccctggcctcagtccttcagtggctgtctactgcattcacgatcaagtccacacccctctatcttggggccctcagagaagtggcttctggtagccttaccagcctcatcttctacttctcctcagctaaatacctcacatttttcccttgctcgtgtgctacttcctgaaatgccctttcatatatgtgcccctccctagtctgtgaagtctgccacgaacagggaccgtatctcaatctcctctgtaatctctgtgcctggcataacactagggacataataggaatgttggatggatggatggatagatggatggatggatggatggatggatggatggatggatggatagatgggtggatggatggatggatagatagatgggtggatagatagatgggtggatggatggacagatggatggatggatggatggatggatggatggatggatggatggacggatggacggacggatggatggatgaagacatgaatagatgcatggatgatggatggagaggtgactagatggatggatttgttcacctccgcaaaaacttagcacccactaggcaccaggctgtgtcctagatattgaagaaacagcaataactagaccaagtctgtctattacactcctggatacttgggtaggtagatggttggttggaggacagcagcagcaagctagctcatccctccctctggctcatttcttccccaggagggaaagaaggaggtaaagaaagttatatttttgtgtgttttccaacatgttcctcacctcctacgctgctacatacttagctaaagaaaaattttgaagtagctaccatgttaagtagccagtagaaggaccaaaagtagtagcaaacaatattgacaaggattggaaagaaagatttccctcagacaaatcaaagcagagattattgtgatcaagccccagagggtaactgacagtgtcctctgcctctcttggctaaccacggtcactcattcactcattcctgcaatcgctcaaaggttactttctgtcttccaggccctgtgtgtggtgtagagttcctagatgacaagacagagtccatgtcctcaaggaatgtgcggttatacgaaggatgcaggcacagaaacacacaagcccagggatggaagggtggagaaacgccaccctcttgacgaagaagagggctctgggcagcctgtggctggagaagttacctcggatcctttagccagagcaaatccgccccctagtagcagcacgatgccccagggcactttctcctgggttaccttccaatccagcaggggagggggataaaatggagttttcctttctgggaagaaaaagaaacacacacacacacacacacacacacacacacacacacacacacacacacaccagagcagcattagaagacaaaagaaatctaatcaagggggaataaagctaataaggacaatgaggtaccatctcctacttataaattagctaaagtttacaataatatatacattgctggtgaggatatgatcaaactattacacacactgccaatagcatcgtaaattggtatgacctttttgaaaagcaatttggccatacattttaagggccattaagactttgtattctatcaccccagcaatattactcctagaagtttatcctaaagaaaaaataccctcaaaggaaaagctatatgcaagaaaacattaatttatgaaaataaaaaattcaaaacagccaaaatgttctataacaggagaatgattacaacccctcaacgcaatataatgccattattagagaaaatatatttgaagactgtagcaatagtgggaaatgtttatagtgtaatatcaatcaaaagtggtagaagaaacaacaaacaaataggattcaaactgtgtgtgttgattataatgtaatatacaggcatattagcaaagactgggaggaagagagaaaacaaaaaattgtgctgaatggaaatcagtgttatggaaaatttgaaacattttctgttcctgttgtaatataaataaaatttcaaatgttaaattcaaatgttaaaaagcaaaaaagatattttgcactaaataataccaccggtggcttgaaagccactgtttcccaggcttttgtagccaatcctcttggatatgatgggattttctccctctagggcccaaggcatcccatagtgaccctttggttccagggctccagtcctgatgactgggcgatcagaacaggagacttaccttcctcagtctggctgcggaagttaaacttgggcttctgtgaaggcacaatgaatagcagggtggccacaaagatggccacagtggcatcggagacatacctaggtggggaaaagcacagctcatctgcgacagagacagtcactcaacaaacccatcacaactccggcagttctgtgtccaaatgcttctatgcaaagaaacaggctcacagccttaaaagtcaaggtcaagagtggtggccaggtgcagtggctcacacttgtaatcccagcactttgggaggctgaggcgggcggatcacgaggtcaggagttcaagaccagcctggccaacatagtgaaaccccgtctctactaaaaatacaaaaaattagccagacatgctggcgggcgcctgtaatcccagctactcggcaggctgaggcaggagaattgctgggaggtggaggttgcagtgagttgagatcatgccattgcactccagcctgggtgacagtgtgagactctgtctcaaaaaaataaaaaaataagagtggtatgggagactgaatcctggctagaaatcaagatgcccacactcttgaccaccaactttgggtgatcctaagcagtttacttccccctctcagcgtgcattctccataagtgtatttcaggacctcttcttgaccaggttctctagaattctgtctgggttcaccagggtgaccatgaagactttggtgctgacctaagccgaccttcaaaacgaaatggccatcataccagcatctccctgcccacatcttctgccttttctaggatgtacatgtttctcatcctttcttccattctgacaacgtcttagccaggagagaaactacatgtaccccctttgccaagtctctgtctatgaagctccctagatgtgtgcctttggagggatttgaccagatgtgaagatgagaaagggaagatggcagagcagagatttggaaactagagctctgggaaccctactcctagcccaagaaatctctctcatcacagctctggccaccctgcctggccaaggattttctgctcagcctactcagggaggagaggataccacaggaacacattagggtcttattgtggagcttggtcagaaaacaaaaatgagtcatgaaaccaacagagtgctctctgaaacccagctcccaaaagaggaaaagtcttgaccaagcatgagtgcctggcccacattcctcttgccacctgtagccgagaccagcagcatttaggcactagtgcactaagccagtggtgtctttctttctctttttttgagacggagtctctctctgttgcccaggctggagtgcagtggcacgatctgggctcactgcaacctctgcctcctgggttcaagtgattctcctgcctcagtctcccaagtagctgggactacaggcatgtgccaccatgcctcgctaattttctgtatttttagtagagacagggtttcaccatgttggccaggatggtctcgatctcctgacctcaagtgacccacccacctcagcctcccaaagtgctgggattacatgtgtgagccaacgcgcctggccctaagccagcgatttctattgaatccaagacttactttgtctcaccctccacccaggcaacagtcagccagccgggcatgaagccggggtctcgggagaaccacaggatgaccagcaggaagaagcagatcagcacgttgatctccgcgaaggacaagggccccagcttccggtactcctcctgcagcaccttgagggcagccttctcgtttttcttgctctctagcccgcagccccaggactttttaaaactggagaatgcaaagatgagagaagggcagggcagactggttggctcaggtgctggtcagatggagcctaaatgttctacagcagaatgtagcaaaaagacacataatgctgtcctcgcctgctatggggcctggagaaaggcccttcctgcctctttccctctcctgttcttccatcccagaatgtactagggaaaagtctctgtagagaggctagagggtctcggcaggtgcccagacacctggagactggctgctccagggtcacctgggggaaggccataaggagcttcggagcctgcgcaaggtgggaacagggctccctcacatgcttcccaagtcttcctccttccacctcagcctggagctgccttcgatggtgttgggatgccaacccccatcaccaaggtggctcagggagatgcagggagtgagtatgaaccctggcagacagggctagtcaggggcagaatgggtccttgtgttccctggagttggaggtgcaggattagggatccaggagaccctggggttagcagcaagcatggctagggcaagaaggaagacagcccaggatggcacccccatcctggatgggcccccttgggaccagtgtccattgtccagggtgtcctgcagggcctcccctaaggtggcgttggcatgaggaggcagggaggagaggaggttcttggaggaggtgtaaaggggagctcagctgtggaggggggataactggggccactgtgcataggactaaggcctcaaggtatgctgaatattccattcacacattccagttccagccactgttggtttgaaggggtgggcaaggccaagagtattgtcctggagagccctccctcgtgagagcccttccgggggccatgagacataatcataggagggaaggggttgatggaataggagctcattcctgaagccagtgctggatgtgaacagccttggagagtgtgagggccaagtgttggtgtgatggtggcttggcctggaacatggggacaccaggacatcaggtcacagctttctggggtgctcaggggtcagaaaaggaggcaacactgatgggacctcaggtctacacggctggctaggatctccctgctgggcaaggccgtgtgtcctgagggtcacccgctagggacactctctagacatccggcacagggatggctctgctggtgtaagacagggcctctctgctgccacacccttggcttagtaaagtttgtgctctaccaagcacctctctgctgccaactgtcgtcctagagaccctggggctcagccaggggcttcaggtttccagcataaggggtgaccttggtattactagtggcccaggagccagagcctgcatttggtgctggcagctcatccccaacaccacagtagctgcagactctggggctgcatggagtatgcagtcttccaatgccagtgccccacagtggtaccgccaagccttcagagtctctcgtgctgagcagctttgctctcatctctgggttaatttcatctggtgatgaccaggctggcatgagatgcaagtaaatggatccagttggcctgtgaggggcctaggtcagggtcaggggtggggaccacagagtcctcctgcagcagaacagccttcaccatgatgcaccatggtgaacttggactgaatatgttgcagagccaacaagaggggagagattcttgagctttgcatgcctctgccctggcaggggtcccaaagaaccctcatggctattacaggaggtaagcctggttgggacagttaggtataaccagtaataatatcccatgtagttcttggtggtcctggggtggggtctggcccctttggctagatatagcctaggaggctgcactaggctcttcagcaagatagttgttctggattaggctagaggccaagaacttaacctcgttctccaggatcgttcagatgaggaactctagtgagagcaacagctgacagtggagctgcctcctgccgctgagacaggtgctccctggcctcaggtggggaggtccatgaggccacaaaggcaggcagggaccaccaggtcttagtttgtggcaggacgtggcctgggccagagcactgttcccaccactcaaaccgaatgtaaaagctgtcctctaccttccagatctggagccaaaacaaagctgccgtgagctaccccggccagccacactgcatgcgtccaaactagagtggcccgtcgggaaggggaaggggtgggactggactgcagccacgcaccccaccacgagcatgctcagaagccccctgctgcagacactctcaggctcccccgccagtcaacaaaagctgatgaaggccgtgccaggctgggtggactcagcttcaggttctggctgtgagtctccaggggcctgacatctgcctctggccagacaagaagctgatggtgcccttgcggcctcggcgccatgctatctccctcctctttctcagtaggccttggggttctagggcagccccggccccaactagtgtttctgacacctggtcatgcttaggtctggaggcaactaaggacagcaaccctcagcctccccaagaggggatgccatgcagtgggagccaaagggcctgggttcaagtctcagtccccctacttccctgttacaaagctctgtgttgaccacatcacctctccatgcctcagttgccttgtctgtaaattgggaataataataatagtgctgacctcgcaggttgttgtgaaaattaattaagtttaagagtgcttgggccaggcgaggtggctcacatctgtaacgccagcactttgggaggccaaggagggcggatcaccggaggttaggagttcaagaccagcctggccaacatggcaaaaccccatctctactaaaaaatacaaaaattagccaggcatggtggtggtgggtgcctgtaattccagctacttgggaggctgaggcagggggaattgcttgaacccaggtggtggaggttgcagcgagccgagatcataccactgcactccagcctgggtgacagagcaagacactgtctcaaaaataaataaataaataaataaataaataaataaataaataaataaaataaaataaaataaaataaagaaaggaaaagagcgctcgaaatcatgtctggcacatgatgagcactcaataaatgttggtcattattattcctgttgccccatgaggagacacagatgctcacctgcagcaggttcaggaccatctcctgagagacctgttcgacggatgtgaacaaatgaacaggactttggccctggtgcagattcaagaggcagggcaaagagagctactgtcaaagccaggctgggtggccaggcagccatgcaaacagtttcccctgccccgtccatgggcaggacagagtggggtttgggcaatgatcattaatattgtcattcttactatcattattatgattgttttgaatatgtatagcaacttttttttttgttttgagacagagtcttgctctgtcgcccaggctggagtgcagtggcatgatcttggcttactgcaacctctacctcccggcttcaagcaattctcctgcctcagcctcccaagtagctggggttacaggcatgtgccaccatgcccagctaacttttgtatttttagtagagatggggtttcaccatgttggccaggctggtctcgagctcctgacctcaggcgatccgccctccttggcctcccaaagtgctgggatttcaggcgtgggctaccacgcccggctaatttttgtatttttagtagagacggggtttcaccatgttggccaggctggttacaaactcctgacctcaggcgatctgcccacctcggcctccaaaaatgttgggattacaggtgtgagccatcgcgcccggcctgtatagcaactttttaatgggagttttcaaaacagttcctccttcagaagaaaacttaggaaaattccctattttccccacaaaatcacaggtttccgtgggcacttttgcctctgagctctgcagtctcttccctctggtcacaaattcccctggtttgacttggctcgaacttcctgtggatggaggcacagagcacaggcacttaactcagagctgagtactttctatcctggtgtggcctgatcacctttgcaccacagataaatttgtgtgttttagaaaaacaataacttttttttagctatttgtcagccacaggtcatggtttctgtccaaagtctggctgccatcaaaggtgacccctgatgaacttgcctgtgtgctaggaacaggaaggtaaactttctaggacctgtacactgctgggaacaccagaggtattcagtaaatgtctgggtttggatggatttggtcataatcactgctggttttactcgacttaaactccccgtgcattgaggcacagagcgtatgcgctcagctcagagctaagtcacaggtttgcggtgacctggcctgatggacccacacggcaaagaggaagcttgtccagcaatgtcgaactggcacgtggggaccagcttatctttaattgctttaacctgcctgctcttcctccctgtgctgggagctgtgcggggtgcccagcatcagagtggttctggaggaattcaaagtcaccggaagccaaatgcagatactaaaggacaggcctgtgatatgcccaggggccgctcagagatggaatgggggtggggaaaagtcagggaagcagcatttgaactagccttgaaggctgaggaggtgggaaggtagagaatggcattccagggaaaggggaccacgtgtgcacaaagctcagtgagcagcctgggttcgaaggaacaggagggcagactagcaggagacagggctggagaaagatcagggccagacacgaaggactttgtaaacctgcctattgagtctgagggctcttctgcagctttgaggcataattaggcataattaggctgtgagcagctcaaacttacttgaatctcatgtaaacaaactggagccacagccaggcgaacagcagcatcaccagcatgttgggaaaggcaaatgcaaaccaggaagcaaagttcacgaggtccttgctgtcaggaaacaacctacaagaagacaccggcccccacctcagatgctgagctgtgggagccagcctggccctgtgcgtggggacggagcagcagctgggccctgagaggcgcgcctgtgtggaggccacatcctcctgaggtctagccaccaagtccattgccaagcattgtcccctaatcgagtgggagcctcagaacatggccacagcacaagacaaggccgagaaatgacccactgactcttctgtgtgtccaggccttgctaagagtctcatggaagttatggcccatccctccagaaaaatacaactttgtggccgggcgcaggggctcacgcctgtaattccaggactctgggaggccgaggcaggtggggcacaaggtcaggagcttaagactggcctggccaacatggtgaaaccccgtctccactaaaaatacaaaaattaaccaggcatggtggcgggcgcctgtaatcccagctaatagggaggctgaagcgggagaatcgcttgaacccaggaggcagaggttgcagtgagccaacatcgcgccactgcactccagcctgggcgacagagcgagacttgtctcaaaaagaaaaaaaagaaaaatacaccttttatacacatgcatgtaatttggctgacatctttggggatctgcagagacctcagcaatctcgctctgtgggtttctgcaaagaacggtccccccacttagcaaaggaaatctcaaaagcttcccagagcggaggctggaggagggtcacttccaccacaggccccgcctcccatccccggggctctgctagccccaggggcgccccctttagctcaagagtgtcaaagcaggcgcagagctttccccactcagcccagacgggctgctcttcccaaagaaagttactggagaactgtaaggatatcattacagaaaacactcccgaaattaaaacaaacgggttgttgaacctcacgtttctgcccagccaggctccagacctgtcctttccacctcccagctcctgcgcccactgccctccccacccctgtccaggctcctgtctgcaaaggatggcatcaccttatttttgtgcctgcccactgcaattagtacatacctcaattagtacatttatgtaccagacatgcctggaagccccaggcatcttgccaccctcaacagaccatgactaccccgcggcagggcccaggtttctctccctcttggggtcctcatggcctgcatccctttgtggccaaggctagaaagttccaaaccatcccatggttcacctgatacctcacaaggggactataacgaagcagtgaagcagtgaatgacccaaccccagcccttcataccatctgtagacctcggatgccatggggccatcaccattagccaccaaaagcagtgagcaaagggagtgctggggagtcttttagaggtgtctattttctacaagtttcaaccaaggacccagcgtctggaagtacattgtcatctgccatgactttagctcagagttcaatccacactccctctctgagccagagtccctgaccccaggggaggtggtgggtcttgcatcatagcagaaagcagactgggacgttagctcccctgacatcagctccctatcctctctaaggcttctgtgtgggcacaggggtgccaggacacagaggctagatggggccacatctttccacccctgccaggctcccaggccaggtctggctgccccgaggctttccaggactctgcagaggagcagagagaggtgggcaggtccctccagccccggtacccacttcgttgtccccagaaggtgcgaccaaggactcactcgttcatctggcccaggagcaccacgttgggtcccgtcccggtcagggtggcggtgcccccgatgctggccgcgtagcagatgcacagggtcatggccttacacaacctcttccgctcttggtcttcctgctgccccagagtggggccttcaaaaatcacttgactccctgtggtgggcacagcgctgttagctgagccagtcatgggggctgcccacccagccccaggtcctgactctgctgctgacctgaggattgggaaatcccagctctgctgatttagctgccccactgggctccataagagttgctggcagggatgtgcccgattcctctctgtaagccccaggaccttgcccagggtctggcaatcaggccgtcagccacagaccctgactctactgcactgggctggggatggtaagggaacacggcagacggcaaggtagatgctgactcgtcttccctgagcttcgcacctagcagggaagcaagcatgggacgccaagccccagacctatgggagcagagagtggaaggatttgagctgctcgaggaggtcagaaaaggcctccttgaggatgagcaggagtagcaaggagtgaggggcatccctaagtgctcgaaagatgcccaaatgaataatcaggtgaacacactgatttctgcaactgatgggaactgagggtgagactttgttcaaagctctattaaaggatctaagttgtgtgcaataatcccctcctaaaacttaggacaacagtattttctatttttttttctctatgcgtgtttaaaggagggctccgggaagcagacagggagaaggaggtggccaaagcatttgccagcagagggaggggaaggctgctgttgtggcctggcagtgccctggccaggggctcacctggcagctccttggccttgcccttgtccaccagctccaggccggcctcggtggctgcgcttgtggcttccatctgctgcaatatggcctccacgatgggcaccatcatggccgtggttgccgtgttactgatccacatggacaggagggctgtgacgcccatgaagcccagcatcagcctgcagaggaggggcagggaggaaagccagagaatccccaccccacccccgtactccctgggaagcaactggggactgggtccacccctgcagggatgcacaggtgttgaggccaattcaagatcagatattggaatagggatgacggttttagagcctcccctccctccctccttcccttctttgcttcctccattcctctctccctcctgcctctcccacacccatgactgatgtctactctgcttgcttctggggttaccaagaggcctcagatccagtcgtggttctaaggagcacccctgccccaccatctagcaggggaagcccaggcatccagatggtgccaactcaatatgagcttgccctagggtgtgctggaatacccctatgtgcaggcagccccagcttcccacttctggctaggaaattcccacccacccccaaactctgttgcacctctcagaagttcagaagggctaagcagagtaggggtagggtgagctggggagggagcttgggaaagtgtgactattctcccggctgccactccaaccctgccatctcccctccgccccgcacatacactttgacccctccatgctgcagtggagctatcacacaaacagtattcagaagaaacactccctttgcttgtaacccctgctcccttctctgctgtctatcaggaagactcctcatggtccttcagagcctgctcaaacaacatccctcctctgggaccacgctctcagtgtgtgcaccaggtggggctggcctgacccttctcaatccttccccctactctaatcatcgctgtgctgggttcaaagcacctgtttccatgtctgctctctccttgggctgtgagcagggcagggcctgactctgctctgtggctctacatgccccagctgtccaaggctagggacagaaggagctcagctactctcagtctgtgggcctcgctgcagccaggctcctcctcagggctcctaattcacctgggggtaggagcaggggcaggggtaggagcctgaagaagggacctaggagctgttctgcaccagggcccaagctgctgtccacacaggcagacattatggacccaaaaaaaaacaaagcccgggacccaggctaggaggagggggagagtttgcatgaatggagttgtctgagaagaaccaaggcttctacatgatatctcaaggcaccaagggtgcctcacatacaggtgactcccaggacaggcagtgccttggacaaccggagaccatactcagaggagcaaggtggcaggaaggatacagaagcatgtgtgaacttgggtttggaagtggaagctctccagcatgctgcagaatgaaacccactggagtggcctcccacccaagctggccactcaagggagccaagcagaagaattctgagggccctgaggtccactttcctggggtctctcatttctagaaaatatgatggcttttgatttgatgctaaagcaattactggaaggaatcaatgccaggatgtgtaacagatcagagagccacaaagtcccctgctcaggggaatctgaggcaccaagggagccccgggcatgggttgcctgcagggcaggctagcgtctgtgtgtgctcagggtctagcacagcccctgacacaggggcgcctcaggaggaatttaccgtaaactgaccagcagctgactcctgatggctgggccaaggacgtgccatcattgaggggacacattgtctcaaaaggaagatatgccctgagtttctgattagagaggacacaggccttatcagagaagctgggtccaatccccgtgtgtccatgagcaaatcactttatccctctctgcctccaatccctcatccacagaatgtgggcagtaagaatactcagctctcagagttgtggtaagaattaaatgaggcaattcataagctcctggtatcatgcctggggccttgtagacactcaatatacccattatgatcatgattgattatggttatgattatgattatattgactccatggcttagctggaaatggctagctagattggcaggagagatcctggaaatggagagagaagctggggtactgagtgatatcggggaagataagaagcttctttgcagtgggaatagatgctccagcttggagagaggacctttctgcttccccatgagctgggtagttgagccacttctggcctgcttcccttatcctatcagacacagcttgatccagcctctatccaatttgttcccggtggaaccctgcagctagctgcctcccccagaaagccttccaagcctgcaaggactcttgctgacccacctcctctggattcgaggacccttacttactgctgctcaccatgtgccaccaccacgcatgcatctggtctctcccactaaagctataacgcaccccacccagccaagtccaggtaagcccatggccagccctcaccagtggatggcctggtctgtgccatcctccacccccttccagccctggggctcatgcagagccacgtggcaagagagagaaggcgtaattaccgtgcaggcttggcccccacccagaggagcgtgcgcagggcgatcctcttgtgcaggttccagcgctccacagccacggccacgatgaggccgcccaggaacagcatgttggtgtccttcatgtactggacacacacctggagcgtggcacgaaggcctcatcaggactgtcccttgccacacactagagccacccagtccccagatgctgacttcagggacagcttggagtggggatgcaggctcgagtggtgtctccctgccagggagaatccacaaatgagggttttccggtcacccccaggcctgtgcgactcacagtggggactagagaaagagagaaggggagaaccagaaagtcaccaggatcccttgggtctgctcacctgcctggagtccagaatctggaagagtgggaaaagcaagacaggcatgagagaggtgacagccagagggatgacttctgtgcaccagtaaatggccatgaggatgatgacgtaggcacacctgacaaactgaagagacagtcctgaggcctcagcgtgttgccgcctccctctccccacccccagaacactccggacggcggctggcatggattgtcaagacacagtgctgatctcagagggattcccctcaaagtcatcttgttccccagccctggtcagcacagctttcccgggtcaggccagggatctattcgcaaaggactcctgccccattcccacccctcctccctgcctccctccttcccagctgtgtggttctaggcacgttctttcatcttctcaaaccttggattagctgcctctcaaaagaaaagatcaagaataggacaaggaagaaaaggagaaagaaggagaaggaggagaaggaggaggaggggatagaagaaagagaggaagggggatggagaaggaagaaaagaaaggaggaagaggagaaggagaagaagaataaaatacctggtttttttggttttattattattttatttttgagatggagtgtcgctcttgccgcctaggaggccattgttctaagagaagtgactcagcaatggaaagccaaatagtgcatgttctcccttataagtgggagctaagctatgggtatccagaggtatatagcgtggtcgaatggatactggagacttagaagcagacagggtgggataggagggagggattaaaatctcagacttcaccactatccaattcattcatgtaaccgaaaactacgtgtacccctaaagctattgaaataaaagtaataataattatgtgataaaactagccacctccctaggttgttttatgtttcatcagtattttttgtgtgtgtgtgtgtgacagagtttcgatcctgttgcccaggctggagtgcaatggcacaatctcagctcactgcaacctccacctcccgggttcaagcgattctcctgcctcaacctccggagttgggattgcaggcacctgccaccacgccctgctaatttttgtatttttagtagagacggggttttgccacattggccaggctgatctcgaactcctgacctcatgatccgcccacctcagcaccctaaagtgctgggattacaggcgtgagccaccgcgcccaacctcagagttccttcttagatgtctccctgcgcctcttctatagtctggtttgtgcccttcctctgagtaccctccccagccattagcatatggagttgtcactgtttcctcaactgtccttctaccaccacaaccagtgcgtgactcgaaagcacaaacagtacagtgagtcctcacttaacatcattgattggtttttggaaattgcaatgcgtaagcgaaacaacataagccaatattcccataggcaaattgctagaaacaacagttaaatttctacagcatatttctggtcacaaaaacatcacggagatcttaaataaagaccaaaacacttccaatattaaacactgaagggaatgtgagctatacatatacttaagaaacattgaaaacaagttagataattatttacccagttacagcaggtcagggtcttgggtgaccagatcctgtcccggcagctcagggtacaaggtggaaaccagccctggacaagatgccatcccattgcagaatgcacactgacacgcacgcccacgctcactcagacagggaccatacagacactccaattcacctaacgtgcacgggtttgggatgtggaaggaaaccatactagccaaagaaaagccatgtggacatgagggtaatgtgcacgctccacacagacagtggccccagccagtaatcattttcttttctttctctctcgctcttttatttctttttttttttttttgagacagggtctggctctgttgcccaggtgggagtgaagtggcacggtcacagctcactgtaacctccatctcctgggctcaagggatccttccttttttttccctccctcatcaacattataatgaaatgatattgaatgaatcaacattattcaagaacctgctgtatttgtagatcaccgtcctcagcatccagaacaggcccaacacttaggatatctttgcaaattcttgcttatttatttatttatttatttatttacttacttacttatttttgagacagagccttgctctgtccccaggctggagtgcagtggtgcaatcttggctcactgcagcctctacctcccaggttcaagcgattctcctgcctcagtctcctgagtagctgggactacagacaagcgccaccacgcccggctaatttttgtatttttagtagagaggggatttcaccatgttggccaggatggtcttgatctcctggcctcgtgatccacctgtctcggcctcccaaagtgctgggattacaggcatgagccactgtgcccggccatctttgcaaatgtttattaaaggaatcaatagcattcatctgagtttaactctgacaatgctgctgaagaacagatgcacctgtacacaatccctgcttctcatcacccagaagagcgtatgtattatttgcacaaaacagtgcaggaagacttggaaattctttgtcagggttgtgttatcagccacaaaaaaataaatcttttttcagcatcccacgagcaaaccagggcacctccctactgggaggcagggtccctcagcctcggcacactgacattttgggctaaatgatgctttgttgtgggagctgtgcactgcagggtgtttagagcaccgctggcctccacctatgagatgccagtaagactgtctccaggttggacagcaaaaaatgtctctgtactttgccaaagttcccctgttgtggggcagggtgagggcaggagaaagggtcaatgctggttgacagccgctgaactaaaggcggaacagcagcgtgactggaagcccaggctttgacaccagacagatatgattggcgcccactgtcagccactgtctggcctttggcagccactaacttccttggggcttggtgtcggggtgtaccctgggcaggccatcagaatgatgcctccaggggcagacaatgagagggcgcattggagagaattttaaaacaataatattagctaaaaattagtttgcttcttactatcatcaagtgatagcaattctaaacaatgtcgctcataaattactcctcctgctcccaatcctggtccctgtcccctcttgtttcatgtcttcatctgcaaatcgtggatttaagagtgctcattcttcccatatggcgcacaaagtcctcggtaacttttgattctctaaacttagaagcagtaggtggcgtgcgtcaccaatgtacactgtgcgttcctggaggagtcaagcagacccactaggaaagaggacgagacacaaggttaactgccccctcacctccgcgccactatttagaagcccaggaggtgcctcatccctgaagtcaacaggcttgacccccctagtctagaatgcctccacagtgtcaagggagagggcaggatgggaagcggatgttagaaaagttcaacattaacaaggcagggtgtcctgacacaccacttaatgaaaaaatgcaggcaaaacctactgtgtgtgtgtgtgtgtgtgtgtgtctgggaagagagagagagattcatctggaaagatgttcatcaaaatgtgaataacttatgggatttgagtgtacttttatttttactttatatcttacagatttgcaaaaaagaaaccttttacattttaataaaataagtgatacaagaaatctatcatttatttcattaaattttttttcaattaaaaaaagacccagaggaaggatagagagagtggagcagagatgaggccaggagggaatccaggtggagacaggaaaactggagacagtcggtgaggagagaggcctgggtgttggcagagggtggcgtgccctgggagtcacctcctggcaaggactgtgttgctcaggctgccaaggtcctcccagcttctcaccagcttcccagctgccctgcccgtgctgtgtaccctctgggtttccttgcacaatggggcggccatggagggtgggggcagggtgaccaaaacaggcagaaagggaaaaaacaagaagacaaggtccagggtcctcacccaaccccgccagaaggaaagctcgtgaaggcagcctttggaaggactctccctgggttctcttcttcccctccctggtcctcactcaaaggacagcttaatctctctctctctctctcttacacacacacacatacacacacatacacacacactgagttagggtttccagttcagggtgtgtgtgtgtgtgtgtgtgtatgtgtatgtgtgtgtttgtgttttttgtgtgttttgtgtgtgtgtttgtgtgtgtgtttgtgtgtctgtgtttgtgtgtttgggtgtgtgtttgtgcgtgtgtttttgtgtgtgtttgtgtttgtgcgtgtgttttgtgtgtgtctgtgtgtttgtgtgtgtgtctgtgtgtgtttgtgagtgtgtgtgtgtgagagagagagtgtgtatgtgtgtgtgtgtgagtggggtctcctgtggcaggaaggtcagccaagctactataatcattccagggaacatcactccctaccagcagagctgaaatcgcagctctcctgcctggctacttcccctggacaataacaaccccagacttcttgctacagaggaagtgtggctgcccacagttggtgtggcaactgcacagcctccacagttggatctgctgtccttgacccatccagggcctgtgctaggcccacccaagggctcctcccagtctccccctcccccatcctaggaactaacgttaatcccttttgattcccaaagccttaaagtgtcagaaccaaaccacctagccccattgtacagatgagaacaccaaggcccagagagcacaggcacttggctaaagtcacacagatgacagaatggtggaagtccagttctcttgcaggttggcttcctgacaccccagtgcactcccttcctctagagctcccccccagagcatcccctgaagagctcctctgtttcccaaacctgcctggggaggggaggtggggagctggaggtttcctgtctgggctgagagtgaaagggctgaaagaaggaacgaggaaggagcagccagcagccacaaaaggcttcaaagggcttgggcctccgccaaactggctgtgcacagcccagtggagcctgcgcccaccctgcggccaaggccattcattctctctctccctcacagaagcattaggagactagggcctgggaggaagcttccctgcaactccaggtcctgccacccaaggcgcgagctctgggaatgtgtcccgcctcctgctacagccccagcaggcaggaggcaaagcaggccaaccccaacctgcctgcagcctggagcaggattatgaatcagatgtggctctccaggttggaaggaatgtggatcatagatagagacactaaggcccaaggaagggccagagagtggcaaagacagcgcaggatccacgtgggtgatgatttttttcctgtaggtccctcctgacggcagaagccacctacagcttgaagtcttctttggcgaagggaaaagacaggagagagagagggaaaggcaagctcccaggttccctgttggcgcaggtggcattttggggggaaacagggttatgcactgtgggagattcgattcggagccaggggctgagcctaaggctgggatctgtgtggctgagatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggatt

SEQ ID NO: 512 - DNA, 28702 bp, Homo sapiens; identical to SEQ ID NO: 511

SEQ ID NO: 513 - DNA, 49337 bp, Homo sapiens
gtgcaggctgcggatccccgtaggcgagcgagcggctaggttcgtgatctggagagacgctcaggtaaggacgggtggccgagaggagtggggggcgaccagggacaggccgatccagacagggccgtgattcttcccacgactctccgctctggcgcaccgggttccggagctaggagagctgttgatcctgcgagtattgtctgggtcccggcagggcgcccgggagtactgagtggggcctaatggggtgtcgaactcccccaccccagccctcttcctccactatgggagttaccaaacggctgtcatcctttaaggttctttgcacaggacgcgataacagctgttccagagaaaagggggtgggggcgcgggagagcagttccttggtaggtagggttgccaaggttggttgaatccaaataactccagaaagtccagccttctgtgaaatagctagagacgggggtaagggcgacaaatctgaggttgcggttccagaaaccgaggctcagtaaactggaactccctcagatctgcattgtatccgcaccacccactatgctaggggctgtggagagactcacagccactcacccccaagacagggtatcagcatcacaactgtgccatgcgggcaaatctgagctttcttcaccctgcagttctttcttctggcctttttgttttgtgctcagccctaaagctgaaggagaggaacctccaaatacaaaccttgttggttttcgtgattcttgtggcattcaatgttaaatgcttctgccccgaggcttgtggcaattggttaatattgatgtcagtgcccttccctcctgtgtattttcgctgggaaagtttgagagataaggggagttgatgtgtacaacttagtttgaaaagaacttgttctctcctagccactgaaaaccgcgttgctttctgcttcccattcttcctttactgataatctggccatcactctgctgtttaaaagtcttgctagagtatggagacaagtagtgctatttctgtggtgagagaagctgccccagagcatacccttgaattgtccctgcacatctctcaggagtggccactcttcttgggtatgttggaagtggaaaaccgtaaagctttctaggaatattttttactgaggtttttttttttttttaacctcagcatcagggttggaattcactgaaatgccaaaagcagcaagggcaccgttctctgtgcctgtacacacctgccctcttctccctggagccaggcaaaaagctgcaaccactcacaattggaacgcagtaaaggttgagtgaattgtgagtgaatgaatgaatatgaatatttgggaaatttgacggaaaggggaaaatgcatttcatctgattggtggcactgggcaattaattgcagcacaaagagcagttattagaaacatattctgaaacctttggctaccacacattgggatcatgctcccagggaagaagtgggtgagagggggaagctgagctttctcagtcaagatatcgcagcataatctctaatttagatttcagggaattgcaaaaaggcttgttgccttttgaaatcaggtggtgatcaaaggaagggtccatctgttgaaaatgaaggaatttttttccaatgtaattgtaacctttagtcagagtacattcttttttttctgtctgttttgcctacatatgaatggcttaatcaggcagagttcaagctgcttgtcatttaataaatacaagatttatgaatgactcattgagggctttcaaaatctttgtttccacgcatttctaagtctggaaaacagctaaggggcaggttagcaaaatccaaggatatacataaatcatcagtgatggcaaagagtatataacacagaaagctcccctgtagtccatcgagcccagggacccatctttatggacaaacttatgtacggacagattctccctgaaatacagtaatgtatggtattagttgatatgtgctgtgtttgctggttaaacattatttttggtttcacaaacttgggttttatgaatgcagtgagtaagtttaaataaccaactcttaaaaaactataacttctaatttaacagagaggatagaccttaggcctgaacaaaaataacctcatgtattgttataggtattgcaatcaagcattagctaaattgaatttctgtttacttggattttcctggaacctcctcacctggatcttccaagctctgcgccttccttgattgcctttgaccgttctcagtctcagcatccttcatggctcctttttgtgagtctcccttgatatacctgtaactgctgggaggaggggattctctttctatctgtagcttcctgactgctcctgagcaccagagctgtgttgccaactctctcctagacctttcctctcagctatcccattgacaccttaaatccaatatgattagagggctgggcgccatggctcacgcctgtacgcctgtaatcccagcactttgggaggctgaggcgggtggatcgtttgaggccaggagttcgagaccagcctggacaacatggcgaaaccccgtctctaccaaaaatacaaaaattagctggacgtggtggtacgcctgtggtcccagctacttgggaggctgaggtgggataatcacttgagcgtgggaggcggagggtacagtgagccaagatcgtgccactgcactccagcgtgggtgacagagaccccatctcgttctgtttttctttttcttttttttttgagacggagtctcgccctgtcacctaggctggagtgcagcggcacaatctcggctcactgcaacctccgcctcctgggttcaagtgattctcctgcctcagcctcccgagtagctgggcttataggcttgcaccaccatgcacggctaatttttgtacttttagtggagatggggttttgctatgttggccaggctggtctgggactcctgccatcaagtgatccaccctcctcggcctcctaaagtgctgggattacaggcgtgagcctctgcacctgacccggagaccctgtctcaaaaaaaaaaaaaaaaaaaaatcccatttgattagaggtatgacctgccatcatctttcccttccctgtttctcatgacaggtttgtgggggattttgtttgtttgtttttttttgagacagtgtcttgctgtgtcgcccaggctggagtgcagtggcacgatctcagctcactgcaacctctgcctcctgggttcaagcaattctctgcctcagcctcccgagtacaggcgcccgccaccacgcctggctcatttttgtatttttagacaaaaatctctagacgaggtttcaccatcttggccaggctggtctggaactcctgacctcttgatccacccgcctcggcctcccaaagtgctgggattacagatgtgagccactgtgcccggcctaacaaattctatttttctgtacagggattcatcctcgtcttactgctagcatcactccagccattaaatgagatcttcctccacttcttccttttattctcctttaactgagtgacagaccctacattttaaaaatcacaatggctatctttgaataccaagtaccctgtccaactatactgtcactgcccagttcagtgcttcatattctcttactcagattattggagtttcacttcaaactccacatgcttaaacctgagctacttatttcccacccaaaacctgtttctcccactgtctcccctatctcagtttgtggtaactttatctttccagttgtgtagaccaagaatcttccagtaatccttaactcctttctttcacatcttatgggctgtatattcaagatatatcaaaattcaaccacttcttaccacctccactgtgacatctctggattagttcaagccttggattatccctaaagggttttcctacttctttcctacttcctgcttctttcctgttcctccctgtttctactccccaaggcaattttcaacaggacatgctgtgatgtttttctgtttttttgggttttttttgagacggagtctcgctctgtcactctgatgccaggctggagtgcggtggcgcaatctcagctcactacaacctccacctcctgggttcaagcaattctcctgcctcagcctcccgagtagctgggattacagacgtgcatcaccatacctggctaatttttgtatttttagtagagtcgtggtttcaccatgttggccagactggtcacgaactcctgacctccagtgatcctctcctcccgcctcggcctcccgaagtgctggaattacacgcatgaggcaacacgcccagcctgagtgatcttttaaaaatgtaaattactgtatgtaaatgtaaaatgttactgctctgctcggaaacctccactgtctcccctttttacttagagcagtgattttcaacctgtggtaaccctattcccctcccgcaggggacatctggcaatatctgtagatattttttgttgtaacaactctggtatagggtggaactggcatctattggatgctagccagtaccgatgctcctaaacaccctacaatgcacacagcattcccccacaaccaagagtcatctgatcaaaaatgtcaacagtgccaagactgagaaaccctaacttagagaaagaacccttgcagtagcccagaagtcttgatctgtcatccattacctgtgaacctcatctcctactgccttcctcctggttcactctactcctgccatattggcctccttactatcccttgaatatgccagacatacgcccacttcaggatctttgcccaggcagttccccacgcctgaaatgtccttcctttagatagccatgtaactaattccctacctcctccaatcctttgctcaaattttatcttctcagcgaggcctcctgtgaacaatatatttaaaaatataataccctctctcaagtggcactccaaattcatcttaccctgctccactttttactagacatattcaaattgtctctacaactgacttgtttattacatttgttgtttattacctgtatcccctactaaaatgtgagctccataagggtaagggctttgttctgttccccaatgaacctagaaccatgtttcatacttaatagatgttcaattgatatcttaatgacaaaaagaataaaagagtgatagactgaatgaaggttggttaaaggaatcacctcctcactgactttcctggctccactcactcccatccatcccgtactccattgtcagagtcatcagaaaccatcactgctttctcctgtacccatggaataatatccaaaaggcttccagtctcttggaagttcatattccccaaattaatctcaaatcctcatctagccccacctcctgctgcatcccctgggcatctgcttggccagtgcattgacaaatattaatagcagacttggaatgatgggaagttcagaaatactcttggctttctttcagaaaaacaggtttgaggtttgtggggttttgtttttgttttgtctaaaggagaaaaagaaaatcttcagagtcagggtcccctacagtgagatcagcaccattctggggcacagatagaggtccagacttttggaccactacaagcaatctaccactgagtgtggaggagaatgactgagagggtgaaggtgaggatgaagtcaggccctctggagccctcctgccccctagccctagagagtcagtctggatgtacaggagaaacttcctctaggccaggcgtcattggcctccagccttggtgtcatgcagacagtgtgattgcagaatggagggcagtcctcaaggcatgaccatggccctggccgtcagccccagcctgccatgcctcagtgctttccggatggctctctgtggagcagagtcaagggtcatttcccagatgtctctgaatgccatgctaacaggcctcagacccacccccgaccaacagcctcttgtgcagggccctgtgccttggcctcatgtgtgttcactcatctgtttgtacagctctcctggctggcggccatgcccttggccttgtcttatcacaagcttccctttgaaggcagagcccacacatcctttctgttgactttgcattgtacttgccatcatcttcccaaaaattactatgtctcattctaactcgattgtgagcaagaaaggaggccttttccacttgtttgcccacatccccctgatactggaattgtttattgagtaaacctaaagttcttcccattttgactccaattgttctcttcagcattggggcctcatcatcccctgccacctcctcatcatcgcggaaggttcccctgtccatccctctgcctttgcctccctgttaaattgtctctctcctacaatacatttttcagatgccaccctttcctgaaacttagagcccctgcgccacatattcccattgcactaaatcaaggccgtcattgtgtccagctttgattaagaaatttctgtttatggccaggcacggtggctcatgcctgtaatcccagcactttaggggccaaggtgggcagatcacctgaggtcaggagttcgagaccagcctggccaacatggtgaaaccccgtctctactaaaaatacagaaattagccgggcatggtggtgggtgcctgtattcccagctactctggaggctgaggcaggagaattgcttgaagctgggaggcggaggttgcagtgagccgagatcgcaccactgcactccagcctgggtgacagagcgtgactctgtctcaaaaaaaaaaaaaaaaaaagaaaagaaaagaaaagaaaagaaaaatctgtttaattatactaagtaaaataagccagtcacagaaggacaaataccgtacgatcccacttacgtggggtatctagaataggcaaataaatacacagagacaaagtaaaagcgagattgccaggggctaagggatagaggaggagttattgtttagtgagtacatagtttatgttggggatgatgaaatagttttgggtgcagatggtggtgatggttgcacaacattatgaatgtatttaatgccactgaatttgtacatttacagctggttaaaatgataactattatatatgttttatcacaatttttaaaaggtaacaaaaaaagaagtatttgtttaaatagtttttctttgtagattgcaagcttgtgggagtggggaaagagcatgatcttttcatctttacacagcacagtgctcgacatgagataatcactcactgttccttcagttcaggactggaaatcaatggaaaggaagaacagttaaggcaagctttccccatatcttttagaaggttttgaaatttcattttaatgtcaaatcagttttatcagagggaatcctgattagttgcagttgtttgtttggggatatttattgactttaaaagaaaacaaaaaaatgatactaaaagtcgtccaaaatgactattttcatagctttttgcatttatatgatgggtagcattttaacaaaatcaatttgagtaataataacttgtatttatataacacttagcagctttttcaaagagctttcatagcttgcaccatttgaagccacagaaagcgtcaacttctttttttttttttttttttttttttgagacggagtctcgctctgtcactctgtcactcaggctggagtgcagtggtgcagtggcatgatctcggctcactgcaacctacacctcccgggttcaagcgattctcttgcctcagcctcctgagtagctgggactacaggtgcacgccaccacgcccggctaattttttgtatttttagtagagatggggtttcgccatgttggccaggatggtctcgatctcctgacctcatgatccaccagcctcagcttcccaaagtgctggggttacaggcgtgagccactgcacctggccaaacttcttgtatagtgtaactgagcaactatttttcctgctccttgggttctagattcttgcataaatttaagggtgtactttaagcattaatcttaaccatttcagttcatattattgtaaccactcaagggattcttcctgcctgctgcacaaagaaagaccacggggcattgtaaccgcccagtgggttcacattgcccgctgcctggacagaatcgatttaccaagacaggggaattgcaatggagaaagagtaattcacatagagccaactgtgtgggagaccagagttttattattaaatcagtctccccgagcatccagggatcagtttttaaagataatttcgcgggtaagggcttgagaagtggggagtgctgattgctcaggttggagatggaatcatagggggttgaagtgaggttttcttgctgtcttttgttcctgggtaggatggcagaactggttgagccagattacgggtctgggtggtgtcagctgatccatcaagtgcagggtctgcaaaatatctcaagcgctgatcttaggttttacaatagtgatgttatcccaaggagcaatttggggaggttcagactctgagccagaggctgcacaacccctaaactataatttctaaccactagctaagttgttagtcctgcagaggcagactcgtccccaggcaagaagggggtctttttgggaaagggctgctatcaattttgtttcagagtcacaccatgaactgaattctttcccaaagttagttcagcctatgtccaggaatgaacaaagacagcctaaaggttagaagcaagatggagttgattaggtctgattttattcactgtcataatttcctcagttataattttgcaaaggcggtttcagcattgtagtaaagaaagagtttaagtagacacgaggctggccacaccatgtgggagatggaattagtactgaaataatctcctccaaagctcataggttacgggtttttcaaaggcagtttaggggaatgggtggaggtggctaggcttgctgctgattgtttgaggaggagatgagatcaaagtgtcctttgatttcaaaaatacaatgagggataagttgataggatgtctgggaatttgcttcaaaataagctggggaggaaaaatggcaggagggggggtagaagatgtataaataaaacttgattggccatgaacagacaattgttgaaatggaatattgggtacatgggtggttttattatagtgttctcactatacttgtataaaatttaagttttccataataaagtttttctttgttaagaaaaacaaagcagagtgagattctaaattgaagttgccaatggcctattgttctttaagtctgctcagttaattcagttaaggaagttatttgaaaacagggtgctaatgacgcggctttgttttctggggtaaataccctgggttcggtgtctcacacggagaagattaacgacagggacacacacgtggagttcaggagaggaaagtttaataggcagaagaaaggagagaggagagcagctctttctcttgcgagaggagagcagctctctctcttgcaagagaggcgtccaaaaatgggacaagtggcggactgcagcagattttataggcaggcttgaggaggcggtgtctgatttacataggggccacagattggttcgaccaggtgtgacatttacatagcacgcaggaaggctggtcgccccaccctaatcttattttgcaaaggggctttctacttggccagtgccatcttgtctgctccttactgtacacttagctggcaaagggaagatgaagccgccatttggaacatgcctagtcctatgtagtatttttctattggcacaactgccagcattcacctgtgcaagcttccagcttgcttgtctatgtctgcagctcaattttacaggctgctctttgttaggaaagaaaatgatttgggggctgctttttattaaaaggaaaaccttactgaggactcccatatcctcactatctgcctaagtaatttcttcttaactcctatatcactattatttagctcaaggcaccatcaagataatcccttgaaagttgattaccagtccatgtttgatatcctgagtcaaacatttgcatctcttaaataaggtgcattttgacatacatgctccgttcaaaaatgtatatacacaaacacacacataaaactataagcaggccagatgcagtggctcacacctgttatcccagcactttgcgaggccattaagcaggaggattgcttgagtccaggagtttgagaccagcccaggtaatatagtgagaacccccccccccgcccccgccaacccccatctctaaaaaaaataaagttagccagggatggtcgggcacagtggctcacacctgtaatcccagcactttgggaggcttgaggtgggaggatcacttgagatcagggattcaagaacagcctggccaacatggtaaaaccctatctctatgaaaaatacaaaaaagagcctctgcacaggtcggagggaaagaaaggagttggaagatctgaagcccacgtagctggtgggcaggcaggagtgcaaatggatgtgaggccgagatcttagcaggcccagagcacatggccttgcagccacaccacagtcatggttgcacaaaggatgtcctgaacatctgtttgaatgtgtctcaagtactcagactaaacacttctaaatctgtagtggaatgaatgtgtaaccaagaagaattgattttttttttttcaaaatttcagaatggaatagggatagttttcagggaaaatggatgaagcagtattgtggtggggaaagtgttcaaagttaatattaccataacttcagaacaccatagtgaataccttggaaagcatcatcttcatcttctgagactttgactgtgaccatgtgaaaggtagagagagaattcaggattaactttgtctgttttcccatgttcaagggccattgtgttacacctaaaattggcaaagagtcatagattatatttaagctcagatttcaaaactgtccatgactattttggcaggatgtatcttgggttttttgttttgtttttgtttttgtttttttgttgttgttgttttgtatgcaatctagatgcagatgtttgtttttagtcagcctggagggagctttaatgttggggttcttcgtacatgtaaataccatgctggataattaattgggatttcctggagcaatttttttttttttaagaaactgtactgtaaacagtttttcattcttgtggataaagagaagcttttctctggatttctaatattcgccaaccctgagggaaaggcaaagcatgtgagtcagtcctcaggaccctccctgccctccactgaggggaccaatgagtttgaggaacaagagtggataaaccgttgactctcatctgccctccctccctccacctcagggtgtgtactgctagtctgaatattgtcctgcttagaggtttctccatcatcttaagtttctgttgtttacagctttccctcctctgccctcatccctctagattattaagttcctgcaacttaactgggaactgatcaagatttcaagctaaagatggtggtgatgaacagcctgagggtcattcttcaagcctctccaggcaaattgctgtggagaaagttccagattccgagattcatgccagcgaggccctgcagcctctatacttgtacttacaaaacccggaaccgagcctgtgagtacaccacttccttaaagagaacaaaaagggctccagcctgagtgacagagtgaaatctcatctcttagaaaaaaagagaaaagaaaagagggagcaagtgtgcaagagcaaaaatactcatctttataataatcacacatgttaaacatttgtagctatgctgtctttggctttccagtgtaggattatatgccttatgaactgtgagaataactgtttctctgttgattcatgaaagtaaatgtagaatgttctttcttgactaattttagcatgttaaaatgatgtcatgcagaaactggacaagagacagatcccggtttttaatattttggaacctgttgtttattatttcttggtagcaattgtctttttttttttcttttaaacaaaggttgatccacaaaccacaaattatttctgggaaccttaagtttctggaagttgcatgtaaatgtttgtaaacagtttactagcttcaacgttctggaatattctgtcctgagttaggaattactgaattaattctagctgatcagtttgcaagtgtgtgctctgctgtaaggatggaagattgagtgaggcaggaaatggtcttcctcacacctctctcatctcgttcccctcctggaaatacaaggcattgcccatgtccggatgtggcagggattctccactgcggcatgatggacattgaggatggatcattgtgtgttgtagggggttgtcctgtgccctggagggtctttagcagcattcctggcctctgcctactagttgctagtagcaccctcatgaagctataacaaccaaaactgtctgcagacattgccaaacatgctctgcgtgactgccctagagagggcagttgagagaatgggaaaggataatgtgtgtatttgtgaacagataactttgagttaatgaagagatgaaatggctaagtattatcattaaggaggaatttttcatgttttccattatttaaaaaacattggcacagagttttcaaatgttggactgcactgaggtctaggtttctcccctttagtgtttattttctttgaccccatatgcacataataaaaagactgagtaagaatggaatgcttgtaaattagtaatgctaatctagctacatccaagggcttgaaactgctctacaaatatattttcactgtaagtttattttgtttccttcaacattgactgtgttctttttcaaataaacggaccagaggcataataaatttctggttgctaggtgtggtttcctacaaacatgccacatcctactgagactggcttattctgaacactggcactttgtggtctatggtttatattggaaagtattaatagttttgctttttttttttttgacagttgaaattaaacatccaaatccggtatacgtatgtagttaggatagtttgctgcttttagtgctgacaaaaaaaaacaaacagtagtggcttcgggaggggcagttttacttagtgaatttcccacaacagatgacatgttcttgtttctaagttactaggaaaaacaggggacagtcaccatttgattttgtttgtagcatattatactgttccaacctgtttgccccaagaataatattgtggtctttgctgctctgggccttcgagccggtcctgtttctatgttctggaccctcgtctgctcaattgtaaagacaattctcattgtttctgacagctcaataccccaacagaaggccaatgtacacttgtgaccaagaatgaccccagattcttgagggtttgaaaagataacgtgttaatgaaaaaagccaaattctaaaatatttgaagaggttcattctgagccaaatatgagtgactgtggcccatgatacagcctcaagaggtcctgagaacacatgcccaaggtggttgggttacagcatggtttagggagacagaagttacacgcaagacataaatcaatacatgtaaggtatacattgtgaggacgaaactctgattttttttttatcttgcccaaattcctatctaaggggtctggggagtcatgccccacaaatcataaattctcaccagatgggttttattcaaccctatatatcgtgatttactttccaagctgactttggcataacattacaagacaaagaagaaaatcaaaatattttaccccaaaacatgtttctttgccatgttttgaaatagccctgcaaagctgttctgcatgggggaaaatttgtatctgtaaagaatctctgggccaggcgcgatggcttacgcctgtaatctcagcactttgcgaggccgaggcgggcggatcacaaggtcaggagatcaagactatcctggctaacacggtgaaaccccgtctctactaaaaatacagaaaattagccaggcgtggtggtgggcgcctgcagtcccagctactaaggatgctgaggcatgagaatggcgtgaacccgggaggcggagcttgcagtgagccgagatcgcgccactgcactccagcctgggcgacagagcgagactctgtctcaaaaaaaaaaaaaatctctgttaacatagctagatcttttttttccagaccctcccaatcctaaagagattaactaagatctgaataggaaatatttctcatctattgtctctaagggcagctactataagacttcaaaggaactttgatctccacaatctttatcttaacctgaacattccctttctaccaatcccaggtctttagacaaactcaaccaattgtcaaccagaaaatgtttaaatttacctatagcgtagaagcccccccaacccccaccccagctttgagctgtcccgcctttctggaccaaaccaatgcatttcttaaatgtatttgattgatgtctcgtgcctctctaaaatgtataaaaacaagctgtaccctgagcaccatgagcacatgttctcaggtcctcctgtgggctgtgtcacaggccacagtcacccatatttggctcagaataaatctcttcaaatattttacagagttcgactcttttcgacaacacttggtttggcctagaaaggtaggacatctctaagcaggggcttacaggtcataagtaagtggattcaaagattttctgtttggcagttggttgaaaaagttaagctttgcctaaagagttgaagtcaactgaaagaaatgcttgagttaagataagggggattgtagaagccaaggttcttgttatgtagatgaagcctcccagtagcaggcttcagagagattagatggtaaacctctcttatgggaccttaaaaggtgtcagatctctcctggatcaggaaaagacctggaaagggacaggggctctctacagaatggacatttctcccacaagggatggctttgcagggccatttcaaaatatgtcaaagaaatatattttggggtaaggctgggtacagtgactcatgcctgtaatcccagcactttgggaggccaaggcaggtggatcacctgaggtcaggagttcgagatcagcctggccaacatggtgaaaccccatctctactaaaaatacaaaaattagccaggtgtggtggtatgcacctgtaatcccagctactcaggaggctgaggcaaaagaatcacttgaacccaggaggcagaggttccaggtgagctgagatcgtgccattgcactccagcctgggcgacaagagcgaaattctctcccaaaaaataaataaatgaatttcggggtaaaatactttgatttctttcagagcctgctgtctgtcatgtgatgctctaccagggtcaggttggaggtaggtattgtattgctacaaagattctgttatgtcagtcttatgatctctatttgagtgttaaagctggtcagttgtgcctaaactctaaagggagggtatataatgaggcatgcccaacctctcttcccctcatggcctgaactagttcttcaggtttctttgggatccccctggccagggtaggggggatccattcagtccgttgggtagcttacaatttcatttctggttcacatgtgcaaagtccttagctagtgatgtcacgcagtgaggactcagtgttggcagctacttctagtactacagttgttatcatcatcataggctcagtgcctgcctcagatgtttaaatctgaccattttaagaggaggcaaagcaaaataaggagtgaatgaaagtaggaggttgtggcaaattcggaaagcagcatttcaggtcagccctgtgctctgtgctcatcatatctttgaatctttggctgtcaactcagattgctgtttggtgttatctcaggtagcagacagtaactgttgatagtcctaactttggagacttgtaatataataagataaagataaaagcctatacctattatccaatgtggaaataaaatcagtttcccttaggtatcatctggtgaaatttagtctaatggtcacataagaagatttaggcatgagatcttagaccataggaaagtgcatttaataattcttaattgaatgaaatataaagaatatcaggtaaaatggaaatgatactgatttgttattccaatgattcttaatgttgatgatctccgtacttgtagaagaaagataaacatgttaggataatagggactaaagaagccagcagtgtataaaatgcagccactaaccccatgtgggtatttacatgtaaatttaaattcattaaatttttatagctacatatgcctagatcttaatatactggacatttctatcatcagagagggttctatttgacagcagtaatctatatcataactgtactgtgtttgaaagcttttctattatttctccaattaattttgaagaataaaaataaagcctggagagtaagaaaaagcttgttttgcagtgttttcacaaagaattctgaaatatagactcaggatgcccctagattgtcttttattaacatgcaagtaaccttgagaaaaaatgagctgattaagagccacttagaattgcattaatggcctcagggttatcttcagctgcctgggactgacaaatagccctggaactgaccatcaggaaatgtgggctgtagtctcctgtgctgataactgcacaggtatcctgtggctaatggactcagcatccaagttccttttatagccctgatgatgctctaacaaggcaatttgtgattctgcgatcatcctcaaccaagtcatatggagggtccctgtgtatacacccatcactgcattaaggccaaggcctacacggatatcttcagtaacatgaggaagtagcacatccctcataaaaagggcagtgcatagcaagggaccagataaaaagcacatgagggtataaggcaatgctttccggtagataaataacgtaagccacaaatatgagccgtatgggtcattctgtattttctaataggccaggtacagtggctcatgcctgtaagcccaggactttgggaggccaaggtgggacgatcgcttgaggccaggagtttgagacctgcctgggcagcatagcaacaccccatctctacaataaaataaaataaaaatatgagtaattctatattttgtaataaccgcatcttaaaaagtgcaagttaaacaggtcaaagtagtttgactaatatactttatttaaccaaatatatctaaaatattatcactttaacatgaaatgaatataagaattataaatgaaattttaatattatttattttgtactgagcctttgaagttcctggtattgtacatttatatagtacatctcaatttagactagcacacagggacagtgctaccatattggggagctcaggaacagagagaataggtgttgaggagtaagaacagttgaaagatgctttatttaaggtgggagtgtcagagaaggggcttgaactgaccttgaaagcctagtagaattttaaggaacaaacgaataacagatagatacgattaggtgaacctaagaagtgttcagggtaaaccagcttgcctggtagagagatggtggctgtgaggtaatgggtagagagccttggtatcaatttgtttggttttctgtatcagtaaaataagcatttagtacctcttctgtgccttgtaccaagtaaagccctggagactatagaaaaagtggaggacacagacctcatgggcttggagttgacacaggccctttgggcagataaagcaaacacagattacctgaggaatggttggatgctaaatggtatgaaagcaaattcagtgtgtgttcagaaaaagcaaagctcaggatggttggagaatatgtcatcagggagataagacttgaactggaaaagatttctataagtgttaaggaaaaggaagggcttctaagcacaagccaaagtggggctaaaggccaggtgtgggggctcatgcctgtaatcctagcactttggaaggccaagacaggaagatagcttgagcccaggagttcaagaccagcctgggcaacatagtgagaccctatctctacaaaaaattttatttaaaaagtttttagccaggcgcagtggctcatgcctgtaatcccagcactttgggaggccaaggcgggtggatcacaaggtcaggagatcgagaccatcctggctaacaccgtgaaaccccgtctctactaaaaatacaaaaatttagccgggtgtggtggcgggcacctgtaagtcccagctactcgggaggctgaggcagttgaatggcaggaaccggggaggcagagcttgcagtgagccgagatcgcgccactgctctccagcctgggcaacagagtgagactccgtctcaaaaaaaaaaaaaaaaagtttttaaaaaccaaagtagatggccgggtgcagtggctcacacctgtaatcccagcactttgggaggccaaggcgggtggatcacgaggtcaggagttcaagaccagcctggccaagatggtgaaaccccatctctactaaaaataccaaaaattaggccaggtgcggtggctcacgcctgtaatcccagcactttgggaggccaaggcgggcagatcacaaggtcaagagatcgagaccatcctggctactgaagacatggtgaaatcccgtctctactaaaaaatagaaaaattagctgggcattatggtgggtgcctgtagtcccagctacgtgggaggctgaggcaggagaatcgcttgaacctgggagtcagaggttgcagtgagctgagatcacgccactgcactccagcctagcgacagagcgagactctgtctcaaaaacaaacaagcaacaacaacaacaacaaaaacccacaaaaattagccgggcatggtgacaggcacctataatcccagctactcgggaggctgacgcaggaaaattgcttgaacgcaggaggtggaggttgcagtgagccaagatcgtgccactgcactctagcctgggtgacagagcgagactccatctcaaaaaaaaaaaaaaaaccccaaagtagacataaacttgtgtaggcaggcagttgtaagaagagtagcatgctaaggggaacagcatgacaagaaaagtacataggaacaccagagtttgggaagaatgaggaaaatgagattagataagtgagatgggttctaataggaaaacctgggcattgaacatagaagttacaacttgatatactgtttttagcgtaggagcaatgtgacaaaggtggttatttaggaaaattgctgagtggcagaactcaggagtagaggagagttagaaaagaggaaaagcaaccaagaggctttgtatgaagtctgggggttagggttctgaactaggccgctgttctgggaaaggtgaagaagagataaacctgaatgattcttaaagaaaaataatgaaataaagcaaaaaggagaagcaaactgtcttattctgtttgggctgctataacaaagtacctcagactagataatttatacacaacagaaatttgttgctcacagttctggaggccaggaagtccaaaaaaccaaggtgccagtagattcagtgtctgatgagggttctctttgcttcaaagaatttgccttcttgctgcatcctcacgtggtggaaggagctcagaagctttctcaagcctcttttataagggtattaatcccgttcatgagagctctgccttcgtgactatgtcacctcccagtggcctcagctcttaataccatcaccttggggaaaaggatttcagcgtgtacatttttgggttttatttttttatttttatttttttattttttgagacagggtcttgctctcttgcccagactggagtgcagtggcacaatttcagctcactgcaacctccgcctcccgggttcaagagattctcctgcctcagcctctcaagtagctgggactacaggtatgagccaccacacccagctaatgttttgtatttttacaagaaatggtgtctccccatgttggccaggctggtctcaaactactgacctcaattgatctgcccaccttggcctgccaaagtgttgggattacaggtgcaagccactgctgcctggctaaattttgaggagacgtatacattcacaccatagcacaaatcttcccagtgatgctcctcatcttattccatccacaagtattaaccgaaagccagctggcttacagagcagtgaggaaggcagataattagacacatacgcatataattataactgcacctatgtaataaatgtcatgaaagaaaaatcggagtgctatgatttaaaaattataatatgaagtgatcatattataagagagtagccagaggtcactttgtcaaggaggtaacaattaagcccaagacctaaagataatgggagccagccctgagccaaatgaggggtagttgatttctgtggaggaggagcacgaagaaagggactaaggcaggaatgagctttccgtgtttcaagggctgaaagaaggacagtgccaaagctggggaaataggtggttgcagcaaactgaatgttcatgaccccctaacatttgtgtgttgaaatcctaaccaccaaggtgatggtattaagaggtggggctttggggaggtgattagatcgtgagggcagagttctcatgaataggattagttcccaatataaaagagaccccagagagctccctcgtaccttgtaccatgtgaagacagcaaggaggctgtctatgaaccagaagacaggaccttgccggacacccagtctgctggtgcctcgatcttggacttcccagactccagaactgtgagaaataaatttctcttatttataagccacctagtctatgacattctgtcatagcaggctgaatggactaagacagtgctaaagcacaaaataaaccaaacctaggactactcatataaacaactaaaatcaagcacttcctcaacatggaatcctttgcagggcttttgttgcccatcagctagaaattactgacaccttttttttttttttttttttttttttttttttgagtcggagtcttgacctgtcgccctggctggagtgcaatgacacaatctatctcagctcactgcagcctccacctcctggtttcaagcaattctcctgcctcagcctcccgagtagctgggattataggtgcgcaccaccacgcccagctaattttttgtatctttagtagagatggggtttcaccatgttggccaggctggtcttgaactcctgacctcaggtgatctgcctgcctcggcctcccaaagtgctgagattacaggcatgagccaccgcacccggccaacactttcttaatgacagtatgcctttgttagcataaaccacagttgataaaatcattatctgtttatttcattttccctatacaagaagaacctgaaaatgaagcttctgttagaccacttaatcatcttatttttgaggtaaaatatgagcaacaaccaggaaattgtttcgatctgatttttgcttaaatagaggaaaaggaagggagtaggagagaacaaaagtgtcagtttatctttagcaaaacaaacccttggcaaaaaattggcttcagtaagggggcagtgaccaaggaccccctccccacacagtgagttggatggtctaacctagatggtctagtttagtaaaggaggagggaggtgggtaggaggaaagaaaccttctggaagctgaacttgtaaactcaagggcataaactgatcttgtcattatggtcattaaagagcaattgaaggaacaggctcagttttcttgggctggtatttgcatgagtgtgagtgttgatacttcccatttcatgcatgagatggggaaaaattaaggatgaccaaggcgtcgtcttagggacctaatcactccagttcttccctagttgtcacaggagaccctcattgaatggctttgaagagtgtgtactctcaaattatcagccacagtctgagtgtctcagaggggaaggtgcatagtctctttgtgtcaggaatctttacaaacagaatcagggcctttcaagggctttctagaagttaaaaaattaacacaatttgaatcatttttcagatcatttgaatcctttcaagtcatttgaatttgagcttttcccccccaacaatggcagttggatatgttacagggcatatgtttattttattttttatttttgcctttaaaagagatgtttattcatgatgaatatgaatccaagtgtttgggtggatataacagaaccaaatgtaacagaaatttaagatcatctttccctctaagatgaaaaatacggtatattatatgttattggataaaattactaaacatttttagaccctgaggttgtatattttatgatgttggctgctgcgtagttgccatgattgctttttcaaattgttaatttctttcttttttaaaatttctatttttattttacattcagggtttacatatgcagatttgttacatgggtatattgcatggtgatgaggtttgggcttctattgatcctgtcatccagatagtgaacatagtacctaataggatgttttccagaagggcatatgtttaataagataccacagggcaacaaaaaaggaggaagatgtggctcctgcccacaaggaatttgcattctaattagattatgacagtatggcccagattccatttcagatgtgccagttcatgtgcattttccattttagttttctgaaacagaaacttcttgttctttaaagttcttgttcttcacaagttgttttatactgaggaaagaaaaaaacccagaacattgggttcagacctctccagagatgacagtactgcattatatgaagaaatagaaagaaaagagtattatgagtttgcatgcaccttttatctttagaccagggtttatcaactttggcactattggcttttgggtcaggatgcttctttgtcttgtcggggggagcccatccagggcattataggatctttagcagcatccctggcctctaaccactagatgtcactagcaccctctcccagttttgccatctgaaaatgtctccagacattgccaaatgtttttgggggactgaattgctttctctgttgaaaaccactgatttaggcactctcaggagagctctttgtctgtattgctggagcatttttataaataaaacaaaacaaaacaaaacactgaggttaagatactgacttacggtcaggcgcagtggtttgcgcctgtaatcccagcactttgggaggctgaggtgggtggataacttgaggccaggagttcaagcccatccgggccaacacagcgaaaccccatctctactaaaaatacacaaaagttagccgggtgtggtggcatgcgcctgtaatcccagttactcaggaggctgaggcaggagaattgcttgaacccaggaggcggaggttgcagtgagccaagatcatgccactgcactccagcctgggagacagagcaagactccatctaaaaaaaaaaaaaggtattgacttccggctttcagcaattaccgaaggaagaggattatctgctctgtcagagtaaaccagaggcaggtttctgcttttcatggaaataggagatgatgctgccatacgtgagggatttgacagagtaacaaaacaactaccttagtctcatccttattctttttttttttgagacagagtcttactctgtcacccaggctggagtgcagtggcgcaatctcggctcactacaatcgccatctcccgggttcaagcgattttcctgcctcagcctcccaagtagctgggactacaggcgtgtgccaccacacccggctaatttttaatagagacagggtttcactgtgtctcgatctcctgacctcgtgatccgccaaagtgctgggattacaggcatgagccaccatgcccagccagtgtcatccttattcttagtggtggggcgagatgcagagggtcgttggtaattatttccttcatgtttctcctagttttcctgttgttcttgattctacccatccatggtacttctaaaggacagggaaatggaccaccccaaactgatgtacattggttctgctcatcacacttgggggtctcaacaggctgatctgtgttatcagcaagtctgctgatacttatcagggacttgctacagagacctggtgcttgactctggaagaaaatcagcatcagcaatgtcttcagtgcctgtggaggataaattatatgtgtacaccttaatagataatctccacatccctgtgacacactgcaacctccagggaccttagcaatgccgatgttctacccaggttttgcaggatggctgcctggtcctcagagtttgcttacataggaggtgaactcaactcagcacgcacagttatgtggggcgagcatcttacaggatgcaggctacgcaagcctttttttctaccagccaaccaattaaacgctgacaatactgattcaatgtttcctttcccaaagttctcccatttccttttttgaaaataaatctgttattgaaaattgaattaatttgtctttgtatttaaagccactttggggagttgggggttgggaaattctcgatgaagaaaagaaactcatttatgaataccctatttccacatggcaccaaactccatgcattatattgtgatcacagcactgattgcacttggtttaggtgagcttagtaagcagactgagatgtgttggttttgcaagatgccaaaatgctattcctctgccaggtgctctctgacctatctttatcctctacttttgtgtatccattaaacccctaagtggctgtattggtcagggttctccagaagcagaaccaataaggtatatagagagatggatgagagggaatttattagtggaaattgctcacatgattatagaggctgggaagtcccatgacaggccatctgcaagccagagaccctgagatactggtagtatgggacagtccaagacacaggccttagaaccagggaaactgatggtataactctcagtctgaggccaaatgcctgagaacccagagaggtgctggtgtaagttctggcgtccaaaggctgggaagcctgtagctgttacccaaggacaggagcagaagagtgtatccaagattcagcagatagatggacacattcagtttttccatgtttttgttctctctggccccccagcagtttagatgatacctgcccacattaagggcagatctttcccacctagtccactcagaattacatgctagtctcctctgtaaacacccccagagaaacaccccaaaataatgctttaccaggtttctaggtatcctttaatccagtcaagtcagcagctaaaagtaaccatcatagtggctaattcctaaggcttttagtttccattagccctgacaggttctctagaagtacagtagacaggcttttttttttttcttttgagacatggtttgggtctgttgcccaggctggagtgcagtggtgctatcatggctcacaacagcctcgacctcccgggctcaatcctcccactttagcttccccggtagctaggactacaggtgtgtaccaccacgcctggataattttttgcatattttgtagagacagggtttcgccgtgtttcctaggctggtctcaaacttctggcctcaagtgatccacccgccttggcctccccaagtgctgggattataggagtgagccactgcactcggtccaacagtcttgataataggctgacctgctttctcctagtgcatccactctgggagagcgtggacctggttcctgggggcgatcgccagtcacccatcaacattcggtggagggacagtgtttatgatcccggcttaaaaccactgaccatctcttatgacccagccacctgcctccacgtctggaataatgggtactctttcctcgtggaatttgaagattctacagataaatcaggtgagggcaagatctggtggtcttgtaaggagttaaagaaacagtgtcatgttaacagaggacacatcaaactctctccatgatagtattgacctctttgtgagcaatggcatggaactcattgatcttaactttttgaatgtgtgaaaaaaaattccttctagtttttatgcatattttcttcaactagtataggtagtatttttaattaataaatatatctctatctctctatgtatagatttataattggtatagagcataggtgtgcaatggaagttttaccagaaatttattttgtatgtgtatattgaatatgtactaatttttttcctttgcttgttgactttatgagaacttttacattaaatagtaacattgtttaatcagagttaacttagcagattacaatacacttgaaatggggccaaaaggatattcatgtgtgcattaggttgcaaagactagtcatgtattagagaaatggaaacttatgatctggtaattttgttaaataaacagtgttacctacctagtttaaaagaaacacaatttaaaagagtttttaaaattcaaatattatattgattttgaatcttttttttcaccttcctggatgtaaactaatgtgaatgatttcaaagtttacctgaaacttatagtgtctatggaagacagaaggtggttaattttgtgaaggtttattttccctttttttttgtttgcttgtttgttttactgcatttgatgatgtcaaatagtccaaattagtctcaaaataattattatttggaatagtttaaagtggttatcaaccagtggtaattctgccaactttcccccatacccctccatatccctcactccccgctgtaggatccgaaggcgtttttcattgtcacaacttgggaaatgaaattggcatctagtgtgtcaaagtcagggatgccactaaagatcctgcagtgcgccggatatccttaacgaagagttgtctagcctgcagtatcaatagagctgaagcggagaaatcttgatctcaaggaaacttgttttctctcatgaatgttaggaaatgagtccataaaaatgataatgaggccaggagcggtggcttatgcctgtaatctcagcattttgggaggccgaggtgggtggattgcctgagcttaggagttcgagatcaccctgggcaacatggtgaaaccccatctttactaaaatacaaagcattagccgggtgtggtggcgcatgcctgtaatcccagctactcgggaggctgaggcaggagaattacttgaacctgggaggcagaggttgcagtgagccgagatcgcgccactgcactccagcctggcatcagagtgagactctgtctcaaaaaaaaaaaaaaaaaaaaaaagtaaatattcactcctgcatttatcctggctctgagtctcaactgtgtctttgttttctttgtattttcctagtgatgctctgatacttagacatggcactctggcctaactacaaacagactgctcctccagtgggcttaatctctgtctggttttctcccttctgatatgtgtctctgccatgattcagaaggtatttgagtctgtctaagaatttaggtgtttccatgtccccaactttcctttctcctccatggtatgacgcagccccaaaaccatgaacatcttactttcatatctcaaagtaggaagttctttttcccccagattcatgggcatctttcttttcccccctttttttgcgttgttatttatttaaattttatatttgtgaattcacaggttgatgtgtttcattatattgtttctaattctcttaaagtaacttactatacaagtaaaagcttcttgtaccacataaaaccatctcatgtgccatcctttgggaaacattgtttaaggccatctgggtctgttggtggaatagctagagaagggaggaataaaaaagataagaaagaaaaatgatactgatatatgttcttttaaaatatatttagtgggtataagtttagttttgttttgttacatggatatattgtgtagcggtgaagtctgggcttttattatacccctcatcatgcatctttcttaatttccccaaaactctagagtgtgcccccttctcaactggaagtccataatattaccttgtttatacggattccagaaatcttcaaaacaacaagctaaattcctgtgttctggatgactgtctggcactctggtgagctctacttgtcccccatggggctctaccattatccttgccagacgtaaactaatgggcagacccagtctataggataccaaccctcatccatttactctgcatgcatagtaatccttttgaattctcaaccccatctagggccctagcagcctgctttcttctggggatccttggtattggtcagctttctaaagcccttgacagtatagggactgtctgttgccaatatatcattgcttcattgagttggaagtcttagaaagttgcttaatgagtttcttaactaagtgacttgagcccaagaactttcagggtaaatagctgttttatcttttagtcctctctttttcttttgaacaatagattctagaatttttttttttttttgagacagagtctcgctctgttgtccaggctggagtgcagtggcatgattgcagctcactgcagcctcaacctcctggactcaagcaatcctcccacctcagcctcccgagtagctgggaccacaggcatgtgccaccacgctcggctaatttttttgtttgtttgtttgtttttgtttttgtttttaagacggagttttgctcttgttgcccaggctggagtgcaatggcgtgatctcggctcactgcaacctctgcctcccgggctcaagtgattctcccacctcagcctcctgagtagctgggattacaggtgcctgccactacaccctgctaattttcggtatttgtagtagagacagggtttcaccatgttggccaggctggtctcgaactcctgacctcaggacctcaggtgatccacctgcctcggcctcccaaattgctgggattacaggtgtgagccactgcacctggcctttttttttttttttttttgagatggtgtctcactctgtcgcccaggctggagtgcagtggcgtgatcttggctcactgcaaccttcacctcctggcttcaggcaattatcccgcctcagcctcctgagtagctgggattacaggcacatgccatcacacctggctaatttttgtattttagtagagacgggtttcaccatgttggccaggctggtctcaaactcctgacctcaagtgatctgcccaccttggcctcccaaagtgctgagattataggtgtgagccactgctcccagctccggcaaatttttgtattttttgtagagatggggttcctgagatcaagtgatcctcccacctcggcctcccaaagtgcttggattataggtatgagccaccgagccaggcctcaagaattcttatctacccatttgcatgagtaatcttagatggaaaacaagtcatcaacgtttttgtcataatagcttctttttagatacctacaaacccaactgactaaatcaccccttgaacctgtcttccctgggagtgtcagtcacacacttacaaaatatgcaagaaaacttgtagagagtttgctaatttttttgtttggttagaaagaactaaaactgatagcccttttaaattatgctttaataattattttctttaagatagcatcaatttttagtaattacctaattttctctctctctctctctctctttttccacctttcagtgactgcctcttatttcctgtttattctttgctgctatttctccatgttgttgcaaaacaatcaatagcatgcaaagaggaaaaaaagagtgaatgaacataaaaaataaaaagtgaaagaaagcaagacattttagaaacaaaggcaagaaacaattctagaaaagtaaaaacctaataaatatcgatgtctataaatttcaaagacaaaaccctaagaaatgctgccacagtgtgctttgtgaggattggaataaagtgcaaggaaaaggagctggggaaggtatgtgacaaaaacatcataccagtccttttgggatgcagctaaagcagtgcttagagggaaatgtatagatgaaaatgcctacaatagagaagaactttctcaagtcagtatctcagctttccgccttaagaaactagaaaaagaagaacaaactaaacccaaaagcaagtagagagaagggcataataaagaacgagcagaaatcaatgaaatcaaaagttggttctttgggaagatcaacaaagttcacaaacttttaattgggggagaccaagaaaaaaataaaagaagactcaaattactaaactctggaatgaaagagaggacaacatgacctacctaccttgataggattataagagaaggtatgtgaacatctcataccgcagtcctctcctgggtgttgtttggtatttggttcccctgagtaggacaccgttactgatttgaatgagtgcatataagagagtcgaaatactgtggggaagggcactaaattgtccctggatgatccctgtcaattatcatctcctctggaattcctcttattggcactgtcaacaggcattaaggagatggagaggtgagtgcctttgttctcctcctcagggtgcttcctgctccatcctgcttccctgactttacacttctttgcggcagtgccagtgaacctagtaagaatgctttcacaaacatttaagttctccttccctgttttaggtcctacatttactttaaaacacacatacacagtttaaaacacacacacacacagtttaatgatttttaaaggaaatttacagagttgtgcaaccatcactatagtctaattttaaaacatttccatcaccccagaagcattccttgtgtccatttcctgcatttgcttttatttatgtgggttctgtgtatttcctttctcttcaccatccctttctctgtcagctccttctctttcacattgaaaaacaaaaggagggagtgaatattacagattgcttactaccagccagactctctgctgaatgttttatatttgttatgtaatttttttagaagtttaatcctttctcatcttagagcatggaaagaataaaatatcaggccaagcatgatggctcatgtctgtaatcccagtgctttgggaggccgatgtgggtggatcacttgaggtcaggagttcgagaccagcctggccaacatggtgaaactccttctctaccaaaatacaaaaattatttgggcatggtggcacacgcctgtaattccagcttcttggggaggctgagacaggagaatcacttgaacctgggagttggaggttgcagtgaggcgagatcgtgccactgcattccagcctgggcaacagagtgagactctgtctcaaaaaaaaattaaaaaataaaagaataaaatatcaacaacctcaaatacataagtatatatttatttgatatgtgttatgactgctttgctttccaattcactatcttctgtctacctgccccatttctttgtttctttcctttttttctgtagagactgggtctcactatgtttttcaggctggtctcaaactcctggcctcaagtgatcctcccaccttggcctcccggagtgctaggattacaggtgtgagccactgctgggcctgccccatttcttgatgactatatttccttctttcctgcattcatctgccccacccaaccccacctttttcctttaatcttgctgaggttaccagtgacatcccaattaactagcctgacagctgcttgacagtctatttctctctctctctctttctttctttcctttccttttcttttctatgttttatttatttttattttttagaaagagtctttctctgttgcccaggctggagtgcagtggcgtgatcttggctcactgcaagctccatctcccaggttcacaccattctcctgcgtcagcctcccgaggagctgggactacaggcacccgccaccatgcccagctaatttttttttatttttagcagagacggggtttcaccatgttagccaggatggtcttgatctcctgacctcatgatccgcccgcctcagcctcccaaagtgctaggattacaggcatgagccaccgtgcccggccaaaaacatcttatctgggccagccgcagtggctcaactgcctgtaatcccagcactttgggaggctgagatgggtggatctcttgagctcaggagttcaagacaagcctgagcaacatgacaaaacctcatctctacaaaaaaaaaaaaaaaaaaaagcctggcatggtgatgcacgtctgtagtcccaactactcaggagactgaggtaggaggatggcttgagcccaggaggcagaggttgcagtgagccgacattgtgccactgcactccagcttgggcgacagactaagaccctgtttcaaaaaaaaaaaaacacttgtcaatattttgcctataatatattggtaataatttgtgtgtgtgtgtgtgtgtttgcgacagagtctcggtctgtcactcaggctggagtgcagtggcacgatctcagctcaccgcaacctccgcctcctgggttcaagtgattcttgtgcctcagccacctgagtagctgggactacaggcatgggccaccacgcccagctaatttttttttttttttttaatttttagtagacatggggtttcaccatgttggccaggctgatctcaaattcctgacctcagatgagccacccgcttcagcctcccaaagtgttgggattacaggtgtgagccaccaggcccggccagtgtgttttttcaattgacatatttgtatacatttaccaggtacaatgtaatcttttgatatatgtatgcattgtggaatgattatatcaagcaatgaaaatatccatcacctcacatgcttaccatttttttttttgtagcgagaaaatctactgttactcttttagtaattttgaaatgtgcaatagattattatcaactatggtcaccatgctgtgcaataaatcttgaaaacatattcttcctaactgaaactttgtaccttttgaccaacatctcccaggtgatcatttttgacttgcaaatgtcctattccatttcaatgaaagggaaagcaacactagtatcttcaaaacttgaaaagcaaagtgtctgtgcataaaaaaagaaagatccttttatccccatatttcagtattataaagtcatgttggataaatgtgctgagagaaatttgcattttattgcacacaaaagaaaactggacacaataatataggatataaaattaagtcaagagttggcctttaacaattgtttgtagcttgttatgtagttaaatcttgatgttatttggtcttgtccttatacgtgcattgacttcatgaaaatcaaatttataatcacttgtatataattcagtgtaatccatttaagacagttcacatggagggtccattggagatttggcctttcacccacattcctccactgcacaaataactcttccctgaattgttggatgtgccattttagtgatcaagggaggacccctggaacacaactaccgattgaagcagttccattttcactggggggccatcgatgcctggggttctgagcacaccgtggacagcaaatgcttcccagcagaggtatgttgagaaggtcaggaacagtgacaactgtagagaagtggggataattctgaacttttagttgtaagacattattagaatcaggtgattcctataaatgctaaatagctttctcaggcagttttgatcattctcagctaagacatgtaaaaatgttaacttctctcatctcaaataatatagttgaaatgaaccttaagatcctgaaactgaattcttctggaattcgaaagtggactcaaatagtagcccaaagtaataacccagggaacattgtggagccacaggttgaattaatgcaagtttgcggtggtgggagcctaaatgaaggctgtggcaatagaaatagagaaaaagggcaagatttatcaagcatttctgaaattaaagcaacaggacttgaaggtagggttctcttcaggataggagaaggcaaggttaaccacgactttgtggtgtctcacttgggaggctgggtgataatgcactcataactgatgaatgaggaatgatttgtagggaaataaagggagattttaaggaaatagaatttcttcttacaacttttttcctaattcaattgtaaatgttatgtaaaaaaagcccatttaaaaatttattttatattttttatatttgtttcattttattttgctttgtgagacagggtctcactctgtcacccaggctggagtgcagtggcacaatcacggttcactgcagcctcgaccttaagcaatcctcccacctcaagacaacaggcgcacatcaccatgccctgctaatttttttttttttttttttttttttgggacagagttttgctctgtcgcccaggctggagtgcagtggcgtgatcttggctcactgcaagctctgcctcccgggttcacaccattctcctgtctcagccccccaagtagctgggactacaagcgcccaccactgcgcccagctaattttttgtatttttagtagagatggagtttcaccgtgttagccaggatggtctcgatctcctgaccttgtgatccacccacctcggcctcccaaagtgctgggattacaggcgtgagccaccgcgcccggcctgccctgctaatttttaaatttttttgtagagacaaggtttcactatgtcgtccaggctggtctcatactgctggattcaagtgattctcccaccttgacctcccaaaatgctgagattacaggtgtgagccaccacacccagcctaaaagcacattttaaatggttattccttgaagaagaaatttgtctttaactcctgcataatttccatatggaggatctatttctctcaatataaacatcttctctcctgtagatgcaagtggatttcgaatattggtatttcattcaaatcaagatgggactggacaaatgttgattgctcactgaagtgtcactttgttatatgaattttctatttttctccccaaataaatccctttattctaaaataatattaattgctgctcttgcctaaatttcttcctgatctttgtttctatctcattttggattgtcatatggttttcttggtggctttactttgggtgaggaaacatgtttaaatgtcataggttgactgaggctgtgggtttattctggagagattctgtatagtcacgtgttaaccctcttttcatggtgtttcagctgcacttagtgcattggaacgcagtcagatttgaaaactttgaggatgcagcactggaagaaaatggtttggctgtgataggagtatttttaaaggtaaaatatctcaccaactttaaatgacgtgttgtattctaggatgaaaagatagaacagtataatattgttatttactttaagaatgttgggatccatacattggtaagataaatagtgcttgaagtacaggattgttaagaatatattttagggccaggcatggtggctcacgcctgtaatcccagcactttgggaggccgaggcaggcagatcacttgaggtcaggagttcgagaccagcctggcttccatggggaaaccctgtttctactaaaaatacaaaaattagccaggcatagtggtgcgcacctgtaatcctagctactcgggaggctgaggcaggaggatcgcttgcttgagcctgggaggtggaggctgcagtaagccaagattgtgccactgcactccagcctgggcaacagagcgagactccatcccccccaccaccaaaaaaatatatatattttaaatgatataaaaatgcacagcccaatagagtggtcacaagccacatgtggcaattgagcacttgaaatgtgtctactgcagttctggaaccatttttcattttatttaattttaatttcaatttaagaacttaaatgaagcagggggcacctttcactgcaggcatgctgaccttgtcagcaaacagcctgctgatttgttctctaatttaattcagtaatgtttataaaattataaattacaagtttaagtgtaatttcagtcatgcagtttgtttttatgtaatcaccaggtagttaattttaattcacattctgttacagtttctacagtgagatgtccattgtttgtaatattttcttacttgttgttctttagctaggcaaacatcataaggagctacagaaattagtggatactttgccgtcaattaagcataaggtactatttgttttccttaattacttgaaatatacttttatgtttcaatctcagagcggagacattaccaaggcactttgaattgggaagtttaattaggtgaactgtattcagccttagaagaaaacttgccatttatgattccaggggacagaagtcatcattctgtgggtaggcagtgagctttctggttttgctgcagtgccgctgaggacttggggactcaggaacatattgctgtcccctcctctgttcctgacaccggctccttctaagtccttgtgaacacacccagagcagccttctgttctgtagctgccatcccacaggcagggagcagagcgcagttctacagaaacttgccttgtccagctagaaagaacagtaatccacatccttcaggtcggatgcctttgtccagtcccccaatattaattcttcaatattcagaatctcaaagggctgctctctggaggcccatatattctcttcttctccctctcatcccccactgtatccctctggtccccacctctttccctctcctttcctctctggaagcccgtatattatctccccccatcccccactctgaccttctggtccctacctctttccctctcctctcatctccattttcctgtttttccctctctttccttttagttcaggtttctggctcctcctgagctgcatttcttcttaaaaggacaattctcagttagcctctcgaaaatgcaaagcctccaaccgggcgcagtggctcacgcctgtaatcacagcactttgggaggccgaggctggcggatcacgaggtcaggagatcgagactgtcctggctaacacagtgaaaccccatctctcctaaaaaatacaaaaaattcgccgggcatggtggcgggcgcctgtagtcccagctacttgggaggctgaggcaggagaatggcgtgaacccgggaggcggagcttgcagtgagccgagattgcaccactgcactctagcctgggcgacagagcgagactctgtctcaaaaaaaaaaaaaaaaaaagaaaaaagaaaagaaaatgcaaagcctctttctttatgcactggccgctgtctaaaacctctcaacaaaactcagaggagactacctgctggaacctcactagaattgagagatcaagtggttttggccgttttcccacaggggaatataaaaaatgcacagttaattccagaaacaaagccaggcatgataccatcctaagcagcgattcttcaggtagctgcccagaaaggcctggagctgctctggaccactgctgatctccagatactccctgagaaccgtcacctcggcgtccaattcctgagtggttttcactactaaataatgactcggttatctcttctcttggccaggacgcccttgtggaatttgggtcatttgacccttcctgcctgatgcctacctgcccagattactggacctactcagggtctctgactaccccacccctctccgagtctgtcacctggatcattaagaagcaaccagtagaggttgatcatgatcaggtatgttctctccataatttcaatctaaggaaatccttgtctgcccatgtaaaacaaggctgggctcagactgtggcatcagttttaacatcttgtaatgcttatacatttttattgaagtgtaccaacgtcttgtctcagtttggacatgaatttggggatgtttcaaattaactagagagaagagttaaaacacagaagaacataagttttttacatttatatttgacaattacatatgtcttcttatgccttgtgtattttatatataaatattaaactctatacaaaatcaagacccttttaaagggaagagtgaaggctggaaatgaatgtgttcaaaactgtttaaaatccttaagggaattctgctatggaatctcaggataaatacagaattcaacaatgtttgtccagaaactttaatgtaagtccattttttgaatttgggatctatttttcccttagaaactaagtctaagtagtatttactatgcaaacactcaaaatcctgtataatgtataatataaactacaataatatttactcatacttgttttatgggatttttattgattataaagcattttcataagaaaaaaagcttccaaattctttttatgaagccagcataactgataccaacactcaccaaagattggacccccctctgaagaatataaaagaaaaaaaagctaaaaagaaaatattagaaacagaatccagcagtacatcagaagaaatatacactttgtccaagtagcttttactccagtaatacaagtatggttcatgttaagaatgatattaatgtaattcattctatcagtggatctaaatagaaaaatcatattatcatttccagggaagttaaaaagacatttgtaaaaatcaccattcagtttttgaaaatttttaataaaacagagctgaatagagacttccctatcttgataaaagagattgatctcagttcaaaagcaaatagtaggttttgaatggaaaggattgttaccgtattaagttttatattaaattacattctggaagtagccagtacagttagactggaaaataaaaaataaattagagaaacaataaaaaacgactacaaaaatcagagataatttggtaatcagtggaatacaatatcaatttctagaaatcaatacatttgacatatataaatcacaatcagctaaaagatatgatataaagatataatgtaagaaaggctcctatttataatggaaacaaaaatataaaatacttcggaataattttaacaaggaaagctaataagaaaacttaaaatgttcctggaggatacaaaagaaggcttgaattaataaagttaacacattataggatcaaaagacataaaaacacctttttttgtcataaatgacaacctaagttgtcattctccatgaattatttattcaccataaatttatgtattcccaataaatatgccaataggatttttaaattgatatgctatttctaaactcatgaataaagacaaacacataaatagccagggaaaattctagaaaaatacgggataattagactcacaaagttataaagcctcaataattaaatagcgtgttcctggcacatggataaagagatcaatcaagggaagtatattagcgttctccagagaaacagaaccaataggatatatattgtattagtccattttcacactcctataaagaactacctgaaactgggtaatttatgaagaaaggaggtttaattgactcatagttccacaggcttaacaggaagcatgactgggaggcctcaggaaacttaaaatcatggcagaaggcaaaagggaagcaaggaccttcttcacatggtggcagaagagagagagagagatgggggaagtgccacacacttttaaaccgtcagatctcatgagaactctttcactatcacgagaacagtaaggaggaaatccaccctcatgatcccctcccctgacacagggggattacaattcgacgtgagatttgggtagggacacagggccaaaccacaccagatatagataaagataaaaaaaattaagaaagacaaagttagataaataaccctataaaggttaaataaccttaactctataaccctataaagataaataaagaaaaagatagataaagttgtatcataaggtattggctatgtgattatggagactaagaagtcttacaatctgccatctgcaagctggagacccaggaaagacagtggtgtagttcaaaggcctgagagctggagagctgataatgtagatttctatcttggtctgaaagcctgagaaccaggagctccgaagaaaggagacgattgatgttccagctcaagcaatcagagcaaattcagccttcctctgcctttttgttctattcagaccctcagtttattggatgactcccatctactttagggagggccattcactttactcagtctaccaatttaaatcctaatctcctccagaaacaccttcatagacatacatagacacagtatttaacctgtctgtgcatcccatgacccaatcaagttgacacataaaattaaccatcacaggaagaaaataataatttcagaaatatatccaaatacatatgagaatttattttatgataaatatagcatctcaactcagtaggcaggaaagatagagtattcagtatttggtaaatgctgttgaggaataattgagcaggcatttgggggaaaaaaattggatccatcattcagaccttacacaggaatacattccagatatattacatgtaaaaactaccaccatgaaagtactaggataagcataggaaaatccttttatgcctgcaaatgtataggctttgtggcctatacatttagtctgtttctattctttggattaaaaaattgacacatttccttgacttatattccttctagaaaaacaaatggacataacattgaaaaacaaataaagcaaatacatcagagggtcagtggcccatgtgaggactttgtaaatacgatttcaacaaaattttaaaatttatttttcaattatataatttaaaattttattttctggtctaactgtactggctacttctagaatgtaatttaatataaaacttacggtaacactgaaaatttagtaaggaaaacagtgctacctgtcatctataatattatcctagttgcctataattttaccactatcattgtttggggaaatccttctggtctcttgtctgtccagatgcacataagtccttatggtcttttatctatataaatatacacaatttttgtatgaaaatggaatcattctgtacataccattttgctgctcttttcactcagtgatgcctggaacatttttttttttttttaagacggtctctagctgttgcctgggctggagtgcagtggcacgatctcggctcactgcaacctctgccttgcacgttcaagcaattctcctgtctcagcctcccaagtagctgggattacaggcgcccgccaccacgcctggctaattttttgtatttttagtagaaatggggtttcactgtgttggccaggctggtctcgaactcctgacctcgtgatccacccgcctcggcctcccaaagtgctgggattacaggtgtgagccaccccacccagctgcatggaacattttatagataatgaacatcttcagtattatttttaaggactatatactagttcatttcatagatcagatgtcatttatctttgatacttagactatttctaatcttctgcaattagctgaataaaaagaaacattagctacttgtacagctttctaattagtgagggcttttgtgtaatttgcatgtgcagccgctgtgtgatatgttcattgcttgctttcagtcgtagttctgcctcttcagctctatttgccctgaagtctttgttgcaaatgactcttcgcttgcttgtctactgtgccccaggctgtcttctcagttgttacaatgaggcagattgaatgaggggaaatgtgaatggattttcctgctggcctgaagtaaagtattttgttttcttttttttttttttgacatggagtttcactctcgttgcccaggtgagagtccagtggcgcgtgcccaggtgagagtccagtggcgcgatctcggctcactgcaacctccacctcctgggctcagtagctgggattacaggcatgagccaccacgcccagctaattttgtaattttagtagagacagggtttcaccatgttagtcaggctggtctcgaacttctgacctcaggtgagccacccgcctcggcctcccaaagtgctgggattacaaatgtaggccaccacgcccggcctaagtaaagtatttcataacacaattgggtctgaaaccaaggggctactggttgatactgcagccacatcagagaacaagccgttgatattctgggttgctccttttgcattgagttgtattgtctaatattgtaaccactggacacatgtaaccatttacatttaaatataaatacattaaaaataaaattcagttcctcagttacactggccacatttcaagtgcccagtagccacatgtggcttgtgactaccgtaatggaccgtgcagaggacatttccgtcattgcagaaagttctattggacagcaccagcatagagcatcctgtctccagttaagacacctacatgcagcctggtgtggtagctcacacctgtaatcccagcactttgggagacctagctgggaggatcacttgaggccaggagttcaagaccagcctgggctgaacatagcaagaccctgtctctacaaaaaattaaaaaattagctgggtgtggcagcatgtgcctataatcccagctacttgggaggctgaggtgggagatcacctgagtcccagaggttgagcctgcagtgaatcatgatcacaccactgcattctaacctgggtgggtgacagagtaagactttgtctttaaaaaaaacaaaaaaaaaaagaaagaaagaaaaggaaaaaaaaaagacgtttatattcattgctttgcccacaatacccaggtgcagtgagcaatcaataatacttattttatgttcatgattcagttaaattgttttataaacccactttttttggtgttgttagtatatgcatcagggctttcctttctcattctgtaagctggctgttttgctcatttaaagaggaagttcttgagaatgaaagagatgaattaactcatccttggtaaatggataatatgtggggacagggcctttgccccaagtctttggatcccaagtgccctcctggtttcaccacctcttgctgctctcctccccacaggaccaccatcaggatcaccaccaccactgggcattttattccctgtcaagtggtgaaggcgttcttacccagaaataacttctccttctgtatctaatttgcaacgaatgctcagaattgtaaaaatgaaagtaatttattcacgaggtaaagcgagttttctgttgaaattatttatgctttctgtttctatttctagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttcttagcatgagagtgcttcatcagtctttgaggaaggctattcggtaccagcaagagacacaagtttctcttacagatacctgttggtaattgtaatgccttttttttttctttaagagactaggtcttgctctgctgcccaggctagagtgcagtggccaaatgatagctcactgcagccttgaactcctaggctcaagcagtcctcctgccttagcctctagagtagctggggctacaggtgctggccgcctggcccagcttgtaatatctttttatgtctgacatttttgagctatctttttatgtttatccattagtggttctatagcactatacatagggattataatcaaaatttttaacatgtggtaaggcacagacactgaccagaactcaggccttgcagaaacagcctatgggcccagactggtacttcctggctgaatattggccatggttttagatgtattttattttataacatgaatgtgtattctttcataagggcttatcagtcagtatatttgccccagtgtttagttgttacaaggacatgatatgcttacttactatcagtttatgatgtagaaaatatattttgtaattataagaaaacaagacttttcctatacccagaaatccctttgcatttccgaagatcagatattttgcttaaaggtctgatcatataggaaatatatgcagaacattttaaagaaaatgcctggctgggcacagtggctcacacctgtaatcccagcactttgggaggctgaggcgggtagctcacttgaggtcaggagtttgagaccagcctggccaacatgatgaaaccctgtcactactacaaataaaaaattagccaggcatggtggtgagcacctgtaatgccagctactcgggaagctgaggctggagaatcgcttgaacccaggaggtggtggttgtagtgaaccaagatcacaccactgcactccagcctgggcaacagagtgagactctgtgtctaataaaaaaaaaaaaagaaaagaaaagaaaaaatgcttaaagtgcctagaacttagaattctttcattgcacatttccagaaatatttttcttttcttttttttttttttttttgagatggagtctcgctctgtcccccaggctggagtgcagtggcactatcttggctcactgcaacctccacctcccgggtttaagcgattctcctgcctcagcctcctgagtaactgggactacaggcacatgccaccacgcccagctaatttttgtatttttagtagagatggggtttcactatgttggccaggctggtcttgaactcctgacctcaggtgatccacccgccttggcctcccaaagtgctgggattacaggcgtgagccaccgtgcccggccttccagaaatatttttcaaaggactagtaatctaatagcctatagtttatattattattttgtattatttgcacgctgttacatagtatataatgataatgttttctacagtgaaagagctatcccgtcttccctttacaactgtctgaactttatttactcattagtcaaggttctttgcaaggcaggtgattaacttaaatatctcagtttatacagtggtttaaaagacttttgttatggtaatagggagagaaacttgtcagataggctaaaatctagataattctacatattctgaggaattcatgctcctgtggctcttgcttataaatatcttggaatgtttctgaatgcctctaagcctatgttcagactctgttgcgtcaatgactggtagtatttctttcattaatatgtttgtcatctggtctgcaagatagggttggatgaatatacttaacactactgaactgtacacttaaagatcgttaggaaggaaacgggactacatcaaacttaaaaatgtctgtgtgtcaaaggaagcaatcaacaaagtgaaaacgcaagctctagaatgagagaaaataattgcaaatcgtctatcttataaggagcccaaatccagaatatatgaggaacttctacaactcaacaacaaaaaaccaaataactcaatttttaaaaatgggcaaaggacttgcacagacatttctccaaagaagttatacaattggccaataagaacatgaaaatatgctcaacattgccaattattagggaaatgcaaatcaaaaccacaatgagatatcgtctcacgcccatcatgatggccactatcagaagaacaaaaaaataacaagtattggggaggatgcagagaagttgaaacccttgtgcactgttggtggtaatgtaaaacggtgcagtcattacggaaaacagtacacaggtttcccaaataactgaaaacagaattaccataagaattaccaccaaagcgggatctcaaagagatatttgtacacccatgttcatagcagcattattcacaatagccaagaggttctggaagcatcccaaatgtccatcaacagatgaatagataaaggaaatgtggtatatacagtcaatggaatattattcagcctttaaaaagaaggaaatcctgtcaaatgtacaatgtggatgaaccttgaaggcattatgccaagtgaaataagccagccaacaaaagaacaaatgctatatgattcctccatgtgaagtatgcaaagtagtcaaaatcatacaatagaaagtagaaaggtggttgccaagcaacggttgggggaaggggagagggtgaatttgtatttagtgggtacagagcttgtgttgcaagaattctagagatctgttgcaaaacaagtgtgattgtacttaacactactgaactgtatacgtataagtttgagaaatatctcttttaaaaagggggaaatgtgaaggcttttgcatgtatgccctaggaaatgcatagaattcttagaaaggtaaacatggtaaaaaaagaagtctttgttaactttctgcagttcacctgtttcaaagtatagttacctttaaaagggtaaacacacaagatatgcattttccaaagcatacaggctttcctcctagctgtcttgttttttatttttttttattttttttatttttttgagacagagtcgcgctgtcacccgggctggagtgcagtggcgcgatctcggctcactgcaagctccgcctcccgggttcacgccattctcctgcctcagcctcctgagtagctgggactacaggcgcccgccaccacacccggctattttttgtattttaagtagagacagggtttcaccgtgttaaccaggatggtctcgatctgacctcgtgatccacccgtcttggcctcccaaagtgctgggattacaggtgtgagccactgtgcctggccttcctagctgtcttgtgaaacgataagtcaaaaccctactgcagtgagttttccaaactgaagggagaagcaatgtacagaatgcctgacttgcccttacatcttatacctggtgttctggcatgattattaaccacactctttttcactttgaaccatgtcctggtttgcatggccagcttccctgcagaggtgatagaaactgacttgaggcagtttctttctccatgccttagttagatgaccctcaaaggggcacagcagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcgatacaatgctttctttacagtattagtggttggtgaaagacttccttcctattgttacagtatatgtatatatctgtaaaattaatgagatatcctttaacttgtagattagaaagcgactaaaaactcataggggatttactaaagaagcaacaatgggaagaagcagccgatcctcctcagtgcacctttttctgttgcacagtacagtgcacagtgtgctggcatcaccatatagggcaagctgtgaccgcctttctcctttcccagggctacatggtgccaagcaggttcagtgtacactggttaccaacctgtctgattccattgtgacagaacacactcacacccaatacattacatgaagcagatttattacttacagacaggaagcaagggacaaaagaggccctggctccattgtgagccagtcccccagggctcaagaaagctgcccagggcggggctgatggagtcttgattgtacgtgccccacttgcaccacagcctgccttgggttatataccataggagccacataactcattgggcaaagctttaaagtacatcctccttccaggggaaagaggaacacaacctcgctgtctcaaacagttccctaaatcaagatgttacattccctaggagggacaacaacaaggccaacctgtttcaggcagttcctccatatcaggatattgcattcccagtgcattctacagttattcttaagaactacaagcaaggaagaagggagaactgggtcagtccaaggccacctggagaactgtcttgtacatgggttagggtaaagttggctattctaaaactaagcatccgcccaaaagaagtcttggaagatgtctttccctgttaaattcagatgatggtaattatagtttggaagtggaattggcttttagagttacttcctgtaatgaaattaacaagcaattcaggcctatttctgaaaatgaattcagtggttaattgttaaaaataaatgtctaactccta

SEQ ID NO: 514 - DNA, 1874 bp, Homo sapiens
tagaaaggtaaacatggtaaaaaaagaagtctttgttaactttctgcagttcacctgtttcaaagtatagttacctttaaaagggtaaacacacaagatatgcattttccaaagcatacaggctttcctcctagctgtcttgttttttatttttttttattttttttatttttttgagacagagtcgcgctgtcacccgggctggagtgcagtggcgcgatctcggctcactgcaagctccgcctcccgggttcacgccattctcctgcctcagcctcctgagtagctgggactacaggcgcccgccaccacacccggctattttttgtattttaagtagagacagggtttcaccgtgttaaccaggatggtctcgatctgacctcgtgatccacccgtcttggcctcccaaagtgctgggattacaggtgtgagccactgtgcctggccttcctagctgtcttgtgaaacgataagtcaaaaccctactgcagtgagttttccaaactgaagggagaagcaatgtacagaatgcctgacttgcccttacatcttatacctggtgttctggcatgattattaaccacactctttttcactttgaaccatgtcctggtttgcatggccagcttccctgcagaggtgatagaaactgacttgaggcagtttctttctccatgccttagttagatgaccctcaaaggggcacagcagatttccctggctactgatacaccttaacaagaagcttgtgttttttatgccctcaaaagtgttttacttatactttcctagacataaaggtggaaaatgggcctaaggtctgtcaaaggtcttggaaaagaagattgtattaaaattgctgtccgtcttcattaaataatactagatcgatacaatgctttctttacagtattagtggttggtgaaagacttccttcctattgttacagtatatgtatatatctgtaaaattaatgagatatcctttaacttgtagattagaaagcgactaaaaactcataggggatttactaaagaagcaacaatgggaagaagcagccgatcctcctcagtgcacctttttctgttgcacagtacagtgcacagtgtgctggcatcaccatatagggcaagctgtgaccgcctttctcctttcccagggctacatggtgccaagcaggttcagtgtacactggttaccaacctgtctgattccattgtgacagaacacactcacacccaatacattacatgaagcagatttattacttacagacaggaagcaagggacaaaagaggccctggctccattgtgagccagtcccccagggctcaagaaagctgcccagggcggggctgatggagtcttgattgtacgtgccccacttgcaccacagcctgccttgggttatataccataggagccacataactcattgggcaaagctttaaagtacatcctccttccaggggaaagaggaacacaacctcgctgtctcaaacagttccctaaatcaagatgttacattccctaggagggacaacaacaaggccaacctgtttcaggcagttcctccatatcaggatattgcattcccagtgcattctacagttattcttaagaactacaagcaaggaagaagggagaactgggtcagtccaaggccacctggagaactgtcttgtacatgggttagggtaaagttggctattctaaaactaagcatccgcccaaaagaagtcttggaagatgtctttccctgttaaattcagatgatggtaattatagtttggaagtggaattggcttttagagttacttcctgtaatgaaattaacaagcaattcaggcctatttctgaaaatgaattc

SEQ ID NO: 515 - DNA, 32809 bp, Homo sapiens
cgccctttcctgccagacctggaggggcggggcggtgccggcaagatggctgcgcccgagaagatgacgtttcccgagaaaccaaggtaagcgccgtacggggagatgagcaggcgagcgggccgatcgtgggcatggaggatgtggtggcaggaagaaaagagaagctgggccaagctaagtgagccaccgcggcagctccattccttcctggtgcgcgctctggtgccctccccggacttgcacgggcggctgtggctcaggcaagcgaggagaggatcaggttggcggatggagaagaactgtctgggagtgggaggatgaggcgatgatagatggctgttctgtaattaaaatacaggaagcaaggtttctctcctcagcacccgaactatttcctttcattgggcacagaggagcggggagctcgggcagcgctgcattgtagccgctgatcgtcgtgtatatgtcttaatcttccagccacaaaaagtacagggccgccctgaagaaggagaaacgaaagaaacgtcggcaggaacttgctcgactgagagactcaggtgatggactctttattctgttttctgtgttgtgaaattgctctgtccactccagccctaacttgaagccccagtgtcagaaggaagtcaaatattgtgtcggaggaaaaatagctgtgacttctgcccccaagtagttatttagaaacacatgtcagaaacaatgttaacatactaaaggcaggaagaggaagtcttggtgaatgatcgcccactgattctgtgtaacttataaagtatctaatattacagttgcaagcttcatgaattacagcagctagcacagtccttgcacacgtagtaagtattcggtgaatgtttttcttcgtaaaaccagcaggagttgaaggtattaattagacgttttgcaagtttttctcaaacttgactaatatgagacccttggtttacccaaattattatgttattcaaatatatatcaacataatactagttatgaagctcatttatttatttttgagacagggtcttgttctgttgcccaggagggatgtgcacaaccacggctcacagcagcctccacctcccaggctcaagcagtcctcccacctcagcctccctagtagctgggactacaggcattcaccaccacacctggctaattttttcttttcttttctttttttttttttttttttttgagacggagtctcgctctgttgcccaggctggagtgcagtggcacgatcttggctcactgcagcctccgccccctgggttcaagcagttctcctgctgcagcctcccgagtagctgggattacaggcgtgcgcaaccacacccggctaatttttgtatttttagtagagatggggtgaaaccccatcatgttggccaggctggtttcgaacttctgacctcaggtgatccacccacctcagcctcccaaagtgctgggattaaaggcgtgagctaccgcccctggcccacctggctaatttttaaaattttcgtagagacgggatttcactgtgttgcctgggctggtctcgaactcctggcctcaagcaatccttccacctcggcctcccaaagtgctgggattataggcatgagccaccacacctgacctgaagccattgtttgactataaaacaatatatgggctgggcgcgtggtggctcatgcctgaaatcccagcactttggaaagccgaggcagatggatcacctgaggtcaggggttcgagacctgcctggccaacatgatgaaaccctgcctctactaaaaatacaagattagctgggcttggtggcaggtgcctgtaatcccagctactcaggaggctgaggcaagaggatcagttgaacctgggaggcagaggttgcagtgagccgagatcctgccactgcacttcagtttgggcaacagagtgagattctgtctcaaaaaacaaacaaacaaataaaaatacatttataaattataaaactaaatgaaattacacattcggtaaaatttaaatctacatcaggtaatgctagggatgatgtgaaactaatgctcctcacaatatgtatatggcactgatgggagtttggaatgcctctactaatgttgccttatagttatttaccactttttctatgaaattactgtagaacctttatttgtacagatggtcatttgaccttcacatggcaaaacctaacatttatgtattaaatctacctgcttaatgcaataaaattaggacttagttataaaattatgtagtagttataaatccagatgggagcactgaaatcacacagtagtactggcttataatgattgtcatccgcattatccagaatatgctcatgaaattatcctagacaattcttaaaatccagagaccatggcctcaagtaactaggattcttggaccttgagaaacatagccatagaggttttatttaccattggtgttcctgagtaattattttagtgtcagtactgggatatttagaatggaaggagcagtgtgtttaactgcaacctgtgttagcatttctgtcttattagttgaaaactcatccactagaggcagaacaaagcatcagggataaaaggaaaagtagaataggttggagttattgaggcccttattgtacttcgtctctccccccttgaaattttcagctactttactttgttcatttaatctgttttattctaaatattatatattctaaatttgttttaacttctttctctttttcttttcctgcactaaatcctataacagctggtatttgtattgttttgattttttttttcctttttacttagcaaaatgtgttcagaatgagcctctgtggagagtcaggcgagtcatgtcccatggtagtttagcccattttaatggactaaatccaggtcactggtctgtcaagattatgtaactaatggcatatccaagactaagcacctgtctctgcacttctgctcctacttttgcccactccaactcacaattctttgcctagtggtacttcatgaatactgtagactatggaacactcctggtttttttttttgagacagagtctcactctctcgcccaggctggagtgcaatggcacgatctaggctcactgtaacctctgcctcccaggttcaagtgattcttctgcctcagcctcctgagtagctgggattacaggtacccactatcatgcccggctaattcttgtacttttgtagagatggggtttcaccatgttggccaggctggtctcaaactcctgatctcaggtgatctgcccaccttggcctcccaaagtgctgggattacaggcgtgagccactgcgcccggccaggaacactgctgtttattgtagcacacgttagatgggtaaacattacccagaaggctagaatgttgagtgtaactatgagagtgccttggcaaatgattggagtgccttggcaaatgatttctggaatagtgagctcttaattacagatagcttctttggcatccattctacttcagataactggaaacaagctacctcgtcagaaattaagatattaaaagcaagttgcaaaactatagcatgattctgtgtgtacagttacatgtacaggttgagtatcccttatctgaaatgcttgcgttgtatttaccagttcagcatcccaaatccaaagatccaaaattcgaaatgctccaatgagcatttcctttgagcattgttgtcactcaaaatatttctcatttttggatttggggtgctcaacctgtataataccattggatatacatttgatccttgaacaatgtgggagttaggggactctgaccgccccccgcccctccccacagtggaaaatttgcatataacttttcactcccccaaaacttactattaagtgcctgctgttgactctaagccttaccaataacataaacagttgattaacacatactttgtatgttatatgtattatataccatattcttataataaagtaagctagagaaaagaatgttactaagaaaatcccgaggaggagaaaatatatttgcccttcattaaatggaagtggttcatcataaaggtcttcattctccttgtcttaatgttgagtaggccgaggaggaagaggatgatttggtcttgctctcttgggtggcagaggtggaagaggtggaggaggtagaagggaaggcaagagggtagacggcacttggtgtaactttgcagaaatacattataatttctgtctgacatttttgctttttcatttctctaaaaatgtttctatacagtaccaattcttccaccacttgctttagtttaaatgcattagttttcagtatagaagggtccataaaagaagtcaaaagcagtcttgaataattggcccttctgccagattgtctagtgtcaatttgttttctggcactgcttcacctcagttttcttcctcatcaccttgcactggtttggaaggactcatccccatcaaattggcttttgttaactactctggtgtgtctgttagctcttgaatttcttcaagatatcttgagacccttcaccccgacccccctgcacttttcccccccccccatatttacaatctctttcacgatttccttgattggctctgtcttaagtccaatgatgccatgcacaatatctggacacatttttttctccagcaggactttgttttgggcttgatgattttcatggctttttctataacaacaatagcatcttcaatggtataatctttacacactttcttgatactctctgtattagggttctctcccatagcattgacaatcctttccgtagagtaccacgtgtaatgagctttagaggttcttacgaccccctggtctagaggctgaattagaaacattgtgtttgggggcaagtagaccactttgacaccttcagtgttgaactcatggggttctgggtggccaggggcattgtccaatattaaaataattttaaaatccagttccttattggcaaggtacttcctgacttcagggacaaagcatcagtggaaccaattcagaaaaaaggatttccattgtccaggccttctagttgtacaaccaaaagacaggcagctggtgctgatcttttcccttcaaggattgggggtgggggttagcagctttatagataagggcagttctgatcataaaccccactacgttttcatgaaacagtagagttagcctgtctctttttgttttcaatcctgctgcttgcttctcttcctactaaatgtcctttgtggtgtttttctagaataggatactttcatctgcattaaaaacctgttcaggccaggcgcagtggctcacgcctggagtcctagcactttgggaggccaaggcgggtggatcacgaggtcgggacttcgagggcagcctggccaacatggtgaaaccctgtctctgctaaaaatacaaaaagtagctgggcgtcctattcacgcagatatcctttctcctcagtgattttcttttttgttttttgtttttttttttgagatggagtcttgctctgtcgcccaggctggagtgcagtggcatgaactcggctcactgcaacctccgcctcccgggttgaagcaattctcctgcctcagcctccagagtagttgggattacagacacgcaccaccgcgcccggccatcatgacttttctctgcttcttgagagcacttccagcatcgctagtcgcactttgtgtgagtctcatgatgttattcaaggtttaccattttgtagtaaacacagtgaaaaatacgccagagatcacttcttactgccatacacaatttactgaagagatgaactgctcatgcagagatgagtagtgtcacaaggtgttttaagtgaatactcatagtatttgagctcactgcaatagcagcaggaggtggctatgaaattattgcagtagtgcagtgtgtactacagttaatttttttcttccttctgtacctcattggatgcgtttttttccttgttttgtactacagttaatttcatgcagttatgatttaatactgcatatttatgtttgtttacatttttctcaactgtgaatgtgccatatatggtctataaatataagttttgataaattttaactttaaaaaaagttgtcaatgattatgttgtagcacaacttttatagtaatattcaaggaaaaatgtttgagaccgaacttctctgtcttagaatggaatgaagtcagagatcattttgtttcaaatcgtttttttttttttttttttttttttttgagacagagtctcgctctgtcgcccaggctagggtgcagtggtgcaatttcggctcactgcaacctctgcttcccagtttcaagcaattctcctgcctcagcttcctgagtagctgggattacaggcgtgcaccaccacacctggctaatttttttatttttagtagagatggggtttcgccatgttggccaggctggtctcgatctcctgacctcaagtaatccgtccacctcggcctccgaaagtgctaggattacaggcatgagccaccgctccctggcctgtttcaaatgctttaagcaaggaaacaataaaacacttaacttatattgtaacagtatctgtatatgtgctgctcaagccagcacaatattgcttaacagtatctgcattaactttttttttttttttttttgagacggtgttttgctcttgtttcccaggctggagtgcagtggcgcgatcttgactcactgcaacctccacctcccgggttcaagcaattctcctccctcagcctcccgagtagctgggattacggggggctgccaccacgcccggctaatttttgtatttttagtagagatggggttcaccatgttggccaggctggtctcgaactcctgacctcaggtgatccgcccgccttggcctcccaaagtgctgggattccaggcatgagccaccacgcccagctctgcattaacgttttataatagatttatatttatggtagcaaatgataaaatagactagtatgtacatatattttatgcattcatgacatacctttttcttaatttttttcagtgtttctaggccatgccacttacctattttttttttcaaattgttgcaaatatcccctaaatgttccagtgtgtttactgaaaaaaaatctgtatttaaatagaccaaggtggttcaaacctgtgttgttcaagggtcagctgtattgtatgtatatgtattgcatatgtccgattgtacacgtggggaaaatgctgtacccagaactgttagcaatcacttctgtggagtatatgagcttggtttcgaggtgatggggagttgagtgagtcagtcaacaggtgtttgtgagtgtcagctgtgtctatgccctgtctaatctatggcatacctctgcaagtagtcaggccatatcctctgtgccaggttctctggcgctttaagtacattagatcatttaattatctgaacaattagatactattttatatgattgagaacttattctacatttgttgcccattttaattccagctgctgaaataataaagtttacttacttaagaaaagtaaattattgtaattatctaagactggatgagccttcagttagaactgtactcaacacatgtgacaaacagactcttttttctttaagcctgacatctgtaacatttctttaagattatttcagtcttccatttctcttccactttcactgatttttttcccaaattttgaatgggagaggatgtaaatgtctattctattaaaagttgttttttcatgtttttatttgggaaatgttctaatctacagaaagttgaaaaaaagagcacaataaatatccatgaacccttcagcaagatttgccagttgttaaagtttggcctttctttctttttctctatttaaagagatacatacatagaacattttttctgaaccttttggatggcagttgcagatagcagcacctcacccctaaattcttcagcttgcaactcctaagaataaggacattctcccgcagaaccacaataccaaacttgcacctgagtacatgagcaagtaattcaatggtatcatatacaggccatatttaaacttccccaaaccaggattgattgttttgaaaaactcaagccagttatcttgtggaatgccctgtattctggattgttctgtcttctcatgattaacttcaggtaacaacactctttagaacaaaggattacagagcagatgttgtaaacttcttattgcatacatcatgagacctttcacatcaggttgttgcactcccggtgatgctaactgtggttaaggtgttacccacccagggccggacatgctggctcatgcctgtaatcccagcactttgggaggccgaggcaggcggatcacgaggtcaggagattgagaccatcctggccaatgtggtgaaaccccgtctccactaaaaatacaaaaattagctgggcatggtggcgcgcgcctgtagtcccagctacttgggaagctgaggcaggagaatcgcttgaacccaggaggcggaggttgcagtgagccaagatcgcgccattgcactccagcctggcgacagagcaagactcccgtctcaaaaaaaaaaaaaaaaagtgtccagatcgctccattggaaagcattgcattttttcttttctaattagtcctcatgtctggggtgatatgttgagatagtgtgaatatactcttcctagcaagctttcattcgatgtttttaatgtctttgtctaaatttttacagtgggggttgcaaaagtgatgatttttctacttaagtttttctccattttttagttaccattcttctgtgaagatggatgttcccttccacacccccaccaccttttttttttttttttttgagatggagtttcactcttgtcgcccaggctgtagtgcaatggcacgatcttggctcactgaaacctccacctcctgggttcaagtgattctcctgcctcagcttcccgagtagctgggattacaggtgcctgccaccatgccaagctaatttcctttttaagtataattgtggaaccattgattaatttttaaatgtaatgtgctatctgccacccctattgtcctttttgatgcttgtgttgtaccaaagaaggttgatcagagacctttttgttagaaagtttaagaaaaagatttttaccataattttatacattaaagattacatgtatttttttcctgaatttttgaccaaggatttgcagcactcagtttaataaaacatttaaattccctaggactctcacagaaggaggaagaggaggacacttttattgaagaacaacaactagaagaagagaagctattggaaagagagaggtcagtgctaattgaaacacttaaagtgaatgaagttattttattggaatattatcaacctttactaaccagtaccagtcttctgtataaaatcttgtaccaaataggtcttataaaatatcctgtataaagtatttaaatctgtagttgatgggctaaaactagatgttattttttttaaaaatggaagtacttttcttctgtttttgctaatttataattttttttctttcttttttttttttttttttttagacggagtctcgctctgttgccaggctggagtgcagtggcatgatctcagctcactgcaatctccgcctcccgggttcaagcgattctcctgcctcagccttccgagtagctgggacaacaggtgtgcaccaccacacccagctaatttttgtatttttagtagagacagggtttcaccatgtcggccagggtggtcttgatctcttgtgatcaagtgatccgcctgcctcagcctcccaaagtgctgggattataggcatgagccactgcgcctgacctgtaattgtttttgaaaacagaaaaaaaacaaaaaaaattaacaaatgtaaaaagggaaaagactttaataattgcaacacacccaaagatagccactgttaagaaagagaaaaagaaagtgtaaatgtactttacgtgtgtctttctataatggcatgatatttatacatatttttctataaattgctttcttgctaaatatatagtgcatttatttcagtactgatgcagggatctaattcagccatttcagtggcaatacagtacccactgtacagatgtagcataatttatttgctattcatagtttattcatttataatttatagttctctactgatggactttcaggttatattggtttttcactcatatgtaaaaagttgcagtaagcatccatgcttatatatccttggtaattgtccagttatttccttaagaacatgactaaaaatgagattgttggaatcaaatcataagtccatgtaaaatgtagatggccaggtagaaagggcttcctggtttgcagtttgcagcccttctggcagtgaatgtaggggcccatctccccataccttcactcatactaggcattatcagtttataaaactataatgaaactgtttcaaatgcacatttctgaattaggtagagtatctttttatatgttttattacctatttgtagattgctcaagtctcacacctttctcttttgggatacatgtttttttaaaatttgtttttgttttgttttgtttgagacggactctcgttctgtcaccaggctggagtgcagtggtgtgatctccgctcaccgcaacctccacctcccaggttcacacgattctcctgcctcagcctcccgagtagccgggattacaggcacgcaccgccacacccagttaatttttttttgtacttttagtagagatggggtttcaccatgttggccaggatggtctcgatctcttgacctcatgatctgcccgcctcggcctcacaaagtgctgagattacaggtgtgagccaccgcgctcagccgaaatttcttaatgtctctaagcttctatttccttgtctgtaatatggagataaagtcaatcacagtatccacctcacagaattgtgaagattaaaggaggtgatggatgtatagtgtttaacacagtgtcagcagatgagaggtgctgtgatagctctagttcttattattatagatttctgttatgatgaagacaatagatacggtatgaaataagagagtaatttttttcctgtttatttgaaatgcttcttttaaatcacatacatgtatctttgtgctccttagatctttatttctttatgagttgcatactattattgaaaagcaagaaaattatgtaaaaatactgtatgactttatgtcctatttcaaagcagatgtatattcaagttattaaattttaaaatttttaacattttactttcttgtggtcttaatttatatatcatttggttcatttatatacaattatatgtttttcaaaagatttgtaaatcagagttgtgcccactgaaacatctatatggtaccctcacacatggcataggaacactgatagatgcaatgtgccagcctctgccatggctaaaagatgtgttcctggaatctgtatttggaaatgtaatatattttatttaaaattgtggttaggtccccagactagacataaaactttactgaactcctaatactgctgaagtaatatagaacagtttctcatatttaatttcccttttataaattcagtggaagaatgaatttgaggttctacacacctaattggcaggtagactttggcaatctaaccccctctttatattagaaatttgtgatattggatgtctgagacacttgccactttaaggtaataccactcattataattggtcatataaaaaatagactagacactcactaatttatttttattttttcattttttgagacgaagtctcgctctgtcacccaggctggagtgcagtggcatgatctcggctcattgcaaactccgcctcccagattcaagcgattctcctgcctcagcctcccaagtagctgggattataggcggctgccaccacgcctggctaatttttgtatttttagtagagatggggttcaccatgttggccagcctggtctcaaattcctgacctcaggtgatccgcccgcctcagcctcccaaagtgctggattacaggtgcgagccattgcgcccggccctcactaatttatttttataactccatttcttaaaacctgtagctttattttaaaaacatgattacaatgtacttttattttccttcttttggctgtttaggtgtttggaggcaaaccacaggagtctcttaactgtgtgtagtagtagtccaaaggtttatggcaaaggatactgggttttcagcgtgctgccatcatggaattgctacttttaagaataggggctgggtgcagtggctcacacatgtaatcccagcactttgggaggccgaggcaggtggatcacttgaggtcaggagttcgagaccagcctggccaacatgatgaaacgctgtctgtactaaaaatacaaaaattagccttgcgtggtggtgggcacctgtaatcccagctactcgggaggctgaggcaggagaatcacttgaacccgggaggcagaggttgcagtgagccaagatcatgccactgcactccagcctgggcaacagagtaatactctgtctcaaaataaataaataaataaaaataaatgcatagaataggaagggaaatgctttctgaatatgaaaaggtagatgctgctttgaaacttgctacccattttattgtcacctaaacatcactgtgatcagtctagagggaaagtcatagtgtccttttttctgtaaagtatgtcacagccatatatacctatgaaatgtaagagagattttaagttattacccattaggaagatagttgctgacacgtggtgcttttccaaaagctctgctcttctcgttctcttacacccacttgactgctttaatagaaaatagctttcgtgatatttgaatcagtcccaaaatgtgtcattttgctctcgtgtgtgtgtgtatttgtggattaatgcccatttcttttatctgattacatcattatactgataggcaaagattacatgaggagtggttgctaagagagcagaaggcacaagaagaattcagaataaagaaggaaaaggaagaggcggctaaaaaacggcaagaagaacaagaggtatggtaggaatcacgtaactagtgaacaaactgattacttcaccataataactctcatgaagagttgcctatcttgggaggttggagtgagctgagatcacgccattgcactccagcctgggcagcaagagcggaactccatctcaaaaagaaaaaaaaaaaagagttgcctatcttgaacttaaaaaaaaaaaacaaaaaactgatcttattcagtttgccagtgttttaagtttttcatctatgtgcgctgtatgtgaaatgtttttaaaaagtgactgaaacaaagttactttttcttcccctttaaagagaaagttaaaggaacaatgggaagaacagcagaggaaagagagagaagaggaggagcagaaacgacaggagaagaaagaaaaagaggtgattcctgtcatgggatgtgctgtgtgatgagtttgaagaataatcagtaggcatgtcagagtttgggttttttttttctctttttcttgtcatttcattgtttgtttggaaagaatcatatttcagtttagacataacaccagagttcccttctgatgctcttcttcgggtccgtgcagtggcagattccttaaagttttcttcagctttaccctatttaccctttatactgggcattggcaaatgttgtaaagggccagatggtaaatattttaggctttatggtttggtctctgtggcaaacatccaactctgccagtgtaccctgaaagcagccatcgataatatgtagatgaatgggtatggctgtgttccaggaaagctttatttacaaaacaggcagctagcccttgctttatagcaagttatgttcttctgaggttctgctgtatatgagttgacttctttagagaataatactttgttttgtttccacatttatttaggtcataagagaactgcttatgacatgtcagcaagaattagaggatttaaagaaatcaggaactcaaatattgaggaactaggaaacagtttttgttatttgtattaaatcttgacttcctcttccacttaggctatgaagataattgtagctaacacacagttgcttatttaaaaaaaaaaaaaaatctgtgaggcatatgtgtgtatgtatcttctctatcttccaggattcttttttaaggattgatttggtatgttttgctgctattccttgacagtatatttatttcagaggtatcacagctcatcttcccttgactgattcatcaggatttgtcttttttgtaatacagctaaatttaaatagcataaaattggataatcaccttataattgggaaaaatgcatgtgtcttcattgtagtcaatatggggcagaagcagcctccacgatctttgttttttgtatcttaggccatcagttaatttcagtgcagattttaaacacctttatttgagcacttctttccagatgaggcaagttcatgctaggtttttagggggcagaaaaattgtttggaacttgtcatttttttatagagaggaattaattcccattttaacagtagagtgttcctcaactgaggtctttcaggaattcagtaacagctaaggcctcttttgaatgcttttgtttcagaggaaatctgtgagacttcaaggagaaatgagggaaatgaaatagattctaagcttataaaaaagaatcagcagtatgtgttcctgctgtatgctagacacttcgctagcggacagagacagagcagtgaaagacacagtctttgctctcattgagctagttttttatatgggagtgtgagatgataagcaaaacagatcattcaaaatgtgatcatattaagtgctataaagaaataaagcaggccaggcgtggtggctcacgcctgtaatcccagcactttgggaggctgaggcgagaggatcacgaggtcaggagttcgaggccagcctggtcaacatggtgaaaccccgtctgtactaaaaatacaaaaaattagccaggcgtggtgatgggcgcctgtagtcccagctactcaggagtctgaggcagaagaatcacttgaaccgggaggcagaggtttcagtgagccaagcttgagccactgcactccaacctgggcaatagaactagacttcgtctcaaaaaaaaaaaaaaaaaaagaaagaaataaagcagagtgatgtgatagagtaatgagaatagagttgtgcttctatagattgcctgctcaaggaaatttctgaggaggtgatgtttgagctgacacctgagtggagagatctcagcaagaagaagcctgaagcttgaaggctgaaaaaaggccagggaacctgaaatctagagtccaaaggagagaagggcagtggaggaggttgctgagggagagggggcagtggaggaggttgctgagggagagggggcagtggaggaggttgctgagggagagggggcagtggaggaggttgctgagggagaaggggcagtggagggtaagcagagtcagatcatgtagggcttcctggatttgaaggaggagtttggattttatgtttcctataatgggaagccattgaaggggtttaagcagggaatgactctgtctcatttatatctgtaccttttaacagatcattcatttaaaaaaaaaatttttttgagatggagtctcatgctgtcgcccaggctggagtgcagtggcgtgatctctgcttactgcaacctctgcctcctgggttcaagcaattcatatgcctcagccccccgagtagctgggattacaggtgcctgctaccacgcccagctaatttttgtatttttagtagagacagggtttcaccatgttggccaggctggtctcgagctcctgacctccagggatccacccgcctcggcctcccaaagtgctcgtgtgaaccactgcaccagacttttttaacagatcatttttactttactgaaacctctgcctcccgggttcaagcgattcttctgcctcagcctcctgagtagctgggactacaggcgcccatcaccacacccggctaattttttgtgtttttagtacagacagggtttcaccatgttgaccagaggacaaggagagagagaggaattcaagtcatatttttaggtttttagtttgaatagacagatagactggcaacactattcactgagggagcattcaggtggatgtgggccagggagtgtagaggacaagagttctgttttgagcaccacaaataagcaactagacatacgagtcttatgtaatgctttaaggggctagggaagataagactgtctgttaaacataggtacaacttgttcaaatgccaattaggtagaaatttactggcatattgcagaacctcctttgccttattaaaaagttagaattttctcctaaatgctaattaccactggtcatgtcatattttagcttctgctaaatgtttatgatttcatctagcattgttttttgggttttttcgtttgtttgtttgttcgtttttttttagacagagtcttgctctgtcgcctaggctggagtgcagtggcgtcatctcggctcactgcaacctctgcctcctgggttcaagcgattctcctgtctcagcctcccaagtagctgggattacaggcacgtgccaccacacctggctaatttttgtatttttagtagtgacggggtttcaccgtcttggccaggctggtctagaactcctgacctcaagtgatccacccgcctcagcctcccaaagtgctaggattataggtgtgagccaccatgcccggcctagcattgtgttttatattcactaatacccccttttacgaactaggacatggtatatatactcaaatatactaagtattactattattgaaactattataagactattttaaatattttgcaatgtgatctggtaaattttctatttgaatagaacgtctcagctatgggccgggcacggtagctcatgcctgtaatcccagcactttgggaggctgaggcgggtggattgcttgagctcaggagttcgagactagcctgggcaacatggtgaaactccgtctctacagaaaatacaaaagttatccaggcgtggtggtgtgcgcctgtagtcctagctactcggaaggctgaggtgggaggatcacttgagcctgggaggcggaggttgcagtgagctgaggtcacgccactgcactccagcctgggtgacagagtgagaccctgtctcaaaaaaaaaagagaaaagtctcagctatatatcctttgaaagcttttcaaaagatctgtgattcaaaagaaaactagaacttgtgtgcgtgtgtgtgttttaattgttccacttgagattcttaaccagagaaaccagatgtgacttacctgacttctgggtttttattagtcctgtgtttgcaccattttaggaagctttgcagaagatgctggatcaggctgaaaatgaggtatttttaaaaccttacattgataatttgagaccaattaatgtttccttagaaataatagttccagtaatgttagtttcgtggtaggttagttagatcatgtttggatatctggactcatgtttatgatgctttgatttatacaacaacaacaaactttattgatgaacaaatacaaatggtattcatgacccctgtggactggacctgtttagagtccttacagtatgtttaagcaacatcacataccgttagcctccagtggacggtttaccttgaatcagagtaacttctatttctgtctgtggtggttccctaataagttcttggacccttttttttctctttttttcttttttttttttttgagacggagttttgctcttgttgcccaggctggagtacagtggtatgatctcggctcactgcaacctccgcctcccgggttcaagcaactctcctgccccagcctcccaagtagctgggattataggtgtgcaccaccacgcccagctaattttatatttttagtagagatggggtttctccatgttggtcaggctggtcttgaactcctgatctcaggtgatccacccacctcggcctcccaaagtgctgggattacaggcgtgagccactgcacccggccttcttggaccctttttagaatggatggaaaccttggcgactgcccctggtggcagtagtgataccagataaaggaaagtgaccaggagccaagagagacatggagctcatgtctcagtaccgttgtttgtaaagtcttgattgcctgttccaacttaaatgtttgcattattaaatgaaacaatgtttatctttgaggaaaatattttaatatactttgaaacatttcgtctttcatgggtttttactccaccagtaaagtcatggttattttcaacagttggaaaatggtaccacatggcaaaacccagaaccacccgtggatttcagagtaatggagaaggatcgagctaattgtcccttctacagtaaaacaggagcttgcagatttggagataggtaactaattttgttttatcatgtcagaatgaagtgattcaaaatgctgacgtttttgagttccccttttgggagaggcgcatgtttccatttcaaatgtccgtcatcagacatctgctgccttcttgctgctgctctcgttttcccagctgatcatcctctgctttgaccatccctgttccctctatccttgttccctgggtgggcttagcctagttctctgagggtgcttcctttgcattctgcatctttaggaagccactttgcttgttggtttcttcctgagcttgcattagtccatggtggacaactgggttggggaaataatatatttgaagagcttagagcagcttggctttattttttgaagggcacacactgtccccaaaacaggcttttaaaacttggcatgtgccaggagttccaggctgcagtaagctatgaccacaccactgcactccagcctgggtgacaaaacaagaccctgtctcaaaaaagaaaaaaaaaaacaaaacttggcatgtgtaaagggatatctgtgaaagacaggatccaaatgaggagaggaaaagtgttttaatttctgttgtcagtgagtgtgcccagactcaggtacagaccgttgggttcaaaacgggcttcagtggctgccagtttgggaaagttgcttaagctctgtgtgccttcgttctctcatctatgaaatgggattaaacatagtctcatctttctgagggggctgtgaggccgaaatgagcacacacacccgtagaacagggccccaggagtgcttgctggcattttcattattgtgactcttgatgttattctgtgagacactcttcttgttccctgccccttttgggtcaatgtttttgaaagaagacgttcatgtggaaacctagtgttgatctcttcagtcatttagcaagtcttcgaacacctattatatgccaggtaatggtgatttttataatttggcctgtttattaatgaacaacttaaagtaggtaaataattcctaatggtgaatgagtccatctgaggcaaaatctgataattatcaccatatattctgcagaagagaagatctaatcataaccttaacatcctattaatcctgaaaagggatatgaatagtaaaattcagatgtatttaatcagaaaccatatgtcatctgtcagctttactttattcataaaagtatccatgctgtgaggtttttttccttcttcttcttctttgaaaatatatccttctctatggttctctcctttttctttttgaatttaagcgttcacaccatttttcattttttaagaacagtggttcccaaccctggatgcacattagagtcatctagaaagctttaaaaaattatgtcctacctcaagttgagtaaatcagaatatcagggccaggcgcggtggctcacacctataatcccagcactttgggaggccaaggcaggcagatcacttgagctcaggagtttgagaccagcctgggcaacatggtaaaacctggtatctataaaaaaaaaaaagtaaaataaataaataatatatttatatatatttatataaaaatattatataaataaataataagaataccagggacttgggtggccttagtttcaaaatgtcctcaggtgtctctagtgtgccctaggattgagagccactaatgtcaagtgtgtatgtccttttgtattttagaggtgggattgcagatgtctggaatgtctgtgaaaagagtcatgggatctgctaactagtagaaagcctcctcttgaaaaactgggaactaagaaaaggaaagagactttattccctttgatacctttagaaccatttctcagatatccactttatctaaacaagaaatggtaatgattggtgtaaaaaacttcccaccaaagaaaaatgcactgtgaattacctttcagagacaactgagactccatgtaagttcacatttgcatgggtacttgaaccaaattgcatttaaggttttccagctgcaggatccctcatgtaggatctatctctaacatttcctccaaatttaagacccgtggtagcctgattcttgattctcaccccccccccttttttttttgagacggagtctcgccctgtcaccaggctggagtgcagtggcatgatcacagctcaccgcaagctctgcctcccaggttcaagcgattctcctgccttagcctctcgagtagttgggactacaggcgcatgccaccacacctggctaattttttttgtatttttagtatagacgaggtttcgccatgttggccaggatggtctcgatctcttgacattgtgatccacgtgcctcggcctcccaaagtgctgggattacaggcatgagccactgctcccggcctaattctccttttgttgggcataagtgagaggaggggagatgtcttaaacgatttcgagaacttggttgacaggccctaccttgtgggaagagggaatggcccgtcatgctctcagatcccatctctcctcaagtcatttcaaggaaatatggacagtggtcaaattagtttgcgagcatttcttttttttattttattttattttattattattcttttttgagacggagtctcgctctgtcgcccaggctggagtgcagtggcacgatctccgctcactgcaaactccgcctcctgggttcgcgccattctcctgcctcagcctcccgagtagctgggaccacaggggcccgccaccacgcctggctaattttttgtgtttttaatatagatggggtttcaccatgttagccaggatggtctcgatctcctgaccttgtgatccgcccgcctcggcctcccaaagtgctaggattacaggcgtgagccaccgcgcctggctgcgaacatttcttacaattttcataggcatatgaaattttaccatcacaactatcaaagtataacagcagtgtggagattttcatcattcaagtgataagttgtgacatgaaattctgcgaaatttgcagttacaaaatccagcaccatccctttagacaagtagactgctctgttccctttttatggagagccttggtgacttgctccagatcgtacagctgttctgttctgtcgttaagttttgtcagagcatcagaggaacacttccataacctcagcatttctttggctggttgtttttgtaattagtacagagttcaattctagagccatgctggaattggtattttttggagtcacagctttgaggggaatctatttgtttttctcctaaaaggtaataattactaatggaaggtaaaacttagtggtctatttatacctcacttacttccaaaagtgatttaaagaaggttcgtgatctagcacattaagttagagaaagtaaaggaaattgaaagcaaggaaaggaagagaaagtgagttattttctccaggtttttatttctccatatttgaattcatctcaagcagatagtaagctgtcattcttaccaaaaaggaagaatgagtggtatctctagaaagacagaaattttcctggcaccagattctaaaggtttctcccttggaatattttacaaagacattaaataggaaggtggacaataactttaatagatgctttataacagttgcatatgtaattttcatgaggatgtttcttacagtgaccttcgataaatgattgcagcttcactttaacatgcaatgcggggattctatgtaggacaaaggtaatgcgtaccaggagcacttccctgagaagaagaaaaagaggagtagtcagttagctatacccgagggggcatttggatacccacaccatttattggccatccttggcctaaggtaatatccaacaactgtgggtttttgcagcaaactgacttaagtatcagaataatgggtaaatattatgccctaaaccagtggttcccaaatatggctgatcttcaggaccaggtagggagctactttgaaaatatgggtcccccaccccttgaggtctgatcagatggtctagggtaggaagtaagaaatctcagttctttccaggtaattctgagaaccacacaggcttggaaccacagctttagactgccttcgtaaatgtcacttctcttagctgagttttcaataaaagctatagggctggccttttgtatacacttagattataaggactgtctttaggccagatgggatttttccccagacagggactttggttctattccaaaactgacaaatgcttatttgacatcctgggaactagggccaagttcattcagatctaggaatcccttgagcagaattttaacctcattaaattagttccttgtttaattctctgcatgcttcatacttataacattttgattcactgttagtgttgccagtcaggttgagtctttgctctttgttctatcagtagttgggaagagggatctaattacaaggtctctaattgaataatccaggaggtcatttggaaaatagaaaatttcacgttaatgaacgttgatgaagcatttctgagctgagcatggtgtatgctgggcattctgtaagcattatctcagtaggtgcttagatagacattacagacatggaaagtgagtattattaaacatttagtcatttcagggccattgttgttttttcccaacacgtcctattcttcaactttctttcttcctaaattctgtggactcccctcgccaaaaaaaaaaaaaaaaaagtttttgtcttaccaatttttaactagcaacctaaccaggaaaattttgtttatttggaaccttgaactacatttttcctccacattgtatgttaggagaaggaaggaagtaagaaagtaaactcatatgaaggatttttgaaatattactcaggtacagcctggtcagcttagccttggtccagtttaaactatgaaaataaaattgttcttcataatggttggccaccttcattaaataagaattaaatgatgcaggtatggtagctcacacctgtaatcccagagctttgggaggctgaggcaggaggatcacttgaagccaggagtgcgagaccagcctgggcaacatagcgagaccccgtccctacaaaaataaaattatccgggtgtggtggcatacgcctatggcatgcgccagctactcaagatgctgaggcagaaggatcacttgagcccggggaattcaaggttgcagtgaagtatgatcataccattgcactccagcctatgtaacagaacaagaccctgtctcaaaaacaaattgtatttattacaccccatcgtgaacaggcaccagattgtagattaatgcagatgtcttggatccctctcttccaagccatatgactgacttgggcaagtgtgcttttctaggtctcagcttccgtctttgcaaagtggtgaaaatactagcccccactgtcctaaagggataaaaggaccagaggggaaaaatgtaaaaatgccatgaaagctacaagatgctgtacacagatcagattgaattgcttcattaactggaaattcttggattactatattgtctaaacattgagtccactgacgattgtacagaaccaggattgcattgttagttcccaccttcctctcagcagtcccgcatgtgacatcttcatgcctgtcaccacatcctgtcacaccaatcagcgggccttcttttcccctatggttcaacatgtataggcttcctgaacttcattcaaaggcagctgaatggtatatgaactttgaaatgtttccaacttgacattaaaacagcaagtgccaagtttcaacacttaaaaaaatcctcttaagcgctgaaacttggcatctgagtggggtttattatctttcagttaagtcaaaacaactaaattacatgagtttctatctcaaaatttaaagcaagtgtttttttgtttgttttttgtttgagacggagtttcgctcttgttgcccaagctggagtgcaatggcacaatctcagctcactgtaacctccgccacccgggttcaagtgattctcctacctcagcctcctgagtagctgggattataggcactacaggcgcacgccaacacgcccggctaattttttgtatttttagtagaattggggtttcaccatgttagccaggctggtctcgaactctggacctcaggtgattcacccgcctcggcctcccaaagtgttgggattacaggcgtgagccaccatgcctggtctaaagcagttgttttgtgagtaattttcaactattggcctagtgaatttaagcttttctttcatacgcagatgttcacgtaaacataatttcccaacatccagtcctacccttcttattaagagcatgtttacgacgtttggaatggagcagtgcaggagggatgactatgaccctgacgcaagcctggagtacagcgaggaagaaacctaccaacagttcctagacttctatgaggatgtgttgcccgagttcaagaacgtggggaaagtgattcagttcaaggtgggcatgcgtgtggaggaggggactggtttgcttcaccctgcagtacttaatggcacaagagagctgggacacaggctcagctggggtcaggcacgctagcactctataaatgtgacttccctctttctctctttccaccccctaccttgttgccaatgtcacgtcaataccacatgaaatcataaacatatattagcatggtatttcctgaatgctaggggtctagattggaaaggatctttcatttatttagtagctttgtgctccagttcttttccagcacatgaattctctgtatcaggtcccctgcatatagccatccagtccttcacttagaagctgcatgtgacaaacggtgcattcccttccttcctctgtaggtggcttccgtgtgcagtgtgacacaacttcactcactaagtttgttggtgcattgtgttgacagtgccgacttagcttccacccaaggtgtatgttctttcttctggagccacacaggaacataaatctagattccaccacctaacccccttcttttttttacactgtttttattcattggattctttcaatactgaatatagtattatacaaaccatggtctgtgatgcagcatacttggtgaaaaaggcattcagatgacacataattattttaaaatattccttaatgcaagggtaaggccagatgtaatctctgctgcccccaggacccattagttgaattctaatagggtgaagcttcctgccttgtctgtgatttcatcagatctgagctggaatgcctttgttatgttaaggcagggaaattgtcccataatttgggaaaagacaggaatagaaccgtgattttttttcctgcaagttgcaaatgatgatgaaaagttggaacacccccccaaaaatgaagatattcctgacatttaaggctatacttctatcaaccgacttcaagatttttaaaaattctttttattttttttttcctccttaaccttttgtttctggggcatatgccttcctgtcttcacattacttgtcagcacaagcaataactgctaaagtggaactgcctggtcacagccacacaataccatgttagaagcactggccgaggaggccatgtggtttgactagccttgtcacttcttcctgccttttccttatcctgaaagtgaggggactggattacgtcagtggttttcctcgtagggtttcttgattatactgcttctgtgaagtggtaatgggagggctgctttcagaactgcagagtagttaatggaaattgcacccttacttgcaacaggctgcacccacaaaccacaaccaccacaacgtattttttcttttgtttagagttctctcatcctggcttgcacagctgacatggattcccgaggccttttattcttccttctaagggtggtgttacaaactgtcactgagtatggatcctgctcgttttgggataccctaagaaaaatactctggaacaaatttgtaaaattatagattcattttgaacataaacgctaaacactagtatgaatatttgaggacctttttacatactattatataaaaacaaatcagatttgtcattgttgaaggcaaatgatcaaatatttaacctaactagtaataggaacagtacatatgaaaatgggatgatattcacacctatcaggcaaaaaaattataaattctattaataccaagagtagatgaggatgtgtacattagtaaaaccacttcagagagcagtttgtcaatacctagtgaaggtacgtgtaacctataaattggcacactcctggctatgcacagtagagagctctttatacccacagagacctgtttaagaatgctgactgcggtactgtttgtggatgaaaaattggaagcatcttgaaaaaccatcattctagagtagataagttttattatttggtatatccagtatacagtagttaagtttatgtgactacatcttgaaaaaagaatatggaataaatactattgatataaaattttaaaacatacaaagcaacactatatgttgtttatcaatacgtattacctgtttctttgcatatgtatatatatgtgtatacccattataaataatggacatttatatgtatgatacatatgtgtgggttttggcatgcatatgatgtatgtatatatgcctgtatctgtgtatttgtatttgtgtctgtgtaggtctatgtatgtatatgtgtgtttgtgtttggaatgtgaaggctacactcctagcctgtggagagtgttcacctatgtgatggaggagggagaagaatgggatagaagggcttcaactgagtctttaatgttttacatatgtaaatattctcattcagaagtggaaaacgttagtgttaaatctgggtagtgcatatataggctgattgatatcttctgtatttttatggatgtgtgaaacatttcatatttgtgggagaaaacagacctggaccaacagggatcaggcacgctgccatgtgccaagtacgccttaaatagatgcaagagtcagctagtatctctattttgcaatctttgattggtaactactttggggaatgttagcctggacaaacaacatttgatgaatggctggtttcttttcctgaattttttatgatagcattcttcattgctccctaggtcagctgcaatttggaacctcacctgaggggcaatgtatatgttcagtaccagtcgtaagtattctgcttgtggatgtcttcctgatttgtcacagtttgttgttctgtttctgttgatgtctgggatttttccactggatatataactttcatgtattttatttcttatgtttttatttttattttgtttttttcttttgagacggagtttcgctcttgttgcccaggctagagtgcaatggcgtgttctcagctcactgccacctccacctcccaggttcaagtgattgtcctgcctcagcctcctgagtagctgggattacaggtgcctgccaccatgcccagctaattttttgtatttttagtagagatggggttttactatgatgaccaggctggtctcgaactcctgacctcaggtgatccacccacctcggcctcccaaagtactgggattacaggcgtgagccactgtgtttggcccagctttcatatattttaaaatatttaaataaaattaaagtttaaataaatctaaatatttaaaacttaaatattaagagttgaaacagaaatatagaatggatgtgaaaataatataagccgggcatggtggctcacacctgtcatcccaacacttttggaggctgaagtgggaggattgcttgaggccaggagttcaagaccagcctggtcaacatggcaaaaccccatctctactaaaaatacaaaaaattagccaggcgtggtggcaggcacctgtaatcccagctacttgggaggctgagacaggagaatcgcttcaagagagacctcatctctacaaaaaaatttaaaaattggccgaatgtggtggcatgtgctggtagtcccagctatttgtgaggctgaggcaggaggatcacttgagcccaggaggtcgaggctgcagtgaggtatgactgtaccacgacactctagcctgggggacagagtgagagtaagactccatctcaaaaagaaaaaaataataaatttatatttcattctttatatatttacatagttttgaatgttttacaatatggttatattattactcataattttaataattaaaatacaaactaataagggataactagaatagagaacataaaagcatttatagtgaaagagccggagattgaagcccaaaatcatcttagtgtgcatttgaccagctaagagagcaattaatgtatcatttcttcttatcttgctgtttgcctaggccataccatggctaatgggttaaattaaccagtgtaataagaagaacagcaatcctatctgagaaagaataggccctaataatggaaaacacttctgcatttttaatggtccaatcttttggattaagacggtttcattcaagccaatttccatgcattgaaacctctccgagggttagtaaaaagggttcctgaataaattgggagctttgggagcttgaccattttaatgactcttccctaggtacaaaatcagtgaacttggtggtcctacaataaattaataacggggttaattaatagtagagctaatctacatattaggaagttactgtaaagcatatcatttgatttttggtttaaagggaagaagaatgccaagcagccctttctctgtttaacggacgatggtatgcaggacgacagctgcagtgtgaattctgccccgtgacccggtggaaaatggcgatttgtggtaaaagacaaagtgatgatttttttcctcaattgttccactgctatataaagggatattctttgggggaaacccagtattttcaagtggtgaggcatagctttttgcctcacacagtagatgagcagagaactttatataaagaacaccacagtttagatctgtaaccgacctcaatgagtcacttgatagatgaagtgactgaggtcacaacgtattggtgacagaggtggggctagaattccagtcttccaatcttcagtcctgggctctgtgtctgacaaatcaggaagcctgaggagtttacgtctgtggaagccccatttcccttgttgcagtttcagaggtattttatattcattggctcacttcacttgagctgtttgtttgtttctttctttccatctttatccctaatgaatcttctgtcatgaccacctacgttaccttgcccatagcatttcctgccttacttggaataatacatccttctgtgcactagagactaattgtaggcttgggatcagttaaacatgaatgcagtcagactgacatcggacagtggcaacccaatcaggaaatgatccagtcttgtgcagaatagccagcagttttgaaggcctagttatgttctgatttctctcagtggactgttccctaggtgaaaagagatgagctctaaatgcctctggggagcacttatcttaccgtttacttgtgtttctttgctgtatacatgcctgcctaacgcaaagtcagaatctttggcaagcttgtcttccttggattctgtcattctgaaaccatttatgaagggaaaagaaagattttaggattcctggctaagggaaaccagaagaaccattacactttaaaggctcgggggatggaagaggtggaattgttcgctccataaaggcagttacttttgtcagttcctgggaatccagtgtgagttcagtgaggagcttctgagtgtgaccttgactcctccaaagcaggggactatttcattaaaaaaaaaaaaacactttattttccttattgactaaagacactgagcatcttttcattattggccatttgtatgtcttctttggagagatgtctgtttggatcctttgcctattttctaactaggctctttgtctttttattattgagttgtaagagttcttggtatattctccatacaagtacctggtcacaaatatgatttgcagatattttctcccattttgtaggttcttttcacttcatgttcttttgaaatacaagttgtaaattttgatgaaatccaacttaactatttttttgtttgttttggtgtcacatctaggatgacattgcttagcccagggtcacaaagatttacttgtatgttttcttcaaggtcatagtttcatttcttaacatttaggtcttggatacagtttaatttttgtatatagtatgtggtacggaggtatttcacttctaactgttgtgcatatctggggaatttactgcttttaaaaaacgtttgagaaccccaaagatctcaaaattgttcgaatagattttatctgtgataagaatcttctgtattaaaagcacttagtgaatttgaagcattagtgtaatgtttataatcttaaagtttaaagaaaatatagactcctctatgtttaataggccttctcttttttttttgagagtgagtctcactctgtcgcccaggctggagtgcagtggcataattttggctcactgcaacctccacctcctgggtttaagtgattctcatgcctccgcctcctgagtagctgggattacaagcgcctgccaccacgcccagctaatttttgtatttttagtagagatggggtttcgccatgttggccaggctggtctcaaactcctgacctcaggtctgtgcccgcctcagcctcccaaagtgttaggattacaggtgtgagccaccgcacctggccacgccttctcttttgaccagtggttctggcctgtttcctccatgccatcaaaccgtgctaccacagggacccaaagagctggctatttgatgttaatcagggatcaaaatcgtcaatcagtgggaaggtgaaacctggagaagataacgtggtcaccatttgctcagttgcagtctgcaccataatccaacaggggcacaggctattctgcttaatgaaaacttctgatttgttacctttcagagtgtcatttattagagcacgtttgaaatcgtgggaaccaaattatgacatcaatttatgtaagccccttttacataatacacagtagaaaatagttctagcatatccaaatatcagaaatgtaccttcggaaaaggataaagtagcatcttcagaatatgcagtgataagtgctgtttcatcactgtgccattgcaggtttatttgaaatacaacaatgtccaagaggaaagcactgcaactttcttcatgtgttcagaaatcccaacaatgaattctgggaagctaatagagacatctacttgtctccagatcggactggctcctcctttgggaagaactccgaaaggagggagaggatgggccaccacgacgactactacagcaggctgcggggaaggagaaaccctagtccagaccactcctacaaaagaaatggggaatccgagaggaaaagtagtcgtcacagggggaagaaatctcacaaacgcacatcaaagagtcgggagaggcacaattcacgaagcagaggaagaaatagggaccgcagcagggaccgcagccggggccggggcagccggagccggagccggagccggagccgcaggagccgccgcagccggagccaaagttcctctaggtcccgaagtcgtggcaggaggaggtcgggtaatagagacagaactgttcagagtcccaaatccaaataaactagttttgttcttaa

SEQ ID NO: 516 - DNA, 644700 bp, Homo sapiens
ttattttttcaaatggtgtagccgccggaggtgcggtgctcagttcttggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgggctagcacctgaggatggaagcggcgaggagccgggcggtgtgtgggctttgctgtttcgtgtttgaaggagatcatgaaagggtgtgcctggctcacgcggctccatactattgcccagtgttttccgagcatctccatccttggccgcgagtgtcaccagctccccctgtgatggtgaaaggcagtcaggtaactccctacttcctggaaactttctccctcaccgctctccccccatattaacaagttgttttcttggacgttgcttagcatttaaggttttggggacggggggtgcagacagggtggtccagcggggctttctggcaacctccaggcatgacatctctttcttctcgccactgctctgtctctttgggtgtagtctctcccttttctctcccagttcccagagcctccctgtttgcactcttcctcttctcttcccctgaaagcctatctgtcactgctggtctctgttccttccctgggttcttcccagtgatcctctgaagaccagcctggtggaaggagttgtctccaggtctttttgtccagctttttccctctgtttgctcccagctccaccttttggggacagggccttcactctttagagccagaagctgccatccagcctgcctggtctccatctatcctgaaaccgattttggggccagtcttctctgctttccagcatgggtggcagcttggggattgtggcctcctttggaagaaagaatcttgtcaagggtcatgggttctagggtgagccagagctttggggtcacaagggcagtatccatgtttggatttctctactgttgaccccatccctcacctgatcccctctcccttctgtagctgatgggctagtgaatggtttaggagggaaggagtgagacacaaaagagggtggtatttgtgaagagtggggatgcaagatgactcccctccaggttctgagactgcgtgctttacccacctcctcagtctaagcagcattgaagaggagagctctgtagtattgccctaagtatcactgtcaatggcaatgtactgtggtaataatagtgattattcaccttattcacaggatgataatcttaactagtttacaaggtctcctcttagtgcaggataaaccccttctgaacccatttccttactctggttgttttctttggcccctttgcctctcagcatctccctgctgtatgctgggagcagacattaaaagtaggagtgccaaccccagagaggttcctgagaaaggtagaggggaagggagcaagggagccagcggctgagagctctacctttccagcaacatgccagcaaacgctatggcaacctgaattccagttctctcccttgaagctgcagtgattatataattcatgggagcagttttgcctccatttctagatgcggttcccaggtggaagagcaccaagatccctgtctcccctctactctccatcttctcttctttagttggttggcattgccgaggttgttggggtaggagaggggaggagggtggtggaggtgggaagggcagacctagaacagaatgaatattgacaaggaagaggttgctgtggctaatcactaaagggggcgggtgagccatcataggggttagagtttcaggagacagaagaggagtctaggactgcctcagaagatcagtaatggtgacgaaacaaagagtcgagaaccaaaaaagttgtcagtggcgggggctgtgcattcctctcttcccgacatgctctgagatgtggaatgcaccagtccttgctccctcaccttttccgtggagtgtgtgcatgtgtgagtgtgtgtgagtgtgtgtgtgtgtgtgtgtgtgtgtgtgtgtgtgtgtgtgttgagggtcgaactggagactggaggtcagtgcctgggaacagcctggaagttcattgaaggaccagcttctgaccctgggtttcaggctggggtggcacactcaagccttgcctcgcctctggtgccctgtctgctctgggcctgtgccagcctcccacttttctgggccgattttctattgcaggctccagctagcaaatgagtgtcttaatagtcaaccattgaacaaataaaacaccagaatgtcccttatctgctagagacaaggcagaggggagaaacatgtgtttggggagtgcaagacacactgtgcttttcttttaactacttagcgattcagcagaataagaatcactgtaataaggtaataataataatgatcacagttaactttctttacaaatggtcagagaacaacattgctcgcacatcagcttgagcaggttaaagaaagctgtggcaatagctttgctttttcttgatcctgcatggagaaaactggaggaaaggggctattggagttcatcatattattcctactattggtcaggcactttttagtgttttagaatatgacaatatattaaaaagagtcaatttttcattatttccatagaatacacactaacagtatttaagtgtgtgtgtgtatacatacacacatggaataaggaaaagctattttaaatagatcacacgagaggctaatgcccttcagggacctggggtgttgagagagaagtattgataatgcagtctcctaagactgtttaaagatttcttcttcatagtaaagggagacttgttcttacaggtagatgctgcaggcacagtgctttgtaaatgaaatgatgagccgttagccccgtgggaccatctctcagtcttggcaatgacctaggtctcttcaatttgttcttcaaataaaactgcttgagttgggttcttctgtaagacctatcaaagggatccaaggagcatactgactggagatttcgaggccctgctcatcttgggatccctgcttcctagtacaggccgctgctcagtccagggcctcgatgcaaggctgaacaaataaatgtctgcgtgaatgaatgaatgcgacctggccagacctgcagtagatgtggcttctgcctcttccagtaggtggcgccacagggcttaggagtcaggaaaggggcttcagggtccgcctggtgatgaaaggtgtagggggagtttagagcttgtgacctgttggggctgtgctgcttccatcaggcccacacctgccccggcacaggtaacccaaaagaccagtgtgtctccgtgccgccgcacacactggaggccctcgcggcatcactgagggacccaggtcccacagtgacctctccaccctgttgtaatgagaactcctttggagcccacccagtccgtcgcaggctcttcccacagacgtctgttcccttccagcacagacagcatcccgccgagcctggaggaagccttttgggtgaatcgctgaacttggtatggccagatgttaattttctccctgatttttcactgatggtttagtaaccagagggcccggtggtgcccaagcccagtggagcatggggtgacctgaagcatgggatctgggaacccagacctgtgcagtcacagagcttgccagccaaaggcaggaggacattttcctaactttaatagggaaaagaacacaaaaacaactgggtgcacttcacagttgatttccgtttatgagtctgcctggatctcctgctgggtaatggcagaaaagctcaggagacccaggttaggaagtaactgagatttgttctaatttccagtgatgttttccagcgcctggcattttcttttctattcctttcttcactcggttttcttagttgtgtggcaagttccatgaggtctgagaagcccttggcactgtgctaagaaggggtgagtggctggcagcactttcttccttttacagtaattcctcccgcctgatacagcagctgtttgttctgtaggaggtacaggtcagccggcgtcatctcacctcttccttgctgggaccctgaaatcagtgctgagcattcagatttagcagacaattttattttccaatatggactacagaaagctgatagactgtttgcgaaacacctggagacttaacaacaagcctaattaacaaaataatcacactgatttcatctgtttctagattccatcctcacagttgcctaggttaatgttgggcactgtggaggagaacagaagattggttttaaaaaaaaaggcatggggaattgttttgcaacatatcaggtgccaaatatttagggacagaagtgctaaacattctgataatgaaataacactctgagccatggctgtcattattaaaataatttagtaaacacctgtttacatgtacctcaaggttagataccacgtaaaacaagtaaaagtgacaggatccctcggggaaaatggaatggaatgtttttcggtgtcatttcgaagccgggtgtgtagacttaaactgaacccactgcagaaaaagcaaaatggaaggctgaaataatgaatgccatcatttgaactgaaacctgggcactccagaagagctcttctctgtgttttaattcctagatggggtgcttatttgctcaagaccaggctttcctgagcctgtgtagacacgggcctggagcaggtagacagaccctcttggtttctatagttgaggcacccctggaggcagctgtttatcatggcaggaagggaagtggatgcattctctactgccccctttcccctgccgaattcaggcaggacccgcgcaggtccctggagaaccttgcttcagtgctagctgtgtgtaccgtgtgggcaggaccccagctgggagatggggagcccaggatgaccccacagaaaagcagagctgtgagatggctggagcctccgagagctgagatgcagaaggtgaggggaagccagaggagccccaactccctagggtgtctgggagggtttggggaacaaggtcatcagggtagtcagttactccttgtggagctgaactgaatttaagttgggattgtagggactgtaggagagaagtttgggcctggagctcaggagtcggaccgaggttgaaaatagacccttccttccctggaagccgagggaactagaggaagggttcatctggctgaagcagagggtgaggaaagcgggggttaactggcaagaaacccaaacctctcagcccctcccctccccaaaaccccacagaacagttctctgcaaaacaccttcactttaaaatgggcttcttgtgctataccctgtgtgtatagggggcaaggggctaggctctggttcgttaaagggtttgtcaaacatagaataaatgtaatgtctctttgggaatttactttctaggatcaggacattttatgggtaaaggaaccttagagacaatcctcatttccagttgagaaaacagaggcccctaaaggttcatggaggcagggatgtaactaaatacaaggtcttcagtctcttcatcctcctgcctgtaccacacttggtgctggccccctgagagagcattgttagtgcttctggctaaattttgcttggtagatctttcaacctctctattcttcctccccctgcctccacctttgtactgccttaaaataatttctgcgatgttagatttaggaatggagttggaagggtggggtgggggaaatctatcattggaaaggtttaaaaacactttcttaggctacagagtagaagttcatacatgtccacaagaaactcctgcaaaattcagatcacgattttgtctgcaaacagatctgcctctaagccttttttatttgctcacttcctctcggccccaatctaggcttgtttcagcccctttgcgagagtgggatggggatgggaagccgggctgtgctgtgggacttccctggtgagctgctgggattcttcatggaccagctggcattaccagtagctggggtatagacacacagatcagccccagggtagagactgtgagacaggctgccacagactccacctgagctgggcgaccaagggcgtctttctgctcccatgtcagggttggtctcctaggacccccggcctactcccaggagacattcccagcagtggtggtagactcagcccatggaagagaatcactaggacctgcctctgacattcccatcttccttgaagtgttcattggctgacttgtttcatactctttcaagtcatctctgagaaactggaaggcctctgaggctgactcggtctagcttgaagacggaggcatgagccaggctcatgcttagagatgtggcttttgagttccctggaggaagccatcatttcagaacatagtgttgtgataatttcatgaaatattcaagctgccaatttgccaacaggggtttcttttaatacactcggctacacttggtgttgcccacttgaacctagctaaaaggaaaataaaataatcttgtctcctgtcctttagagaaccaagccaaaatctagacagtgaatgaatgttcttctccatattgcctgtgggcagaaatgttgacttgagtactcaattaagctctatttactttataaccattgtgtcatgtacagtcatttatattcctttctttcttccaaaataatctacgttgggctaaaacctttcaaagacattaacaaaagtaacaaagtaaatagctaaagaataaataaggctgtaggctagagaaatgacttgggtcttgggtcacattctttgacttcatctctttctctgagagttcagaaggaatcaaatccctttttttttttttgtctgtaaagtggagataataatccttagccaattcacttcgcagggcagctgtgaggatccaaataggagaatgagtgtatatcgctgttcaaacatcagctactcttattctccccatcagcgagcagagcaccagagtttggaaaagcaacgccatgaagtaacattcacagcatttcaaacaactttggaggtgttgtgggagggctgacattattcaatattttaaaggtgaaaatgtaaaacaaagagaaaccagagtctgaggtggtctggctgataccagaataatcagggaggaagtgaaccattggttgagatgggcctggtattttgccctccagagagtctaggagcctgtggccagtaggctcccaggacggtggagccatgtgcactgctggcactgctgctgtttccaagctgagggtgaggacatggggatgcagggtatccgacgcctggcagctgtccacctgccatgctgctgtcccctcactgccaccacacatggctgcctggcttcggcctcaagtccaaagccacgctggcctgaagtcctttcatggcctgaaaatagggccattgagggcaggaagaacaccacctgggcaaccaatgtctcctcacttttgaacgtgaattccccaaacctaaacccaacttcccagtacaggaggacgggctggaaaataaaactttgcttcaaaagtaaactttgggtttggaaaataaacttatttatttttcatagccaaaatgttgcaggtttggagatagaggggacagttctgtgtagctccctaagacactgatcaaaataggaaagagctttaacattatagtctaagtgacaggattagttttagtttcccaaagcaaaaataatcccatcatcaaaaagtatgctgggaaactttcgcactttcgcatttgtttgcaccttgttctacccccagctctggtcctgtgatctgtggagccatatatgttttaatttttctctaaagaaaaaaagctgtattgaggtataacatctaccttgttataattttaaaatagagcaagagtaatagccaccatttattgaatgcctagcatgtgttagacaatgttcttggtgcttcatgtgcttaatatgttttatccttacagtaatcctaccacgtgggttttaattatattttttagataaggaaactgaggaccaaagtcttaagcaatgtggccacagccacccagacagtgttggggctgggaattaaattcaggtctgtcggactttcaaaacatttgctctttctgttacttctccccatggagaacagtagaaagagaaacccactatctctctatcctgggaaaatgaccttgtccttgccttctggaacctggcttagatttgccttgtggaagctcagagctggaatccttgttcttacttgatggctgcatgttgtcgtggtaccccgcctcccctcctggtcccgtcctctggctttctttccccttattcccagggtttctgccagggccctccttgcttcttcacatctcctcacaggccttcacagaccacctaggtcagtacaccttgtctcccgggggacccatttgtggcatggccttgcttcaccacccattcttggaatatttcctcagtcactccctccaggaaaatagacactctccattctcaaacgagattcccgtgagtcccggggaccatccctgtaagctgagctctccagacttcatgcattatttatttatttattttgaaatagcagctttgttgaggtataattcgcataccgtaaaatttacccttttgatgtgtatgattcagtggtctacctacttccccaatattttcatcacccgcaaaaaataccctttacccattggtagtcacttttcattcccctctctctccagcccttggcaaccatgaatttacttttgtctctatggattttcatgtgttattgacagcaataataattccttttttttttttttcctgaggtgtagtctcgctctgtcaccaggctggagtgcagtggtacgatctcgtctcactgcaacctccgactccctggttcaagcgattctcctgcctcagtctcctgagtagctgggactacaggcacccaccaccatgcctggcttatttttgtatttttagtagagatgggatttcaccatgttggccaggatggtctccatctcctgacctcttgatccacccgcttggcctcccaaagtgctgggattacaggcgtgaaccactgtgcccagccaacagcaataataattctacagttggagtttgctgtgtagtctgactgttgataacatatctcacaaatttcagacctagataggtcatgacaatttacatgataaatgatgacattgaaaggaagcacgtgaaattagggagctggctgtcatttggaggtgggattaagcgttttctttcaattatacaaaaaagtggttttagcatttttcaaaggtatcttagcataatgtcttcaaggttcatccacgttgtaccatgtgtcaggacttcgttcctttttatggctgaatagtatttcattgaaagcacacgccacattttgcttatccattcttctgttgatggacacttgcgttttcaccttttggctattgtgaatggtgctgcaatgaacaccagtattcaagtatctatttgaatccatttttagttattttgggtttacctaggagtggaattgctggccctgcaatatgactttttagctttaagagcccacttccttgggtagtgccccaaatttgaagcccacgtagatgagactacagcattaggaaatcctattgtgtcagtagtgagggtttggtatttagtctgggctcccagttcctataccagaaatttgactttaattggtgtttcacaatctgacagctgccttttgatgaggagtgactgatactgcctctgttcaaaaaaacaaaatgaaacaaaaacgaaacaaaaaaaaccggtgtctctatatccagttcagctttcacctcgttgctgacctggcttcgtaactcaacaggaaattggtgtttggcaagacaaagctatttagtctgtctctgtctctccctctgcctgtgtgtctagtccaggagcacccatgtctgtggctagagatgtgggcctgataagcctggggactgttgggagagggtggctcccctcatgtgtggctgggccgagtcctccctggactgtgagggggaggcagctctgtgctctgtgctggccaggtgctgcctgccctgccccaggcatgactgattaataagggatctctgccttcagcctgaaagctgccttcagaggggaaaagcagcttcccagggctctcacctgctcctcatacatctaaagtctaggcaagagaggcaaaaacgtgagaagaaaggtaaacagtccggggagaaaattgggaaaggaggaaggggagagggaagcgagcagtgggtagacagccaggggaaacagcagcacgtggtaggctcttggctgtggattgatgccccagttaaatgactctggaagcctctttccagtcttgggataggtattttcttggtgatcattttacctaagagtgataatatcatcggctgcatttctgtcttagcatgttgaactctgctaatctgaggaagaaacacacacatacattgatgcctcagctgaacccattaatcagagacctgggtatggataaaaaagcgcacaggctcatggaggtatgtgaagctcagaagactttgcactttgaaggccaatgtacttaatttaatccaaccgactattagtaaattcctctcctttgggctctgccctcacaccccctcactggccctgctcacaggtgcctctgggccgctgtgcagagctggaatgttgcacagcatttctccaaggtggaagcttctgttgccatatctggctgcctgagacatcctggggattcgagctatacatccaagtggatttcagtgactcagagctcatatttggtctgtcgtgaataggatcttgtgcctctgtttttaaaattatttaaaaggcaaaaattttgacctatgcccagctgtctgaaagaccaggagataagaagccttttctaggataaattgactgtgaaatatctctgaaaatgaactgtctcatgccagttgtgatgaaaacaattctaaatagttttttttcctccagaataggaatggttagtcattaacaaaaagttattgagcgtctgctatctgcaaggcagtttgcttataggatctctggattcaagggtatcttcaaggtacagccctcaactatcccttcctttaagggaagtatctattctaggaggtaagatttatgcctagacacacagacatccgcaactgtaataaaaggcagaacatgcttgatgttacaaggatataaagataaaggctcacagatttaaagaagaagggtggtatggaaagatggaataaatggaggaagtgttatatggaggttgtgactgagccgtcccttgaagggtggatagaaatggggtggagaggagaggcgcacattcccaacagaaagggtgggatggcctgtaatgtattcacagggatgtgcgttggatttcaaaggagtagtgagttgagtttggctggagcaaggttttgcagggggaagaagtgggagagaaagttggaatggcaggaaggggataatgcgtggagcaccctgtattgggctgaagagtttgcatggcatttggtaggcaatggagggccgtttaaagtgtttgagtggagagagggtatactcagagctgctcttccaggcagcaggctagaggataaggtaggggagtcgaggctgcaggtagaggggcagttctgaggctgttgccactgtccaggcaagagagggaaggagtgattttcccagcagaaagccagagacaagggagccctgtgctgtgatctggatgggaagggtagaggttgtatttggaggcaagtagaagatgcccagcatgcacgcagaattagagttctgtctaagaaggtgctatttgaagctgtggaggtggagccattggggagagagagagcagagggaaggaacgatggagagctgaagacagacaggaggagggtaaaatggaggagacaatgacagagtagtcagggaggtagcgggagagccttactactgcagggtcttggggatcaaggcaggagagcatttccaggaggccgtcattgctgaatggagtcgtgaaagggaagatgggaactgagaagcccgctggattgaatgattgggctggagagtgggttcagagtgactgttgtcccgccgaactgtgcaatgatgaggcgtggtggttgtgaagcaggggcagcacatggggaccactctttcaagaattttggctgtgaataaaaggagaggggagggatttgttggcacatgagagattggaaatgcaagagaggggagcagatggggaagaaggcagtaggcagtggcgttggggatgggagtggaaggctcaaccccagcaaaggaggtagcactctgtcttcagaggcagacatgcagtaaagcaggggatgaggaaacgtagaggggcatggggggagctggaaaggaggacaggaggggcctcgggcaggggtgctgaatcctgggagggatgaggcagctggagtggggcctgagcttgaggagaccggaagagggaacggtcagtgggaaacactatgagacacccaaagaaatccacaagggtgcccaggtcccagaggcaccggccgaggtctggaagcatgagttaggggccaggagtgattggcattcctagagaaagcttccccagaaatgaatttggcaaagtgagacagctgctgactaggtctgggggcaaagggttctagctctgtaggaggcgtgccaagctcgagctggtgtgggagaatcaaggtggccagtgggatgcaggagccaggatgcatcgttttagtgggagtcagggagtctgaatcccccagcctgcctccatcccaggtggattagtcatcagaatagccaatgggccccttgagctctgagtggatgcacaaagggccaggtggactttctttggggagcataacaggaagaagatgacaaaagcctgggtggtggagatggtggcagtttaaggatgtgggcttaggactgtggactaggatgcacgtgtgtgtgtgtgtgtgtgtgtgtgtgtgtgtgcgcgcgtgtgcgtgcctgtatgtaagggcaggcacatgaagacagactttattggtttcacagtttggcctccagagggtcttctgggtgctgacaccaaagcagagagagctcgtggtgtgcagccctgaggtcacgtttgtgacgtggatggaaggaagcaggggatgggaggactggtggaggtggacgtcagacaccaggcttcccacagactgtcttgggcatcaaggacaaggaacctgcactgttaacctcagtcagggcgcaacggtagaaaggaggagtgatggggcaatcaagaccacaagtgccaacctcagcgcactcacctggagaatacttaccttcacactgttcccacccctgtctttccatgcccttccatccaaaccaagcccagcttcacagcctatgatattggctctctggagaaccggttagcctttgtggagtgttaagccctgcgattttatatccttataattatatcagaatatcaaattcctgagaacagaacattttgttatttttttcttcatcctctcccctgttgtaatcccacaagaaaaatgttacaaaccactggaaagcctctggttggatcccacttgagctttacaatgccttgatttccctgtaatcaagaaaaatatgatatcctgaatgtttcatgaaaggatgtgagtctttgatgccaaggacagtaacactccttgaatgccatggaaatatgctctgctgagtggctctgagcttacccttggtgtaggaaggtgtgaatgaccagcaggtaccccccagaccctgccccagtccctgtcacatatgcagaggactctggttgggaggggtctggtgtgggggagggttgtgagtggcctggaggcctttcccggaggcaggcagagaggcggtggctgcaaagacctagtgtctctgagttgaggaggctgggcttctgcacctcactcaaattctctgcagcggccagagcccctgcatccattcttatatgttggcattgttcccaaaagaggcacagttgttgacttctcatagatgccaattttcgtgatgtttgcaatactagctcctcatggtaaaatgcatagacagtccagtggccccaagtccttgcctttgttcttccatttttggctagggaagtagcactagtcttctgtgtgccttgcctggaaacagtgtgttatgacggccctcgtgggagttggcatggcaggccctgtggccaccatctcaccccgtctggcctcatctggaaacctacttgcagagtttggccttattctgatgaacctcaagggcagcgctgaccccagcttgatctcttgctgggtctgggcaacaaaaggctttgggatttttccttttttccactccagtgaaacttaggcggaatgcaatgttttcctctgagggtatcagttggggaatgaactcagagtccagatggacagggttccgcagttccagctgctgccatactcagacaactggtcctctgcatttctttggagtttgacttggctttaataaaatgaaggagaaaagaaaattttgaggaagaaaatgaccagaagaagaatgtccttgagttgagggaagccatggaatgggctggtatcctgagaagtggactcagctcttcttcagagacctgtagacatcacagcctgcaatcccatgcgtccttggccctcagactggtacagctagcatccctcctaatgatttttcctgggtctgtctgaaagggtgaggataaaatggcaatcagggtcatcaacttacatctttcaggcccagaaggaaatgaacagaaaagttaaaccaaagacggagccttatggaaagattcctctaacacttgggagccaaaccccaagttatttgacttgcatgtggggggtgtgcctgtacgtgtgtggatgtgcatttgtgtgtgtcagagagaaaataagaagcagaggaggagagagcagtgtgaccgagcttgtaacccctgaaagacagcatgtggtcacaagatacagccatatctgggagcaggaatttatgttttagatgtattgttatctgtcacattggcattttgttcgaaccatttaattttcccatgtctaggattctgcatctgaccttcctaccatatgaatctatttattcttgtaacctcacttataatgaccgttacttgagtatttcaaagggattgatggaaatatggcaggagaaaactttgtgtctggtcctttacgtactattggctgcattgggacattatagcatagactcaaatgcttaaagagtcttttcttttctttttttcttgagacggcgtcactctgttgtccaggctggagtgcagtcatgtgataatggctcacggcagcctcaaattcctggactcaagcaatcctcctgagtagctgggactacaagtgtctgccaccatgcctggatacattttaaattttttgtagaggcagggtctcactgtcttttccaggcttgtttcaaactcctggcctcaagtgatcttcccgccttggcctcccaaaatgctggcattataggcttgagccaccatgcccagccttaaagagcatttctgagctaaatttgcattaagaaagaatgtcttgggggtcgagcgggaagagtataaaagagccttgctccatgacttcaaaaatagtaccagagacaaaggactttgggtcttaaaggaatgaggatgtcccatgtttgcctggccttgcatatgaaactactgagagagtcttaaatcggggatgctttatcttacttgtggtaggtgtgactaagaagtcacacccattttcaagaaagtctttgagaggaagctttattgcatcttgcattccttttcttctttctgagtttctttcctagtactgaagcatatattttttagttctttcagcaatggtctatgagtggtaaacttcctcagtctttgtctgaaattttcttttattccttttggcttctcattctagaatgatagtttagtcaggtacaggattctgtgttagcagttatctttcttcagcagtttaaagatattccattatcttctggattctattgttgctgatgagaagtctgctgtcagtctaaatgaataatcaatattctaatttttgaaaagatatattagtgttacgcagttttacaatgatgtgttaattacatagattaaaatatattgctgggagttggtgagatacttcaacttgaagattcgtatcactcaccagttcttagtcattatctctttctttctttcccttcctttctttttttttctttctttctctcttcctttttctttctttattttctttctttcccttccttccttccttccttttctctctccttccttcctccttccttccctttcccctttccccttccctccctccctccctgcctgcctgccttccttccttctctctctccttccttccttctctttctccttccttccttcctccttccttccctttccccttcccttcctccctccctcccttccttccttccttctctttctccttccttcctccttccttccctttccccttcccccttcccgcttccccctcctccctccctccctccctccctccctccctccctgcctgcctgcctgcctgcctgcctgcctgcctgccttcctccttccctttgcttccctttcctttgacagggtctcactctgttgcccaggcttgagcacagtgagtacttggctcactgcagccttgacctcccaggctcaagcaatccttccacctcagcctcctgagtagctgggactggagatgtgcggcaccatgcccaactaattgtttcatttttagtagagatgagatgaggtcttgctatgttgccgaggctgatcttgaactcctaagctccagtgatgataccacctcagcttcttaaagtgctgggattataggcatgagctactaccgctcccagcctcacgatcttttcaaatattatctctcccctagtcactctattttgttcctctggaactctattattaaaacatgtattgatctttctcattttactctttcttttaaatgttctttcatattccatattttgttatctatcctctgctacactctggataatttcttctgctttgctttccagttcaccagtttccccctcatttgtatctgctgcttagcctttaaatgcatttgcaatttcaatgacattttattcctggaagttctactttttcaaatattttagttttttcatagagtatctttttccctttataatttccattgtgaatgatttcacaatatgtgcgtgaattctccattccttggtgctctgagcatggcctgccatactgccagaactggaaatttgaacctgtgttttatagtccactaataatactttactaccatcacaaggatgttgtgaagacaaatgagataatggatgtggacatgctttgaaagtattcgtatatttaccggaaaggggttataataaatatacctctgcttggcttgttaaataattctctcttgaatcagacatttaataaaactgtatttgtaaggggaaactcttcaaatgtatgcaacaagattatatatatacaaatatatatatatacaaaaaatatatatatatttggaaacagagtctcgctgtgtcacccaggctggagtgcagtgatgctatcttggctcactgcaacctccacgttccgggttcaagcagttctcctgccccagcctcctgagtagctgggactacaggcacacgccaccgtgcctggctaatttttttgtattttagtagagacggggtttcactgtgttgccctggctggtctcaaactcctgaggtcaggcaatccgcccgcctcggcctcccagagtgctaggattataggtatgagccactgcacccagcctgacaagataatatttaatagcttacctcctttattgcctcctattcatggcacctaatgatttctagtctgttcgatggaacttacttatttacagagtgttttaaactttcaagatgttagtccatggtttctccttttcaatgttttggtatataatttggtatatgaggtatatatcagatctacattaaaatatatttttggtacattaggtatctattaggtaaattaggttaggtgtattgggtatatgtcaggtatattaggctaactcattctactaccttcatttagggaaccgaagacagggcagactgtcagtcaacaatcaatcaatccatgttaaatgtgtgctcactgtgagcttggcactgtaatagccattggcagagggcataaacaagcataaccaattttgacagccatgtattaagtgtctactagataccagacggacacagtgatagatacgttgatgaataaaacagatgggcatctgctgtgctagagcggacagtggggccgctggctggaagtgcatcacacattctcagtggcggcaacacggaccattgttaaaccacactcgtttgagaagtgagtgaatctttcagctctcaaagtcttgctctgttttccatggagctccagtgcacaggcagataccctggctccatcaaggaccaagtgtttaaaaaaacgtggtccaacagatcagcagcttttggtataagggggtcaaatacaggatgaaacatgatattttgtgaggttgagtggctatctctatgtcactgaagtttgtctttggttgtcaccttacccttctgtgcccttccattgctgtggaacattctcacttcaccctcagggatctagggcttctcccttgtatctctccttccctctgctgaaacatgaccacagagaaagggcccttgctgcactgttcttgctcatcctggcaatgcagtgctggctgtgtcttggaggagctgggctggccctccaggccaactttgccaggagacagcacaggtgggaggagaacggtctttaggatgtagctgaaagccccacaggagcagagccacctggaacctgctcagagggcggctggaatcaactatttacatttttgtataaatttaagtcattttgtcttccctctgaagtatttgcatgttcagccttttctctaattgtgaaatgaaagactgtctcctttccaagaatttcaggcatcagcaaataagttcaggaggaattagtaagatggaaatcatcctgtggatgattttgcccagcctatgacttccagttaaatccggcaaaggagaaatctaagatgacaaataggtttcagatcctgtgtggatccaggactggttatggccacctggagtgctctgttgaaaggaccctgaaccattgcctaagctcctaggggaaagtgttcagtgatggattagtgatgtctgccataggcctaggcaggagtgaaggtaagcggcaccactgcaattctggccattcctcatagagtcagagagttgcttaggttgtattttatacagcaagttgattcaatcattgccatcaaacaaatacccaattcagtgaaaaaaaaatcagttgaagtatgtgttaggataatgtagataatgtaggaaaaaacatctgcccattaaaaattatattcttccctttttattcagctaggttggtaaatcatagacatatttttaaaggtgaattaatttgagagcttctaatttctgttctagactcctgaaggagtctgcaaataatactttatagttttactgcaccttcattctaaggatttttcaaaacatctcatgcatgttgtctcattgcattgtttacttgaccccatgacagatttgtttccagcatacaggtggggaaactgaggctcggagatgatctgacttgccgaaagttgaatggcaagtctgagcaggtgcaggcttggccctgctcttcttcctttgtaccatgaacttgttgcgactcctctggggtctcctctgggagatggaaatttccatccagggagtactgttattgataggccctctcagggggaggagactgccagtgccgtgactcaaaatagctgtctcttccctgctgaagatgttgccctttccgcagcaaatggatgaattagacccccctgcttcgataaaatactttagggtttatagggtggaaaattttgtttggaaatgaaaatagcccatagccatccataccctgaagctgtcagctaatgccatctgagtcacccctccccatcttctggcacctgtggggagcctccctgtggtctaccttgcggggtctgagcttggccatatttggcattctggagcctgctggctttggaagtgcctttcaacctgccaacacccacatggggacccggatcaagccatgtgtttaaatgactgggctgtggagggagctccagtggagacgtccaagggatgtagggccatttacttaacataaatcagttccctgagtgtgagtgtcttaatgcattccttcagttataaacagtttagagccatgacagccaacatcttttcacccccgctctccttagcccaggcctccatttggatttgtttctacagccagagactttgatgattgcaagggatgatagggaggccattctgaagacaaataaccattgtttatggagccctgactcctggggtggcagccgctcactgggtgcaggcatgggacctgctcatcagctcctggtgggcactaatctaagtgtgtcccatactctatcttgtttaatcttcccctcccattgatgaagtggggacctcttacattttacactttagagaaaattttacatttatggaaacccattttacagagaagaaacctgacgttcccagggcctcattaatttgctcaaggtcacacagctattgaatgggagagctggaatttgaacgtaggcagcttgttttctgagctctggcttctaaaacgctttgccatgtttatgttatttcctgtctaatttggaggctttgttgctgggcttttgagatctttcttgcttgcttaaatagcagtccataggttggcagaacaagcctgtggatactgccctgacctccggtaggaatgttcacagaagtggcgtcagtaccatggacttgtccttgtcccaacctcagatgtagaacagtggagccaggttcccagagtcctggcttgtgctgtgccccaggtttctcctgggagcggatgtgccagggcttgttcttgggagtctgcctgcacccatggagaactgacagtcagggaacccattttggtataaacaggggttggtatatttagaaataatctctagagactgtcatatgtgcttatctgcatgctcagagataaaagtcagggaggtgggtcagtaagaaaatgctggggttgacatccagttgacacatggctctttcccagggacacagggcagcctgatacatagggcctattttagggtctttcattatcggtttggaattgtcgctgtctgcactgcagtaaaacaagactcgcctggatctgcctttcctgacttgagaaaaaaagatccttacacaggcttgccttcgattcccatctttctccaacgtgctcacatgtgctagggttttttgttttctctctgcaacccacccgcagacgtaaccttctgattcactgtctaatttagggcagaaacttgcagagcaatgtcaaatgggtctgttttcacttctggatattacacatgcgtaatgttcttgctttgaaagcattccaagaggatacgataaataaaggggctcgtacacatacagctcagtggccacgtggctcacatgggtctgctgcttttgggagcgggccatgtttcttctccccttccttccctcgcctcactccctccctacctacctcccccctcccttcctcccttcacttttccccctcctttcttcctttgttaagcaaaataattttttcattcatgagcaaaaacagttttccaagggatgtgaaaaggcaacagagatggtatctctagtaccctgtatttttcagtcacaaaattatttgcctctggcttttttcccaagttcgattcccatttattctacacttgtatcggaaccattgctgtttttaatgggatgacacagttaaaatgagcccctgctttatagaatgggacttgttagacgggtcaccctggttggaaggcccgggagacctctggctctttaaacacgcagttgctgtgtgtgaaggacactgggttctgctatacggcactttctactgagtgggaaattgagacatggaacatgaaccagccacccctggaatccaggagagggctgaagcactggctggcacgtgccctggagcggacgccatgctgggctcactagctgtggcttcatgtttagcaatgaggtcgagcaacattcattacaacgcattgcccacttaagtttgatttaagatgtgtaccgtttatgatcaacagggaaatttaatttaggtacagctaatagctgcatgtgtgagtatgtgtgtggtaggttgatgagagtttcaggcatgttgtttaaatttgaacattagctaaccttctaggtaagtgtttcataatggggtatcccacatataaaaatgacattagggttcagactttgcaattgattgcacatctctcttttctaaatgttttcttctgtctttttcaagagaaaggggagatcttaatgtatgggtagtccaaggtacataatgttttatatcacagttttaaatttgtattactttttaaagaggaagatgaagtagtagtattggctagactgggttgagttgggatttgcaagtaaaaatagccttactttattgagtatctagtgtatgccaggccttatgtcaggaactttatgtgacttgtataacttaattctcacaacaaccctgtgttgtagatatgagtgtgaacaaaggagagaataggttcaaaatagctaatgccatggcagcccatagaagtttggagctggatatagggtttggggctgaggaggcaagagttacggcctcaggcctataaaaattgggggagctggaatggaacccttgcataaagcccagaaccttaaagagcttcctgttcagagaagggagatgagaaactctgtttactgctttggagtcaacagcaaggaagtgttctgtgtgtcctggggcttgctgtgtcacctttgagagagcaaaactctcgggctgtatcaaccacatgtgtggcacctgaattcatactacttgcatactataggaaatttaggataacaattaacataaaaatgaaatctaagacattgatagattaatggataaagaaaatgtggtgtatacatactgctgtggactgaatagtgtgtggaagcaaattcatgtgtggaagccctagcctccaatgtgatggtatttggggatagggcctttgggagttgattaggttcagatgaggccaggaggtgggccttcctgatgggattagtgcccttagaagaagaaacaccagagagcttgctctcactttctccctgccacgtgaggacacagagagaaggtggccatctgcaagccaaaaggagagccctcactagaaatccatctgctggcaccttgatcttggagttccagcctctagaactgtgaggaaataaatttttgtttcttaagccggctagtctatggtattttgctatgacagcctgagctgattaagatacatacagcggagtattattcagcctgaaaaaaagaaagaaatcctgtcatatgctacaacggggatgaaccttgaggacgttgtgctaagtgaaataagctggtcacagaaggatgaatactgcatgatcctatttatatgaggtatctaaagtagtcaaactcttagaagtagaattgtggttgccaagggctgaacgaggggtgcagagggggttgttcaatggatatagagtttcagttacacaagatgaaaaagttctagagatctgatcacaacaatgcacatatagttaacactagtttaactgtacacctaaaaacgcttatcgtggaagtcggtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaataatgatagactggaataagaaaatgtggcacatatacaccatggaatactatgcagccataaaaaatgatgagttcatgtcctttgtagggacatggatgaagctggaaaccatcattctcagcaaactatcacaaggacaaaaaaccaaacgccacatgttctcacttataggtgggaattgaacaatgagaacacatggacacaagaaggggtacatcacacaccaggggctgttgtggggtggggggaggggggagggatagcattaggagatatacctaatattaaatgaagagttaatgggtgcagcacaccaacatggcacatgtatacatatgtgacaaacctgcacgttgtgcacatgtaccctaaaacttaaaatataataataattaaaaaaaaatagttaagatggttgtcttagtcagtttggctgccataacaatttaccatagactgggtggcttaaacagcaagtactcatttctcacaattctggaggctgggaagtccaagatcatggtgctagcagatttgatatctggtgaggacctgcttcctggatgactgccttctcattgtctcctcactggcagagagttgagaactgaagagctctctcatggctctttctataagggcacgaatcccactcatgaggaaccatctttatgacctaattacctccagaaggccgcacctcctcataccatcacactgggagtccagtgcttcaacatataaattttggggagacacaaacatttagtccataacaatggtaaattttatatatatatttttgcctcaataacaagaaccccacaaaactagatctaggataactgatacccataggacccttcaaaaataatcacaaaaactctgaagccttcttccacagctcaggacccttcagacttttataaaataagcagtccaggctgaagatgagcttacagtaaaaaataatgtacacctcacaacagagttgaggaagagtcagcagatataacaaacagaattactaccttgaaaactgaagtcacaggacaatttgaggagaatataaaataaccttgtttaggctgggtgtggtggctcacacctgtaatcccaacactttgggaggctgaggcgggcagatcacttgaggccaggagttcaagaccagcctggccaacatggtgaaaccttgtctctactaaaaataacaaaaattatctgggcatggtggcacacacctatagtcccagctccctgggaggctgaggcaggagaatgttttgaacccaggaggcagaggttacagtgagctgagattgtgccactgcactccagactggatgacagagtgagaccctgtctcaaacaaaaaacaaaaacaaaaaaaacaaataaaataaccttgtttaaatcaaagagatggccgggcgtggtggcccatgcctgtaattccagcactttgagaagctgaggcgggtggatcacgaggtcaggagattgaggccatcctggctaacatggtgaaaccccatctctactaaaaatacaaaaaattagctggacatggtggcaggcgcctgtaatcccagctacttgggaggctgaggcaggagaatggcatgaacccgggaggcggagcttgcagtgagccaagatcgcgccactgcactccagcatgggcaacagagtgagactctgtctcaaaaaaaaaaacaaaaaacaaagagataaaggaagaaatagaaagcataataaaataatagtgctatatgaaaaaggagaagatttttaaaaagggcccaactgtatttttagaaatgaaaaacacatttaaataaataacttaatggatggattaaacattaggttagatatggtagaaggtaatatcagtggattggaagttagatctgaggaaattgcatagaatacagcccagatattaaaatattgcatatatgaaggagccattgaaagaattggtggaaagaatgaaaaaggttaacttacatctaaatggagttctaggaaacagtggagagaatgatgaaaaggcattactttaaaggataatgccaagaatgttttgaaatttaagaaagatattgatttttagattataccagcacactgagtattgagtagggtaattaaaaatacatctcgatctagacactcagtgtagaaaactgcttaaatgtcaaagaaaatcttaaaagcaagcagggagaaaagacagattatttctgtacaaacaccagacttcatcaaccacaacagacgccagaagacaatgaaataatatcttcaaagtgctcagtgaatatcaaactagaattctatacaaagctaaattatcattcaagagttaggatggaaagacatttttcggccaggtgcggtggctcacgcctgtaatcccaacactctgggaggctgaggtgggtggatcatgaggtcaggagatctagaccatcctggctaacacagtgaaaccccgtctctactaaaaaatacaaaaaattagccgagcatattggcgggcgcctgtagtccccgctactcgggaggctgaggcaggagaatggcgtgaacccgggaggtggagcttgcagtgagccgagatcgcgccactgcactccagcctgggcgacagagcgagactcagtctcaaaaaaaaaaaaaagacatttttcctataaacaaaggctgagagtatttacctctaaagtgatctgtgctgagagaactaccaagggacatgcttaataaagaagcattaattttttcatgaacctggcattgcaaatgtattttttttaagaagattaagatttaggatgattgaaatttaggatggggtgggtgcaaagatcagaatttaatgtgttctaaggtcttggtatttttcagggaaataatgaactattatttgaaatatttcataattcaaaagaaagcagacagaaatacccagacattgacctttgggcaccatcattatcactagaataacaactaatatatgcggagttcttactgtgtgccaaggtcttttatgatgttattccatttaatctcacagcaaccgtatgaaaaaggtaacgctgccattttgagaggtaagaaaacaggggggacaggggggatattcacttcagtgctgccatcactgagggtaacacacagcaatagtctgtgttccgtgaatgtggatgaaccaaaccaagctgaggttaaactataataagcaccttgctcgtgtcacatgttagagaagtgatgaaactgtggttctaactcaggcctgtctagcctgagactccctgctcttttccacagtgtctgcccctcactgtttccttctctgagtagacgagtcagacgctggccctgcacttcctgtgaattaatgccccgcttttcccctctcacacatgctttggtctgtgtgacttgtcccattcaggccctgatgtcctagtggtgtctttccaggtgtcatacagcccggcagcgtctcctgcatccttgctttgctttcaacaagactgggccggctgtcgctccccagtttctatgtggcagtcagacaacaccccccgcatggtgttgctaggaaatgcaggagcgatcatagcatttggagcaggggccctctctcctgcctcctgtacacacctgcctttaccatctgttcaggatgctcctggcaccttgaccctgccacactgagatgctccacctcattctagactgtggacctcagagcttgggttttcttaatggaggaattatcagggagaaaactggagcctggggttgctaagctacactggaccctgttctagtcacacactggagaagaggtgctgagagtgggatgtcttgcgttcaaggaattttcattcagtttcctatattttcaacaaaacgcctatctctgctcaagtctactttatatcgtatatttatatatagatatgcacacacatatgtgtacatacacacactgaataattaactcgttacgcctgtgaaaatagttttttggtggtgtttgttttttgcccctttggttcgtttaatcatggactgtgctgtttggtttcctgaattgccagttaatttcaggctaaggcagttaatcaggtagtcccacatggcctggcttgaacatagaaggaacagggagctctgatgcatttaggttctgattactggcttctcacacactgtcatcattctttggagggtttttcttgacctgagctcaaatcattccataccaaagggattcctgatttaaactgtcagtgttaaaaggcctggtggacagatggtgtcttacaggcaaacaaaggctcttggcttgctgctgatggaagccatggactcctccaatttctccttttcccccaaagaggccctggccgtagatcccagcattgccaggcagcctgtgttgttgaggactgtgtcctgtgttttggtggccaagagcatttcgactctcccaggggtgtgccagaggatcaggctatccctttcttagggacacagttgaggtgggtggaaacagcatgtaccttgccattggagaagctgggtttatgctgtgattcacccagccatctcaggttgtgctcttgggagagtctttgatcctcagtttccccagctgtagattggtgatatttgtctccacattgtaaagagaatttatgatactgaagaaaatgctgtgtaaactttaaaacaatacaaatgtaaggcattgctactctcagtgcttggaggatgttttgtgggaagttaatggcccttgctctgccatatttcagtgccaagaaccacaagagctgtcaataaatactgatgaatgatgagggggagaagccatttgactctgtggaagccagtgctttatatattaaatgcatgtattcattggatcattcattgagcaaatatttattgagttcctactaaacacgaggcactgggaataaaacactgaataaaacaagtggaatcatgactaatgtttcctctggctttcacagagttagaaaaattaggtgtgttgttttcataaaattaaattattctatatatataaaggattttaaaatgctgatagtatatctgtcctcctctttggtattaaaatgtctcttcttttgtgtgatgatggtgatagttgatttttgaaaaacttttcacatagtcaaatttgaaaaggtgttgttagttgtccttgaaatccagcttggggatgactgatctagcccaactccccacccagggcaggcctgtctttagcattctcaacaagtggtcatctagtttctacttggatagttccagggaaggggacctcactaacttcaacacgcagccattcaaatgttaaacagccattatcttttgagtgttcttttttatattaagtggaaatctaccatcctataacttctgctcatcaagcttgagtcctccatctggagcaaacaaaatatatttacttcattttcttatagccctccagatttttgaagcagactattatgtttcttccaagcatattttccagacttcttgtccccactttctttacccacgttctcccgtggcttcattcctctccctcttgccccacctctgctggtcagcttctacttgccagtgttcctcttgcagtctgttccccagaagggacacagggcttcagctgtgtgccgacttggatggagtgctcagcctgctatgtccctgattcagagctctgaatgcagattaaggaagaagtaaagattgcgtttgcctttttggcagctgtgctctactgttgactcatattgagtcgtagcctactaaaatccctagggtccttgtcatataaattgctgataaggcaagccagggttccacctaccctatgtttatgcagtgaattttttcatctaagtatagtcctttacattgtgcttattctatttcatctcgttagtgtggaccatagtttcagcttgttgaggtcatttttattctgactgaaacttccaatttactagctattcctcccagatttgtgtcagcagcacatttggcaaatttgtcttcatccaactttttaatttagtgttcaaaaggctagagccaaagacagagccttgggtcacatcagtagagacctcccagggtaaatgtatcagtgagtcaatccctaggcatctgtgcatagaatcagtgcacctatgaatgtgtcaatcatcagtgcatctctggatcagccaactgcagaccctcctgagtgtattaatcacactggtgatgtgagttctattttcagactcttctacttctcattttttaaggcaatgtcaaccttttccattattgaaccaccattggtaggattatgactttcaaatttaccttttcagcccagatatctgtctcttttacatttttaattttttaattgaatagctgcagaatgttttaatttttcaaagtaaatgcactatctccacgtcctctgaaaccttcttctctttctgtgatcaacttggtgccaccaagttggccaagccaggtacctggaagccattctcagtgcttttgctttcttctcactccacagctaattcaattgagtggggtaattataaatacccttagctgttctaagagattctacctccttaatacctcataatacacccctcggactctgatccgtcttgcctatacaactgtaagaaccttctaactagattctgtactcctggcctgactccttctagccctcatcctgtactgtgtcaccaggaaacaaaagcctcactcagattatgtcagtgtactgcactgaggcctttgctagcaccctgtccactgtaaatgataggtggtcctgcatcgtcttactgttctcagcttttactgtttcttctaccaaccctacacttcagatgtactgtctactgctggttcccaactgcagcatgtaaattcatgctttggatatgccgttccctgtacctgggatgcctttcactccttctagtcaactgacttctactgcttctttaggattcagatcaagcatcccctcctttgggacttcttccgcagatgcagcgggttgggcatcccttttcagcaccactgcagcactctaagtgtacccattggaaaactcatcactacatggtagactgtttgtctgcctctcccacttggtggagggcccttgcagggcaatgcctgtgctctgtttaccactggagccacagctcttagcacatagtagtaggcacttgggatttgttgaaaaaatggatgaatggaggatttgacaaatcatttccaatttgccttgaactgagtgaccattacttcccttttagcattactctatgattctgcatctgtggcatccctttgatgtactggccatataattccattcaaaaagtgaaagtgtacttgacattgattaggttttttctccatatatgttccaagtcatccgatttctaatctattctaggcttgttaaactccatttttaccacttagttgcatgtttgtttctctgatcctgtattagttagggaaggctagcagctgttacaagcagcccaaaatctcactggcttgatgcaatacgagtttaattttcagttacgtgacagtccagtgcagttactcctggtcaggtggccttccacatggtgactcagtgagcatggtccatttcattctgcagggcttctctctttgtggtctttgacgttttctccattcagctaatgtatggagaaagagaagcaattgcaggtgaggaaacagagggatggtgcgtgggagcttctcactggcccggcctggactagcacaccatcacttctgtgcacatttcactggccagaacttagtcatatggtcatgtctgactgccacggcagctggaaaatgtaggctagctgtgaccccaggaagaaaaagggaacacagatatttgtgagcatgaacagttgccattgcacccattcttagattctggacctcgtgattcccagggctgccttccagagctcttcttagtcagggcattttctgtgctccaagccctttgatcttctatctcccaggctgggtttttttatctctgccctttgcctctctgttctctcaagccctcttggccattggtacctcatttctcttttcttgctggcctgtctgatcttgactcctcatcgctccagtttcccagcagctgatcctcacttgctcacgtgtctgggactggaccatctgattcttggtacctgcttgccattgccagatgtgttcctcagggacagcccatcccattccaagtcctggcacaatgggggagagtcctttcactctgtcctgtgctttgaagtccttcctatgagtacagagtatggatttgaactctgtttttagagataattagagaactgagggagttacagtgagagccactgggagatgtgggctttgggaagccaaaagtatccatgctgtatgtcctgaagcagataagcctgaagttaatggataatctgtacgtatatgtagaaaaattgcaaaggtggtgatgctagagtacatgtttttttgttactctgaaaaagaagaaagtgtcacattttagtgtgagaattttaggtaagagacaaagaaaaaaatcataaattccagaatttgggatgccattatggagaggttaagtaatgtgctttcctagaaaaaaatgggagtggaagagcccatctcagaaggctttgcagtgacctgctgggtggcaggagatggataagcaagctcaaaatctcttcttctgccatgattctttgaaaaaaataaaaaagctgggtgttctgcttttgactctgaccttgtttgagagatgctcatactgaacgtgtttgtctctgggtaatggttccggatgattttgtaaatggaacgggtattgtcttgtaaggtttcaggaactatgatgcctgagttccattacctgttttgtcacccactcattctgcaggttactcacttgggtaggccacttctccattcttttgatggtctgcttatctattaagtgggaatgggaacaggatgaattttcaggaggtttgaatgagaagtaattcatgtttctaacacgcttcagaatacataagtacaacatcctatgggaattcaaaatacaattacacttttgttaggtttatttctccgtatgctggttctttggttcttgccttgagacatgcagctttttgcaaatgctgtttcctagaaatagctctttaaatgtgtgtgcctctcctagtgagggctgaaatggtaccctctgctgggttggaggctggggaggaaggagaggaggctgaaagtcaacaccctcaggccagggccctaactctagaggccgtgaacacggtggttagagcacgtactttgctgtcaggctgcttggtttgccggaggcttggcacaagctggttagtccctctgtgcctcagtgttctcatctgtgaagtgggcgtcataataatgcctaccttatgggggtgctgagaggattaaataaatcaatgtatgtaaaatcatgagaacagggtctggcccacagggagtactctgcaagtattaactcttatttttaaacaggtattttagaaagatgctttgcctcagatgcgttctccttggttacttgctgacgaaacaacctcctcccatgtatctgaagggcctcagagcagccttcgtgcttgcagacatgcggagaaggaccttcccactgtcctcgggtgggctcagcttacgttaagagatgaccatcaacacacggggaaagcaatttttcagttcataggatttagtcggactggttactatatgtcactgcagcgtggagggaatatcagaggactccactgcattaggcgggctgggcacttgcttgccgttgatattcttaaatgaatcacgttgttaaatgcggagggagggctgtgcgcgcagacctatattcttacttctgggagaccctgtggggctctgagactttgcacttcttagtccaaccaacttgaagtggtcccttgctcccagtgattcattctgcttttactgctgattctgtgctcttgagggattcatggttcgtgcacacgtggaagggtggggcagtgggtaaaggagtgacattgcatgagtgtatagacaatagctgcactgtgtcacttacagcctgggcttcttccgtaagccctaaaccacccctgtctgtccccccgaccctgaggtaagccattgatgtgggggcgagtggtagactaagcatccctttggaagaaaaggattaatttgcatgaagctaggaacacacttttgaaatattaaatacaacagaggtctgctgagcacctcctatgtgtaaagcaccatgctggacgccgtgcgaggtacttggagtagtaagacttgactcctgtcctcaacgagctcaagatctcttgggggagacaaacacaggaataaaacaggttgtgatgaacatggcaacagagcgtggtgacaggatgccataagaatcttggggctctgccgggcccatccggggcatgttatgtacccagagacttgacattttttaatttttaaaaactgtggtaaaaagtacgtaacacagttttcaatctgaatcatttttaagtgttacagttcagtagtgttaaatatattgttgtggaacacatctccagaactttttcatcttgaaaaattgtaactggctgggcgcggtggctgacacctgtaatcccagcacttggggaggctgaggtgggcggatcacaaggtcgggagatcgagaccagcctggccaacatagtgaaacccctactaaaaatacaaaaaattagccgggcgtggtggcaggcgcctgtagtcccagctacttgggaggctgaggcaggagaatggcgtgaacccgggaggcggaggttgcggtgagctgcgatcatgccattgcactccagcctgggtgacagtgtgagactccgtctcaaaggaaaaaaaagaaatgaaaaattgtaactacacacccattaaacaactccccatttctccctgcctccagcccctggcaaccaccattctactctctgtttttatgcatttgactactttagatacctgatgttaaagtggaatcattgaatatttgtcctttgtgactggtttatttcacgtagcataatggactgaaagttcatctgtcttacagtgtgtgtcagaatttcattgcttttaaaggctgaataatagtccattttatggatagactactttttttttttttttttttttttttgagatggagtcttgctctgtcacccaggctggagtgcagtggcatgatctcggctcactgcaacctcggtctcccaggttcaaatgattctcctgcctcagcctcctgagtagctgggattacaggtgtgcactaccctgcctggctaatttttgtattcttagtagagacagggtttcaccatgttggccaggctggtcttgaactcctgacctcaagtgatctgctcgccttggcctcccaaagtgctgggattacaggcatgagccaccgtgcccagccacggatagattatattttgtttgtccattcttctgtcaatggacatttggacttgttattgtgaatagtactgctatgaacctgggcatgcaaatatctcttggaaatcctgctttgagttcttttggatacatatccagaagtaggattgctggatcatgtagtagttctatttttaattttctgaggaatcgccatacagttttccacggtggctgctccattttactttcccgccaacagtgcttaacgttcttattcctccacatcctcgctggctcttgttaatttctattttttgatagcagccatcctaatgggtgtgaagtgatagctcatggtggtttggatttgtgtttctctgatgatcagtgatgttggccatgtgtatatcatcttggagaaatagctattcaagtcttttgcccattttaacatcaatactcgaggatttctctttctgctctgcccatatcctcagatatcgggactggcttgcttctgcagagggggccagatcaaccctgcaccagcagaggcatagggcagcaggggcttctccctctgcaagtcccaaaagtatgcgggttacttgtccccattggccatataactagcacccctctggactgcttagctctgcccatcctgctgtttctaccttgcgatgatttacatggatgagaggctgggtatgttcatttcttcttgcttcagtattaatacattaccacagacttagtggcttaaaacaacacagttttattatcttatatttttgaaggtcagatgtctaaaatgggtctgcagggctgcaatacttctggaggcacttggaagactgtttccttaccttttccagctctagagaatgcccacattccttggctcatggccctctcctctacctgcaaagagaacaatgtagcatcttttgctctcctctcgtgccttcctcttccgaggacccttgtgatgacctcagacccacatggataatcccatctcaacatccttaacttaatcacattggcaaagtttcttttgccacataaggtaacttattcacaagtaccagggatgaggacaaggacgtgtctgggggtgatggtcattattcagcccacactgggcctctgctatgtggaaggcaggggtaagagcatcttttgtagggagggttcttattctgtgccttctggacttaaactttaccctgggttagtaggaacagcatctagggatctgaaggcttgggcttgactttggtttggctttgcctgggtgggaacctaggggacaagaggcttgctttctctgagctcctgtgacctcaccttttaaaggaggtgggtgggccaggtgctctttaggtccctctcgctctgccatatcctcacctgctctcatttctcatgtggtgtcctcacattgccttttcccattggctatggagagactgaggctgccctgaagggtagaagaggaaagttatatgaaactttggggaaatggctcctgggcaccagctaattcaaaggaggacaggaatagcaggaatgaagggcgcgaaggcactgctttattgcccgcctccttcccccagcccctacataaagcatccttggaacaaacaaatggaaatactgcacaccctgtaagcctaattgggtcatacataacttgtacagtgatttcctatgaaacttcaattagccccctcttccagttcaaacctgataagctcaaatatttgtaaactgccagccagatggaagatgtgtctccttgtggcttggatatcctgtaactcaatatgtgtggtgactggcatgggcatccgtattcaaggaagggaaggagcctcgcaccctggacgtggcattgaggggcaagaaaaggtgttgtttgttctctttgggacaggtggcccgactctcctctggagcaggctgggagaagttgccaaggacagttggcgtccttcagtggctggggaaggagagggtgactcttgggtccttgtgtcattcttcatcacttccaactcaagggagaatgttgacttgaaatagttaacctttagtaagcatgcattagtattaatgcaccctatttaatccttattatattatccctgttttaccgataagaaagctggggatcaaagaggttaagttaacttagcaaagatcacatggtcaacaagtggagagctgagactcaaatggaaatgagtctcatgtctaattaaatgtcgaatttcaaaatgcatctctttctactatgccacatcatatcttctggcctcttcccttcacctaaaaccattgcccttgggagtggaatgtggagctgtgaatgaaggaggaggcagtgagccacagcctggaggaggtgacggctgcaaaccccgcactctggcagaggccagtcaaccgctttggaatgccaggctgcctggagctaactgtgggccaatcttgtgttggccactttcgtttcaggcccaaatttagttacagagtcagaaagagcaaggcccctggcagggcaaagttaccagagagtgtacgtgggtatgtgtctgtgtgggtgactatgcagtggggcctctccttcccagggaggctagtggcttcttgtggcagggtagtatcttacacagccgtgcctcccactcccctgtaccagtggagcccctggtaggcctgcaccctgatgcttcttgaccacttgtcctatgctaggcattgtgaggccacatagtggaatgagacaggactctgctctcagggttatgttggagcaggaggagaagttacatggatataagaaaggcagtgaccaaggccatgagctgcacagatggaagtgggtatgctttgtgcctccgtgttccacgctggcaacatgtgttcgtacctgtactcgtgtacctgcgtgcatgtactcaagggtgactgtggggtcatgtgggggacttgcctcctgagccccttaccctgggcaggtggtggctgctcctttccctcatcgcggagcactttacacaactgtatgatcatgggtgatctggggcccatgggggcagcttcgtaactctttggctcaactgggaagttggagcaggtatttgctaccctgagtgtgagccctaagaccatagttttatgctggaaaccgcccctctttcatgacactcagtgcctagtgcctgcagttgcaggctgccaggggaccacccaataacaaagctatgttgaggccatctgtgtttcgtgctgaaaggacatttttcttcagcagcatactgagtgcatagagcagaccaaagcagacatcccattttccccagtaacctccgcatgtgtgaaaactgggcagctgtcaccttgagaaagatgctgctgggtcaccccaaagattccacatacatgctgttgggtgcctccttgtatgtgtgtagctgttattagccccatttcacaggtgggaaaggcaaaggcaggaaggctgccaaagagcctggtattcaagggaaatgaatgagcaggcagttgtaatctcagtggcatcccactccacaatctgaagtgcatccccaagggttagggagagcagcttaagaaaccagcagacatttcagaagctgagccctatggacagtgcacatcccatgctcaaggagttccggtggtcctagcccattagccacgtttgttgagactcagcggagcacccccagtaagtggctgccctattcaggagtacttttcagattcaagtctttatcaatattaagggaggaaattcaggggtggaggtgggcgagcaggggcctcctctcttttgggaagcctatttctttggccagcatgtcctgaatgataaacttctccagcacccactagtgaattgcagaatcactgaatgccagaaaagtgcataggaccttagaggtcatttggtgaacaccctcagtttacagatgaggtgactgaagcacagagagggagataaacttgtctagagtcacacagctgcttagtgggaaagggaggaagagactcatgcattcagccccactcaaaaaagtgactcaagagggagagccgaccaggaagtgggagtggctgggactgtctgtgcttcaggggaaatgttgggggttgtgaaatgcagccactctggatggggccatgctggggtgcctacaagggccttccaggtgctcagcccttcctgtgcctctccttcattgctgcaggccccaggggctcaaccccctttaacaataacaaaatgagaccatttaatgactacttccccctgagaacttagtcgatggctgcaccatgctaagtgcttataaatgtttcaagactcttgtcacaactcagagatatctaagtctcagaaacgtaaataagttgcccgggctcacagggctagtaaatggcaatacagacgggaacttagggctcctgcttttgctgttaaccaccagatcacactatctcttcttggaggtggctgctgtaattcactcaatgtgcttgcagtcctgtccccataaaactcagtatttctagatcctgcactcccacctgtccactttttctttcctgtcttcatagaccagaagcaggtccaatttgtcttaaaggttatgaccctcctaattcctgtggggacacagacagaggagaggaacagagatagggggacagagtcacagagatgatcgagtgttacagcgtttttacagctctaggttctgctctgtgaatcctgactccattctgagatgaaaaatggtagtgccattgacttctgccttctgctttcgggttcttaaagatggacttctcctgacctccccttcttctcccttttggcccagactttcagtgcagttgaggctgcgggagaatccgggcagcactgtaagtgccctcggcccgagtcaggccatccagtgtttcgccagtccttcaaggaccctggaggagaagggctaggcagggtcggataccactggctccagagagtgtcagaaaaacctaagcagaaagaagagaagggggagtgcaggacataggaagatggcaaacagacgcccacagaagaggagagtgcatgcatcctatgaggacggagcgtggatttatgatgccagagaaactggaaggtttaggagtggagaggtcagtcttagcctgggtcccactggatggaggctgtgtgcttctctctgccttggtttcatcattcaccatcattgggaataatgtcttttgtctccttacttaaagtgatcaggcactgagttgaaatcagcattccttcagcaaacacttcttttcatactggctgtgtgccaggctctgggctaggcacagagccacagagatgagcacgtcatggcctgccctggagatactcacaggtgcccagagtggagcttttggacaggactgaaactgtgcagagatgaggggttgatctaacttcccatcaaaccagctctcgcagccagaggtccgatgcctgatttttaacggcgcttgagaaaactgttgatatatttgaaggtgagtctggttttactcagttgtgaaggcatgtttgtgcatgtgcacatatgatttatttgatatttgaaaacaatttatgaccagaattctttgcatccttctctgggcctatgtcatgtgctgagggcttgccggaagcacttgtatagggtagagacttgtcctgccacatatctctcctctggactggcctaaagtctatcctcccatctccttcctgaaggacagcttccaaatgccttcccctctggttcttttcctgaggacagacctctttctctttcctcttgggatgttcttccaagtattctgagtctctttggctttttaaaacacattaaattgaggtaactttttgttatggtaaaatatatgcaacataaaaattatcattttaaccattttaagtgtacaatttagtggcattaagtacgttcaccatgttgtataaccatcaagcactatctgtctctagaactttttgtcattccaaaccaaaactttataaccattaactcccattttctcttcctccccagccctggcaaactctattctactttctctctttacaactattctaggtacctcatataagtagaattattcaatacatgttcttgtgtgtatggcttacttcactcagcaccatgtcctcaaggctcatccatgttgtagcctgtagcagtattgtattctttttaaggctgaataatactccattgtatggatagaccacactatgtttgcccatccatttgttgacggacacttgggttgtttctatcttttgtctctttggataatgctgctatggacatgggtgtacaagtatctgttcaagtcctcgccttcaattcttttgggtatatacccagaaatggaattgctggttcatatggtaattttatgtttaatttttaaatttttatttatttatttttttgagatggagtcttgctctgtcacccaggctggagtgcagtggcgcgatctcggctcactgcaagctccgcctcccaggttcacaccattctcctgcctcagcctcccgtgtagctgggactacaggcgcctgccaccacgcccagctaatttttttgtatttttagtagagacggggtttcaccatgttagccaggatagtctcgatctcctgaccttgtgatccgcccgcctcgacctcccaaagtgctgggattacagatgtgagccaccgcgcctggccacatttaatttttttgaggaactttcatcctgttttccatagcggttgcaccattttacattccccaccagcaacacatgaagtttccaatttttccacatgattgccaatacttgttattttctgattttttcgataatagccgtcctaaggggtttgaagagccatctctggctttgaggatttccatgtaaattacagtgagccgccggggctctctgtgtggctgttcctagctgggggccccttgggttgagcttgccctgtaagcacaggtagattggaggcagccgctcagcatagctgagtgtgctctcaggccacctctgcagctgggagagcccagccatgggcagagcggggtggctgctgggctgcacctggttcagcccctgctttgagatcagtaggggaggagatccaggcaccagacaactgggagtgggggatgaggccggctggagaggctgaggggagcagtgagatgtctggaccaatgagttctagaacctgagctgtctgaactagaaggacctcgtacggtatctggtggagcctcctcattctatggaagagattgagagccagagaaggaacgtgatttgtctgagtgcgcagagcaaatgagtgatgggcctggggctggaattcagatttactgacttctggcctagttcttttcccaccgaacttggggaggagtcaagataacttcatgtctatatgaagtttgatatttaccaaggaatgacagcctcaggggagacttgcatattttttcgttgccttctaccttcttgtctgcctgctgtctggtggggttttgtagggattaatcagataaatagctttgacttttctaaatgaaagaagcattgtattttatacaaagcattgttattaaacggcctgtgagtgtgtagaaataagctgatgctgtttcttttgtcgtgccttagtgagaattagagacttccaggagtggcacaaataggctgtgtgtgggtacatttgtgtatgtaatgtttttagtgtgtacatatgcagggtgacccaccttccccatacagtgcgatcccctgacaatggaagaatttcagagccttttactaatagaggatccttgaggaatgcagcaccattttcaaggatctctggaattctgtgttctgaattatctggagagatccattaatatctgtgtatgggatatagcgattgtttttaagagttggttgcttaacatggaaaatgtgcttctgggaaaaagagttttaaaaacccagctttcatgttttattttacttcattgaaatgaggttcttcttgcgtgccccgaggctttatctctggaatgatttttactaaataattcttcatattcaggtagtactttcatagacataatcccttgtagtcttcaccattgttctgtgaggggtgtggtatcatctcagttttacagatggggacattgaggcgtggagagcatgtgtcacttggcactggtagcactgctcaccgtgtgaggggcggccgtagagctagggcctgcttgctgaagccacgtggctgtgtggctggggaagccctccctccctggaacctggttctgaggttatgtgcatggtgcactctggaccggggcttagtctcgctgccgctcactctgggcgcatagccctgctcatgcttcatggaggcgagcagataggaaacagaatggtttttaaacaagacgaaaagaaaaaggaaaagatgaagagaaaaaggaaaggatcttgcccatgtttctcagctaattttcaaaccaaccgtcttactgtgttactttaccctgaacctagatccttctgcagagaaccacagttggaaacccaggagtgcaagtggccctctgtccagagcttaggctggagttgagacggctgccgagaggtgtgctgagttcttatgggacttcttgcttctttctctgtggctgcagggagctgcctctgtttgcctgcagtgctggggatgaggaggaagtggcctcaggcaggttgggaggcaggcggcctgtctgtccccttccagaggcaggaatctggcactggggtggccacagtcatattggaagtatacttaagcaacaaaaccaaactgtaacttggttttctttctgattaccaaataattacttattgcacagaattttggaaaattaatcacaaaaatacctagtaccatttattatatattgtattttctcttactgtggccacgccagtgccagattcttgcccagccacggacagtcccactctggaagggggcagacacgctgcctgcctgccaacctgcctgaggccgcttccccattacccccagcaccacagggaaacacaggcagctccttgcagctctgtcctgagagtgtgatgttcattaactcatttgattgtcacacagtgctatgagataggcagtgttattatctgctttttacaagtgaggaagctgaggcacagagaggctaggtaccttttcaagtctcacagctagcaactgacagaggctcgaatttggatccattctgcctggtttccaggtccatgcccctgagtgccaggctgtactgcctctcagcacgtgtatattacctgacacttaaaaataacactagtgtttccttctagtatttcttctatgaaaacaaacataaaattggatgggggccgggtgcagtggctcacacctgtaatcctagcacttttggaggctgaggtgggtggatcacctgaggtcaggacttcgagaccagcctggccaacatggcaaaatcccatctctagtaaaaatacaaaaattagctgggtgtggtggcacgtgcctgtaatcccagctacttgggaggctgaggaaggaattccttgaaggaggttcaaggaattgcttgaacccgggaggcagaagatgcagtgagccaagattgcaccactacactccagcctgggagacagagcgagactccatctcaaaaaaaaaaaaacaaaaaaaaaaaacaacaaaaattggatgggagcctgatgcaggaggatcacttgagcctaggggttcaggactggcctgggcaacatagccctgtttctaccaaaaaaaaaaaaaaaaaaaaaaaaattagctgggcacggtgactcatgcctgtagtcccagctacttgggaggctaaggtgggaggattgcttgagcccagggaggttgaggctgcagtgagctgtgatcacggcactgcattccagcctgagtgacagaacgagactgtctcaaaaaaagaaaaaaaggtcgggggcagtggctcatacctgtaatcctagcactttgggaggccaaggtggatggattgcttgagcccaggagttggagaccagcctgggcaacagggtgtctctactaaaaacaaaacaaaaatctgaggtaggaggatcacctgagtctgggggagtcgtggctgcagtgagccgtgattctgccactgcagtctagcctgggcgacaagggtgagacccatctcaaaaaaaaaaaaaaaagaaaaaagaaaaaaaattgtggtcccattgtatatacttttgtggaccctgtttttgcttaatattagactgtggaaacaatttctgtattatttcatatttttcaaaatgtaattttcatggcttcctaaaatgctgtcagtggatgtgcattgatttctctaaccatttctccagtgacgggcttctaggttgtcttcaatttggtactggtatcattcacaccgtgacgagtacccaggcgcagagctttgccagactcttggattagttctctcagggtagctcctgagaagggtggtgaatgttggaatttcttaacaactcccaccagagtgctgaactgctgtcctgacagggtggagcagaccacgcttcccccgggcaaagtgcaggaggctctaggaggggttaggggctcaacctccccctcccaggtggggctgtgggagctacagctccatcgtcgtcctcaccgtgcagaacagaaatgcacgctccgcctccctgagtgtcaggcctgtgggtccgtgagctccgagcctcaggagtaggggcagcctctgctgcagggaccactgtgccatcccactgagtcccgtgacccacgaggctgggtgttcagaggcacgaggtggagtgcgagcaggtcctgccggttcccaagggtgcccgcccagttcagtgggtgacagtgaatgcgcagggtgagtgaggattagctgagggagccattctctcggatggtggcagaaggaggctggggccaccgagaatactaaaaactgccctcacaaggtcgctgcctcctgtgttctagttctgctgcctgggaaagctgtactcaccctctgcctctgccctcctaccaataaactgggccagagcaacagaacccctgcatcatgggaccaaagtccaagtaattactattatggggaaaaaagccttgggacagttacgttttgagtcatccttttattcaacacattggtagtgtgcacataccacactccaggctgccctgggctctgagaatacagtggtgcaaaacaaaggctcatgcttcctgggacttccctcctgttgggaacaagaaacacatattcatttaaccaatgataatagatacattgaacatatggcaaacatactaatttaaaataacggaagagcatcttccccgtatacttctgcacggaaacctttgaaggccaaattaaagttctgtaaaagaacttccatgcagccaatgtgttttgagtgcctcctggcaacactgtactaggatttgaggccacagtgctgtttcctgctctcaaggagcttgtgagttgctgggaaaataagagaaggacccaagtattagactttaactcatctcaggcgttcagcagctgaaggaaaggggaggctgagccagtgtctgggtcccctcagtgtggtacctggctctggggcattcttccccactgtctgcacaccctcccttctccccagacatcagcaacctgaaggatttctcctttttgtagatggctgtctgtcctcaggcaggcagattattttttattttttttaattacacttaaattctggggtacatgtgcagaatgtgcttgtttgttacataggtatagacatgccgtggtggtttgcttcgcccatcaacccatcatctacatttgtatttctcctaatgctatccctcccctatccccgtactccccgaaaggccctggtgtatgatgttccttaccctgtgtccatgtgttctcattgttcaactggccacgtatgagtgagaacacacagtgtttggttttctgttcttgcactagtttgctgagaatgatgttttccagcatcatccatgtccctgcaaaggacatgaactcatccttttttatggctgcatagtattccatggcatatatgtgccacattttctttatccagtctatcattgatgggcatttgggttggttccaagtctttgctattgtgaacggtgccgcagtaaacatatgtgtgcatgtgtgtttatagtagaatgatttataatcctttggctatatacccagtaatgggattgctgggtcaaatggtatttctagttctagttccttgaggaatcgccacactgtcttccacaatggttgaactaatttacactctcaccaacagtgtaaaagtgttcctatttctccacatcctttccagcatctgttgtttcctgagtttttaatgataaccattctaactggcatgagatggtacctcattgtggttttgatttgcatttctttaatgaccagtgatgatgagctttttttatatagttgcctgcataaatgtcttcttttgagaagtgtctgttcatatcctttacctagtttttgatgggatttttttttcttgtaaatctgtttaagttctttgtagattctggatattagcgctttgtcagatgagtagattgtaaaaattttcttccattctgtaggttgcctgttcactcagatgataatttcttttggtgtgcagaagctcttcagtttaatcagatcccatttgtctattctggcttttgttgccattgcttttggtgttttagtcatgaagtctttgcccatgccaatgtccttaatggtattgcctaggttttcttctagggtttttacggttttaggtcttaagtttaagtctttaatccatcttaagttaatttttgtataaggtataaggaagggatccagtttcagctttccgcatatggctagccaatatttccaacaccatttattaaatagggaatcctttccccattgcttgtttttgtcagatttgtgaaagatcagatggttgtagatgtgtggcattatttctgagggcctctgttctgttccattggtctatatatctgttttggtaccagtaccatgccgttttggttactgtagccttgtagatagtttgaagtcaggtagcgtgatgcccccagctttgctctttctgcttaggattgtcttggctatgcgggctcttttttggttccatatgaaatttaaagtagttttttccaattctgtgaggaaagtcaacggtagcttgataaggatagcattatatctataaattactttgggcagtatggccattttgatattgattcttcctatctatgagcatggaatgttttcccatttgtttgtgtcctctcttatttccttgaacagtggtttgtagttctccttgaagaggtccttcacatcccttgtaagttgtattcctaggtattttattctctttgttgcagttgtgaatgggagttcactcatgatttggctgtctgtccgttattggtgtataggaatgcttgtgatttttgcacattgattttgtatcctgagactttgctgaagttgcttatcagcttaaggagatttggggctgagacaatggagttttctaaatatataatcatgttatctgcaaacagagacaatttgacttcctctgtttgtatttgaataccctttatttctttctcttgcctgattgccctggccagaacttccaatactatgttgaataggagtggtgagagagggcatccttgtcttgtgccagctttcaaagggaatgcttccagtttttgcccattccgtaatctctgctgccacactaaaaaagttgaaatgctgatttttcaataaatgtgaattaatccttaactagggcctgtaatttagatttgctatcaccaggtgctgataggcgccttagttcaagtagcaagaggtcttgacttccttcctctccatgcttggaaataagtggaggaagcatttggttattatggcaaaaattatggcaatttgtcatcttcagttgaaggccgtggcttagctgtgtgtctgtcagtttgttttcttccctatggtctctgatgtcaatatgagagccctcgagtgccaagggcgttatatcagggtcctctcaccgaagcagtgttggccttgtggtcatcgcaggtggtttgcttccaggcgttccttacgaggcttccttttcctttctttaccttctttcagccagctgccccataaataacagagagcaagtgtggtttactggatcactagcaggtgtgaatgctgtagcttttccgcttttcccattggcttgggcctctgaagtgctccaggctctttgccttctccagccttcatgtagtcatcagaggcaggtgggttgtaggacagaaaagatacagttgtatttgagggagtactcgtcagttgggttggggagagagccgcagatctcctggcgccctcacggtctccttgttttggagcacatttgactgctgtggtcatggggcctgttctgggcaccccacctctcatgaactgtgtctgtagcaggatgggggagaggaggaccggcagagtgacagaatgctgctggaaatggtgtgaaaatagctcaggtaggaggaagcgcagtcagatgcggcatggcggcgggcgcatcgggaaaccactgggcgcccaccccggggagggtttccacctcagctgggcgtcctgaagccactgggtgcccaccccggggagggtttccacctcagctgggcatcctgaagccactgggcgcccaccccggggagggtttccacctcagctgggcatcgtgaagccactgggcgcccaccccggggagggtttccacctcagctgggcgtcctgaagccactgggcgcccaccccggggagggtttccacctcagctgggcatcctgaagccactgggcgcccaccctggggagggtttccacctcagctgggcatcgtgaagccactgggcgcccaccccggggagggtttccacctcagctgggcgtcctgaagccactgggcgcccaccccggggagggtttccacctcagctggggcgtcctgaagccactgggcgcccaccccggggagggtttccacctcagctggggcgtcctgaagccactgggcgcccaccctggagaaggtttccacctcagctgggcgtcctgaagccactgggcgcccaccctggagagggtttccacctgagctgggcgtcctgaagccactgggcgcccaccctggagagagtttccacctcagctgggcgtcctgaagccactgggtgcccaccccggagagggtttccacctgagctgggcgtcctgaagccactgggcgcccaccccggggaggatttctacctcatctggggcgtcctgaagccactgggcacccaccccggggagggtttccacctcagctgggcatcgtgaagccactgggcgcccaccccggggagggtttccacctgagctgggcgtcctgaagccactgggcgcccaccctggggagggtttccacctcagctggggtgtcctgaagccactgggagcccaccccggggagggtttccacctcagctgggtgtcctgaagccactgggcgcccaccctggagagggtttccacctcagctgggcatcctgaagccactgggtgctcaccctggagagggtttccacctcagctgggcatcctgaagccactgggcgcccaccccggggagggtttccacctcagctggggcgtcctgaagccactgggcgcccaccccggggagggtttccacctcagctgggcgtcctgaagccactgggtgctcaccctggagagggtttccacctcagctgggcgtcctgaagccactgggtgctcaccccggggagggtttccacctcagctgggcgtcctgaagccactgggcgcccaccctggagagggtttccacctcagctgggcatcctgaagccactgggcgcccaccccggggagggtttccacctcagctggggcgtcctgaagccactgggcgcccaccccggggagggtttccacctcagctggggtgtcctgaagccactgggtgcccaccccggggaggttttccacctcagctggggtgtcctgaaaccactgggtgctcaccccagggagggtttccacttcagctggggtgtcctgaagccactgggtgcccaccccggggagggtttccacctcagctggggtgtcctgaagccactgggtgctcaccctggagagggtttccacctcagctggggtgtcctgaagccgctgggcgtccttaagccactgggcgcccaccctggagagagtttccacctcagctgggcgtcctgaagccactgggtgctcaccctggagagggtttccacctcagctggggtgtgctgaaaccactgggcgcccaccccggggagggtttccacctcagctgggcgtcctgaagccactgggtgctcaccctggagagggtttccacctcagctggggtgtgctgaaaccactgggcgcccaccccggggagggtttccacctcagctgggcgtcctgaagccactgggtgctcaccctggagagggtttccacctcagctggggtgtcctgaggatttctctcgcttaggctggaggggaatgccagcttccccatttggccattgagaagaaagtcatctctcatttatgtgatgaaaatattagacactgaaaaaggacttttggtttctacattgttttttgggtcttagactctcttatgctttgaaaatatgtctttttgcatagggtggttaattcttgatcagaaaatccacccacccatcaacatctgaattcattcgctattgcctttttaaaaagttttcccacaattttgaattcagtgctctgctcgttatcttccccacttctcacatttctttgtcaccatgctcttcccacaaggactttgtcttaatacagcacaacctgtgttgcccagtgtgggcgcctctagccacatgtgactatctgaatgtaccgtaattgaaaattaagtaaaatgcaaaatgcattttgtcagacgtgctagctacatttcaggtgctcaggagctgcgtatgactggtagcaagggctccgtaatccagcctaggattatagagcatttctattactgtaaatgttgtattggacagtgttgctatagactggtctatatatctcagtcagggttcaggcctataacagaaacttctgtagccgtgtttagaggaaagatagtacaggaatttaggggcttatacaataattggaaatgctgcaagagcaggctttaggccgggtctgtgggaatgattcccaaaacagtgctgcagaacaggccccccgagggaactgcggttcgggtacaattatgaggctgggggacctggaagccactgtgccaagggctggctctgggatcacaccgccttatgcatgatccaggaatcaggaagccactggtgtggccctgccagccagatacctgcaaaatagatgcttccccacctgacgtagttttgattcagttcttgattggcaaaagttgtgtcaggaattctcgctccaagggaggttgggagccattgtgtttagccctctggcccctgcagtccagcggggcaccgtaggaggagggtggaagagctgctgagaccgcaagtttaccagcctcccacccaccacatggtgctcagcacacaccatccttccagagaggagtgccactggggttgagatgacagggcctcgggttatcgtctgagatcgagagacggtgtcctctctgttcacgtcctccagctatctgtgtactgcaatagatagggaagattaatggcccagctttctagtcattgggcctttagtgggtggagaaagtccggtttctgttccaggttgtctgcgatactcttaaagggaatgcaggccccttgtcactacagcaagatgacagacagcaagagccaagtgggcttctgggtgacatgttggcctgagagaaggcatttcctttgccctgcagagattgctcagtggtcaggactttagggagaaatttatttgcagttcttccctttctaggtgtgagctgcggctgctcaccctctctaaatcgatgtgggtgtctgtgtctacgaaggtggaggagtgacctgcttttgtgctcacagaaggcaccaaggccaagcagggtgactgctgctgaagcaggctggcagccccagaccttttcctactcacggctgattggggggtccctttccaatgccaggggcgttgggcatgtttattcaacggtggcatggaggcagggaagtggggagaacactggcagctagtgtttgagttctgcttgtttggagtgggggcttgaagaagggatcacctgagcccaaacctgaaacgtgagaagggattgcctagcaaagggcagagggaagaacatgaaggacattctaagtacatgcaaaggcactgcggcaggcaagagctgagcatgtctgaggcatgaaatgagccactgtgtcaggagtgcattggaccgggcccagaggggagtgaggtgaactcagagaagtgggccagggccagtctgtgcaggtgttgtaagctgttgacaaggagtttggattttgaagggatctaactaggggaatgacagggcccaatttacgagttctgtttttaaaaggtgactttggctgctgcatggagattggcttggggatggccaagagtggactgaggaaaaggtcagggtggctactgcagcacttgtgggcaagagataggtagtggcctggactaggatggagatcttcctcacaacccctttccttagaacttctcccccatggttacatccaagaaatcagtagaagagcatatggcttgagaataagcccattctttaggggtggctggactgactccagcagtgttccttctacagtgtcactgtagtccaccttcacctgtatcatgacagcattatcgttacagtccttagcaaactgtgttgagcattttctgggatatggccctgaatcaggtgcagaaatagagatggattaaagaaaaaaaaattgtttcatcactgaacaccttccaagtccccagcaccaagcccctcactcacaggggacacccaggaggcacatgccactgactcctaacttggactcctcacttggacccttgcagagcagaatgacacgaggctggccagaccgtgctggggtcctgccctcatcctggtccccagcagcagcacctgggtgcaggaggaggacgcagatgctgtcttcaggggagctgggccatttgacaggtgggaggcattttcttatgactggggatgaggtcactgctgggggcacctacctgttggtgtgtggcctgatctgcgaggcagctgctcagggccttgttcaggggtgggagcatccgtggaaacagcccagtcagacagagccagagcagacttaaatggtggcatcctttcagctggcagccaggaggctgagctttgaatcagctttataatttgaaaattgatctctttgcattgggtggtgatttcgtgctaacaaaagccgtcagggacacaatgctgcctgccctaccttcatggcaccactctggattcaaaacattgagccagagatggggattttccactcctgggagtcttcggtagttgtgccaccctgttgtgggtgacccggagatactggtagaacatttcaagtgctcaggagccacatatgactggtagccagggtattggacagcctaggattatagaacgtttccattactgtaagcattgtattagacagtgttgctacagactggtctatatgtctgaggtcagggtggggatctaccgcagtgggtgggaaaattacttggagaaggggaggcccaggcccggaggtggtcagtcccgagaggccatacctgtctcacccgagaggccacacctgtctcacccgagaggccacacctgtctcacccgagaggccatacctgtctgtctcacctgtgtgcggctctgcactcctgtgcagggccctagtcatgtcatgggaccgcagcaatgcgcagagctgccaggaccaaaatagtgtaggttgttttcttggcctctggctagggagaggttgacattccatttttccccatgggctggttcatatgtgctttctccagatggtgtgctccagaaaggtccttgcgctctgggaatggtttacaatataaataaggtccctcatggagttttgggagggctcagaaggcagcccaccaggatgtggttttcagagctgccccagggctctgcacagccagctgccgtcttggtagcttctacctcgtgctccgggtgcagggatgctcccctcacgcagcttttctgggtggtggatgtgttctcaggctggggcttcctgccctctttccaagtgttgtccccaaactcctgggactcttggtttttggaactggcagcccgtatgagatggggggattaagggcaatgcaggggggtgagtacaaagattaaggtctggggacagccgtctcaggggaggcgtgagctgtggagggcttaccatgagtgaattgggggctgggaatgccaacagttggggacagggcagcttttatgtatctgagggaaaaggagaagttagtctgggaactaaaatagtctattaaattttgtcagtgccaaacagagagtctaggaagaaaaaattatataccacagattgaatggagcaaaattagagttccagccttccctggcaagccagagaagcaggagttgctcagtggctccagtacagcagatggaaacagggcgctttccacttttgcctaagaggcgccccgaggttactgcgggggcaggtggtgtagtggatgctgtcacgtggagatcatagtaaacagaaagaatgttcttggggtcagaaatccagccccttgtatctcgaggcctggagaagcccaggaggaggcgtgcaccttgtctgtcaccatgtacacgagcacatgtgtgcgtgcatgtggagtgtgtgagagagggctgaggaggcaggggtagagtctagcagctcaccgtgagccctgtgcctgctgcagcaaccctccgtcgccccattctgtgacctttagtgagtcagacactcctttgtcttcttatgtgttaaatggagacacgcatgcttgctgggtgttcaagcagttctcatgctttgggtgccttcattaattccaatgcactctttacatcttttcctgctggatcttatgagaaaggttaaggtcccggccttattggggtcttcctcacgttaggcttgggatctacacagtgagtgcagggaggacagggacgagttacaggagagatgagacgtctcattgtagggagtgtcacgtcctccgtgagcctgatgttctgtttaatgcagtttatccctggggcagagaacaggaggaaggtgaagggaatatatatggtgaggtgagagtcggtgtcacattgagaatgtggctatgaactgggtgtggcagagaggcaattttccaggccttgaggagtggaggcggggctgtaatgctacaggggccagatggcggtagagcaggtggcaactgttgcgggacaggaggcagctgaccagctggtctccaagaggacctgaggggtcttcttgggatcatgcaggggtggtagctatgtggcatgagtgatgccattccctgccctttgtgcccatggtgggcaacactaatctatcatcctcagagtcccttaagtatatagcattgtggacagtgatgtcaatcaattggcataaaagttgaaacttattgtctgtcactggtgtgatggaaaggatatagactggagtccagcagaaatgacagccccaccaggtccaagctttgggcacctaccaagcatattagctcgtttttcggttgcaagggacagagacccaattcacattagctttagctaagtcacttaagtcacttaaacatcacagtgtgtgggggaaaatcacttggagaaggggaggctcagccagccttgcagtacagccctaatggaggtcagccccaagaggccacacctgtctcacctgcctcacctgcgtgtggctcaggtaagggctaacttcaggtgtggctggatgaggaatctggtgaggttgctcgggctctgcctctggggcaggctctctctaggtgaaaatgttcacatggctaagccaggtcatgtgctcttcacaggttcctgtggggacggggtggaggtgggggtgataggttctggaaagcaggtcacatggggagcaaagttatcttggaggtcaaacatagaaggatcagcccaagataagagttggggaggtggctgggagaggcgccaagtgttcatctgtgtcttaacaggtgaggagagggagggggtcaataaggttgagccagcaaccttaggacccagcagcttccctggaagaccctgtgcacatggaccagaaaaggccactgtgggcggccttgggtgtcatgtatgtgcaactggtctggctgcttcggccacagtctctgggcagctgaagtgtcctcagatgccaacctcaccgcccacagtagcaccctcttatctgcggcttttcttgatcctgcggcacctggccaattgactagcggtaccacgtctcaaggtcatgcatgtgttctgggagattcaggtttgggccaggctgagctgatcgcttggcaaaccttacagactctagagcgaggcatccagcctaacaggccaaagagtgtttgccaagcatatgtgctgtcttagggacagtctcagaggcttcgttgcctagacaccagagcagggcagctgtccctgcgcaggttggagccctgggttgcactggttccaatcaggtttccttcctgacactgtccctctcccctaccccatcaacccctgccactcacagctccttttcccagatagcaaatgctgtctaatgaatcaccccaaaacaaagtggctcacaacagcagacaccctgttactgctcagtctctgtggctcaggaattcaggaagttcttgtgtgggtcagtaattcaaaaagttactgatttggggcagtcctgacttggggtctctcctggggtggcagtcagatggtgattggagcagctgggggctggccagggctccctcttgccacatggcctctctgttgaggctagtctgggcttcctcacagcatggcagctcagggctgaaaggctgccttgtgtgggggctggcttcctccaggacgaccatccagagacagtcagggggatgcaacgtggctttttttttaacctatccttggaagtcacacagtgtcacttttgctgtactttattggtaaaacagtcaccaaaggctgacctcatttcaagaggagggcctagatctttctcaatgaaaagggatgtcagatataaagggatttgttgacatgatttaaaaccatcacagctcccctggcccctcctggtcaaccaacacttaaagcccagatggctttgaggtagctggatgtgaccttactctagtccagcccttctcattttattatatttatttttgtttattggaactcaggtgcagagagttgagtgaatcatactccagttcattgtacgttttccatcattgattcatgcagtgacctctcatattcactcactcattcatttatgcttcctccttgcccctgtatcttatgctcattttcctcctcaccttccttaaacaatcattctattcgatttcatgaatatcctttcatttgcatgggttcttaaaatatgtattttaatttctaggtaatgtgttgtgttgtatctgtttctgctgaggtccatacgtgctgtaatgcacggatctcatctcttgcccacctaaggtgaggcaaggagactagagcggagtgacacgcccaaggtcacccagctaaaccaggaccgcaacgatcctggccctcttccctcagcatctcacactcatgtttccacgtgccacctcctaaccgcctgcaatagcttgaaataaggttttgaaaaaattgtgaatctggggtccagagagtgtcggaagtgcccctgttttctatctagtaactgttgtgttcttttctcttttgccacaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaatatcctttgttcaccgggctgggcatgctcctgggacctgcacgctgggtccagccctccgaggctccctgggccacgagctgtgtcagctgtgctgggctacaaacggggcctcgggcctactgcatctgcatcactggggtgctgtgaaatgcagagttctgggccccgccctagactggatgaatcagaatatctggggacggggcccagcaatctgcttgtataataagctgcctgggttgggtttttgttttttgtttttttcatataataagcaacatttgagaaaatcagcctaagaagttatgaaatatcatctcctgtagctgagcttgcccaggggcccactcatgtgttggggtaacagtcgttagttacatgctgcctcattcccttctttcccttctgtgccatggcgctggatgctttcacggccttccctctctctagggtgaaggggctcaggagatggaagagcgtagtggtcagggcccctggctgttggctggagggccctgaagcagtggttctcagccctgattgcacattagagtctcctggaaagttataacaaactacagaccactcagttccacctaggcataaaaacaaacaaacaaaaaacaacaacggaaaactctctgggtaattctaatgtgcagacaaagttgagaacactgtctggaagtgttctgtttgtccatatagaaacaagcaaatgggtccttcagaaacagtggctttgaagggatgggcgctcgctgtggagttacaagccccttacttcatcagaatcctggggctgtagaaattgggaaggacttttttttttttttttttgagacggagtctcgctctgtcacccaggctggagtgcagtggtgccgtctcggctcactgcaagctcctgggttcgcaccattgtcctgcctcagcctcctgtatagccgggaccacaggtgcccgccaccacgctcggctattcttttttgtatttttagtagaaacggggtttcaccgtgttagccaggatggtctcgatctcctaacctcgtgatctgcctgcctcggcctcccaaagtgttgggattacaggtgtaatctgccaccgtgcccagcccagaaaggacctttaagtgctgaagttcctcccccacttccacgagtgatgaaattgagccccacaggagaggctccccagggtcatgtggtcaggaacagatgggactagaaccctggtactgactgtgggaatttttataataaggattcctccaggcaggactgctgtgtctctcaagggccaggatgggagcattaggcttcatcgatgagtttctatggaaagatttaaaagtctcaggtactggttgaaagaaggtagcctagagataaagaaagtttctattgagacagaaatgttctataaatgtttgaggccaggtgcggtggctcacgcctgtaatcccagcactttgggaagccaaggcaggtggatcacctgaggtcaggagttcgagaccagcctggccaacatgaggtgaaaccttatctctgctaataatacaaaaattagccaggcgttggggcacatgccagtaattccagctgctcgggaggctgaggcaagagaattgcttgaactcgggacgaagaggttgcagtgagctgagatcatgccactgcactccagcctgaggaaaagagtgaaactctgtctcaaataaataaataaataaatataaatgtttgagcccctcaacttaaaagtattttaagaaaatgcattttaaaacaagtggctgcagctgcctgagtggccaagcatggttttagtgcccggggtactggatgggagactaggctttagtcagccccataggactgcttgcatatctgctcacggtggagtcagggagtgggagagctgagggccctgcaggtcaggcacccctgagagaagggcagcaaggcccagagaagacaaagggcttgccctaaatcacgcagctggcaactgacagagctggacttcaaatccaggttcccctgaccccgaagtccatgcccatcccacaccccatgcatccatagtactgggtaggactaggcaggtactagtagatactaggtgggaccggtgaggtcttaggaggatgctcagggcctgcagtccaggtgcactgggacacgccggacctggatccgggcctaacacctactccctgggtgctgtggccacccctccgggggagtgtgccttcccacctggaggagaggaagggggcccagccttagcagtgccaggtgggtggcattccaagattgcttgggaagactggctggacagggaaggagatagcctggagtactagccagccagttcttcttgaagaagtggaatccgaccctgtcattaggaagggaactcagcttaaaaagtaatctgggcctcaaaaggcgacacagagcacttcccagggcttacctgggttctctgcttttcagccagtggcttttcttctctgcctgattggtttttacacatgatcttctctggcattagcccagtgcctttagcatgaagtgaaggatggataggtggagagtctgaatgaggggaggggaactgatagtgccagaaaccccaagctcagctgtgccccactgtggtggaggcaatgaagtgacatgttctgggtgtgtgtgcacgggtctggtttggctgggttgttgcatccttgtcccgatggggagagcacaggcaccagctgatggaatgaaactggccagcctgtgggctcggtgtcactttcctaagcaggcgagaaaaggtttgggaggcaagaggtggcgtggtaggagggctaaaagaactgcctatgaaggcttcaaggtaactttagagtggatcagtatagaatagtccttaacactgagactgcctgagcttggatcccatcctactacttgctctgtgacctggcacaagttaacgtctgacccttctgtgcctcagttttctcatttagaaagtggggatcacaagcgtacattccacacagagcatttctgttgggccgtaagaatgtgcctggcactgagcaagctcttggcagaggtcagcttctgtccttactgtcaccagcaccagcatcagcgtctgtctcccatcatcactacttgtgcctcatccaacacaagggcagcagaatgtaaaagcttagtccgtctgggttccggtccaggctctgctatatgccagcttggggtcttggactggctgctttacttttcacccctgcaaagttgggagattgacaggtccactgtgtggcatcttttttgatatcaaggtggacatagaaaatgttctacaggaaaatggatcctcagaagtacccacaggactagggagactagtgctaagataatcactcgggttcctcccagttcagaattctgtgacgctggcccagggctgccccttaacacgtcagaaggccgtctgtggcaggggagtgaacactggacttggtgatcgggaaatccgggctctagtctcagctggtcattaacttgctgtggggccttgggaaagttcctcaggctctctgggcctcagagggttagactagatcatctctaaggtctctttctgcctcaatattcactaactttgtgagtatggatttccctgagagaattatggtggtcccttcaccccggatctccacccctctctgtcttcctcctcctcctcctgtgagactccatgaactgggctgcaaacttggcagtgggagcggggtaggtgggagtggagctggaagagcatagacgggcccttcctgggaagcttccccttgctggccttccatggagggtgtggggtggtcccgtcggaaggggtattatcacattagctcatttttctcttgagagcgtgtcctgccctgaaaatgtgatgaagaagtcagggcatgggaacctctgcctgcactactactggtgagggaaccttgggctgtcccactagagcccagcacacaccaaggaaaaatcaggaggccttggaatcaaagctttgcctgctgaagcgggacctctgcagaccagaggggtttctatgctgtctgtgagactcagccttaaagaggagacagctttccttccctacactcaggacggaccccctgccgtactcttgggggtcttcaggatctctggaacctgccagagaatgagagagaagaaatggaaaccactcttaaccttagtttaaaagattaaaaataaaatctccaaatttcaatgaaacccagagaaagtctctctgtcttggaatcctgttccacccatgtcccccgttccaggtgggcgtgggcccacaggccgttcggcataaactgtgaagaaacggggtgcttggcgcaggccatgctctttagaggcaacctcaggcacacattggggagaatgaagaccaatgcaatctaaataaatgaaaggaggggaacaagtttttagaaatctgtgtttactctggcacgcgactggcctccactgcttttgacatattagggaaaattttggcggggacccactagaagcacttaaaaaggcatatgtttcttttcagaatacaaggggcttggaatgcattgtttaaacaaaattcttatgaatctttgattcattttaaaaaatatgtagattatgtttgtttcacttgtactttctgtggcattaacttccttgactccctttctcagaccatttgaaataattattttactgactatttttgccaattgtgtggccttagcgatctatattccctttccagaagatgattccaacgccaccaattccaacctggtaagtccaccatcctcaagtctctgctttttcactcgatggagaactgcgttcagatcacatagatgcatggaatgtgggagagaagtgagacgtgtgtttggcatgtgcaggagccctgcagagctcacatcccgagtgctgttttactctttattcaaatcagcacctgtctcattccggcctgttttccaaaagaatattccagttaggtggtggtgagctctgtgtgtgtgtgtgtgtgtgtgtgtgtgtgtgtgtgtgtgtttagtagcaaatcccgtgactgctacaaaatgtgctgcaaaagttgtgagtgcaggtgttcgctgcagcgaacatctgttcttggattgtgttgtatttcctttgaatgtctttgttccattggtggggtttgctcaggtgatctggagtgttgctgcacgataaataatttctaggaagcttttaggaacatttgcttttgcagccaacatgtattattgagttagaagggccttattttattgggaaaggcggctttccatttggattgttgaggggccagctctggcaatttggggttagaattggtccatggaaaaagtggagagtgtgtttacttttggctgagcttgaagtcattacaaagacttttgctccatctgggcatgtgaggaaaagagctctggaatgcagttggcaaaattggggcactccaggatgcctctgcaaaaggcatgcagggaaaatcccgtctctttctccccctccattgcagagacaccgtcactctccacgtgatttccacatggcgtgtttggtcatcagagccaccgtctttcccctgccgtcagtaccttcctttaattactgagatggaaccgtccaatgagatggtttttaaaagaagcaggcagcttataggattctcctttccacagctgctgggctgatgccatcacagggtggttcttgtattttgtaacctttgacattttcttgggccctttcagcaaaaaaaaatatgatgcacgttttaacttctcagctgtcgccccagttttttcaggtaaccgctgatgcatagcaggtaaggtgttcaccgcctgcgggctgtggtgtcttgtggctcggcttggggccctttgttggggacaggctccaaaaatttcaaagctgggcacaccactgagtgatggcatggccagagtcggaaggcagagcatcggccgccgtccgtgaggccatccgaagcgtgacctcatctcttaaggggcaagaaatctttactgtgtcaaaataaatacaagccaaagtgtctccctgaagcaggaactccttcccttggttccatttcttccctgtgtagccacctccttcctctgccatggtcctcccaaccctcctacagtttcacatttaatctgcaacttttaaagaggagccttcgttccacatagaatccgtatcttgttcttaagctgatgacacttggggctgctcaaggcccatgcagtggtgaaggtgtgtagaggagtttggtttttcttaggtcctgagatggccacatgtagccccttcacccctcggtttccaggaggattaagggagccacttggcttgctgagctagagggaagccctgggctggctgagacccctcaactctggacctcctggaggcagaggggctcgtaggagaggacaagaggtcaccctggacttcttctggagctggagtgaggttgctgtgtacagatgaggtgggagggatggcaggtttttatcacatcacagagtgatggaagaattctaaaggaggtggtggggctgcttgcacaactgtgtaactttaccaaacatcatcgaattgtgtacttacagggggtgaactttatggtatggtaatgatacctcaaaaaagctgcagatgacttctcattctctgcattccacaatgtcgcacttcccctggggcagtgaatgctgccagctgaaggtggggggtggcatcagaaaacccttaaaacagatgaataaatacgacctcatatcagctaataaatcagaacacgattctgccccatggagaaacccatcgcgagtgctgtgacccggcctcccggtccttgctctctacagcatcttgaagctgcagcatctttgcagatgccccctttacaaagcacattctccccttgcttcttccagcctctcctcctgtgtctacacgaacgtttactaggcttttgtcctgagccctctgattttcttcttctgcactctccctttggggagctcatctgtgtccacagatttaagttacctttccaagtaaattgttgctaagactgacatctccagtgctaagcctttccaaaggcctggccccatatttcccgcattggagaggcctgtggaccggtgcagcgaccgctgaggcctgcacatcattacaacccgagagaactccaactgtgcagaccccagctcccctgcggatctgattcacatttagtagttctggggcatggtctggggatgcgcatcaaaaaatttcctcgcagggatgccgatgattagtcagctttgggaacaaccggcctcttgggcagagcaaaatttgagttggacagacctgacttcaaatcttggcttctccactttaagattaagtctgggccgggcgcagtggcccatgcctgtaatcccagcactttgggaggttgaggcaggtggatcatgaggtcaggagatcgagaccagcctggctaacacggtaaaaccccatctctactaaaaatacaaaaaattagccaggcgtggtggcgggcacctgtagtcccagctactcaggaggctgaggcaggagaatggtgtgaacgtgggaggcggagcttgcagtgagccgagatcgcgccaccgcactccagcctgggtgacagaaggagactccatctcaaaaaaaaaaaaaaaaaaaaaaggttaagtctgaatcttagtctgaggttatttagtctttccaaacctcagttccccagcttgtaaaatggaagtgacctcagagggttctagggaagagtagggcgggcagtgacaattatatgtgccaggatgtcttgccaatacctcaaacaagccccaaatagaactcattctctctcccaccacacgaccctgtccccctgaagaaaacgaaacatagcccaggtgaatgctgctccttttcttttcccttggccgggttgatggcattgctggccttgctgtcacatggaaccatctctgacatcttcttccccttgccatgcccatctgagcaggaatccagtcttggagattgtaatttgcaatgtatcacatttagctttctttctattctcaaagtcatttgttcagacttcctgtgccttagtttcttcatttataaaatggaaataacgataatgacagtacctacctcatagggttgttgtgaagattaaatgagccaaaatatgtaaagcccttaggagagcaccttagtaagggcgaagtgttgggtcttgttaatagtgctggatactattgttattattgtcatcatcatcatccttgtcaacctaacccaggccctgttgcctttttcatggactcttacagtcacctccttcctgctgtcctccctctggtctctccttccactggtctagctcgtgtgtgtgtgtgtgtgtgtgtgtgtgtgtgtgtgtgtgtgcagtcatttgccaaacatctataccaacagataggcactatgattaatagggaagatgaaactgtaaacagttgtttcaaatagtgaaaggtcttataaagggccagggtgtcagggtggaagaactgattcattttgctgtagagaaaggattaatggcaagtttcacataggttgacatatttgcattgcgtctctcaagaagaggatgccataagagatacttcaggttgaagtgtactcatgtgcaaaggcatgagtatacatgtggtcacattctttaggaccagaggaaggggtgctggttttgaggggatgagaagagccaggtgatgggggcttgatggcccatgcaaactgttggacttaactgcaggtgaggaggaggctcgaaggctttaacggcagaggagtgctcttgcagcatgaggaagatggctcagacggaggcctcactgtttgtgaagagaaaaagaaagcttgccagagtccagatggtggtgacaataaggatagagagggggcagtggatttaggaggcaagcttgcctggacgggtaaccagttggatatcatgggtggcggagagagctggctcccaggatggtgatacgaggagccaggtgcccttggccaggagaaagacttcaggaggaaggtcatatttgaggggcagggaatgatgcgtacgattagggattgtcaagtggaggagcccgtggagcgtgaggctggggatgtcctaccggcggtcgacaggagcctgcaacccaggagactgtttatgctgaggatggagacttgggggcaacaggaggagagacacaaggagaagctgtaggtatggcccagagcacctgcatcagggtggagtgggagggtagcagtgaccacagccagaccctggagaacagtgacgtttgcagagggtggaggaagaggagcaaaggaaggtcatacaccacgtgtcaggaaggcttagcctgagaggtaggaggggaacctgctgagagtggagtcttagaagctaagggaacagagagtttaagatattcaagaggggctggttggtagttcaaaatcgtggctcatggcaactcaaggccaatgacaagaggattggcctgactgagaagagctgagcttagggccaaaagtacgagaagaggatattgatctgtgtctgtacccctatggaggccctgaagtagtaggtgcatgacaactgtttgctgaggttcaatgcttgaaacattcccattgttgtgccagagtgggatgccccaaatcacttatgtaccccgaaaatgaagcttgagaaatcctccattagtttcatagctttttttaaaaaattaaagaattgcgatttcagagccctactctgagaaacagcaaagaagagatgctgatgcacctgaagcaggtggctctcaacccctgtggcataagttcatagagatgattaaaatgcatgttcccaggccctgctcccagagattctgactctggagtgggccctaggagtttgaatttttaataagctcccctggggttctgatgcaagtggtcctgggctgctctttgagaacagtgacctagaatgttcctcatggtgtgattggatccaccttcagctccctccgcaatcagctctgtctacccacaggttccctttaggatccaagcagaaagacgacacacgtcaactgctgagagctttcccactccattgggttcaagaataatctatttagcaaagcacactcacactgtcacagaattagaaaagattcttcttttcacacacacttgcaaattcacatctgtgcttgctcctgctctcagattccctcgcaaacgcatcggcttccacccattctgtcgcaggccctttcctttctcccacttatttttctaacactttgctttcttctgtttccaagagatgaaaagtattccagaatagagttttttttttaaaagatctctctctcattatttaaataaaagtctgtttgttgtatgctccatctaacatacacttttgcaccaaaatccatcatctttgttatcttttcctcatgctagtgaagcataatgaaagctgaactgggccatgacatgacaattctttctttagatttagtgctgttattggcaatgccacctctatgcagcacatcgtttataatatagcagctgtaacccctgtctaccaagagctattacctgttaggtagattgtctgatgtctgttgaacaagctctgcaagcggagccgactcattgtgtgtggaaaacttcctgtcctctgcataccctgaagcccacgaagacttggcttgagttgaaatattaagagaatatatttggcatttgaccttgtgcaaagaacagtgcatgtactttctggagcaagagccaagcttgaagtggaggtggagagaagacgggatgaggccatcaaagggatcatcttttggctgggctttcttccttcagaggttgtgagaggagaagccgtccgtcagaggggcttgagctagactaggaagaaggttgagatgtcagatttgcccatttattggtgtaaaattggggcaaccagagttgcctcataacctggctgagaggattaagtgagttaccataagtaaacttcacaggacatgcccagcacaggcgaatgtgtgttgctctttggaactctaagccaggctgagggcccctcccctctgcctggtccctgggggtaagtcacagtcattggcaccttgtgctagctttggcctcagaagggtgggaaagaagagaccaaaacgctgtgctttttggcagctgtgacccagcaagattagtgtctgtgtgctcacccttgccttctgactacacagggagagaagctgggatccattaatggccaaagaagagccccagagggagagcactggtgggggaccccactcccccacccctgagctttgtgtgtctcttgccagtctgctcaggaggtgcctgtcagcctgaggttcccccattcccacacagtgctgggttgaatcacccgacatggggccctgcacttggaccaccaccgcaagttctgagatgcgtctgagccctatcgccccccgtgctttgagaagtgaatggaaatgccactttgggttcccctcctctccctgcagtgaactgtgttttcttttattatcaggtttgcctaagagtgagaagtatttttatagggctttcatgcatcaacaataatgatgacaatgaaatgagctttattattgctatctcttatgtgttgtcctaatgcagcaggtgttagggtttgcagaaatgctagggttataaaatacactaatagataactacaagcaacaaaccacatagctactgtatcatgtacaaacaccctgtcctgtgctgtgtagtggggtgtggaaggcagggtggagagcctgtttttggatgagagaatgagcttgacacagcgcattgggaaagtgcttctacggagtcagttctcccctcagattttccggctgaatgggtctgagtgggacctgggtgtgggtgtgtcttaaaagctataccagagccagagttgcaggcactgacctaggaagagagatctgaactgtgtggccttaggtcagtcacttaacctctctgttggtatctcttttggcacgtggagtagtaatgcttgcttagtcattgtaattgcctttattgagtgaccaccaggtaccagagctttgcgtgcaatgtttctaatctccacaactgtaaattatgctttctatttatttgtttacttgatggtagagaatgtatccctcttgttcatggctgtatccccagtgctttggcaataactggcacacgtaaggctctccataaatatctgctgagtgaaccctgggtgaatgaatggatcctgtgaagtgttatccctttatttcagataagaaagtaaagtctcagagaagtaaagtgacttggtgaggcagtggcagggctgtagttggaacttaggactgtatgaaaccacagcttgggttctttgctctgttccctgggatgtgtagggtcgctgtgagtatccaatgaagtatatgtgaaaatattttaaagattaaacactctgtagcagtattaacagatttaaaataaaaacaaacaaaatttggttctgttgcaaaataaattcagtaagtaccaagttagccaaaggtaaatacattatttttttaccttttttttgagacagagtctctctctgtcgcccaggctggagtgcagtggcgcgatctcggctcactgcaagctccacctcccgggttcacgccgttctcccgtctcagcctcccgagtagctgggactacacgcgctcagcaccatgcccagctaatttttttgtatttttagtagagacggggtttcaccgtgttagtcaggatggtctcgatctcctgacctcgtgatctgcccgcctcggcctcccaaaatgctgggattacaggcgtgagccactgcgcccggccaggtaaatacattattataagacttctccaagcctctaacacaacagcaacagacactacttatgacttcacaccatgtgcagatgctgtcctaagtgccttgcgtataaatgcgtttaaacatgattatagcacgatgagatgttattatcccattcaatagatgagcacacacaagctcagagaaggtaaataattcaccctgtgagatgtagccctgaagcgaagtcatggccatgcagaagtgggtgaggcatctcccggtctgtgttcttagccattctgctacagctgcctccttgtgtggtaaggtgctccgtgagtccctggactagccagacagcacatcacctttcccactcataccatcacagacatcttgaagaatggtgttcccgggctcacacctttgggaaatgctgctctgtgttgccccaagaaccgatgcattaggagaaaggacagagctggaaacgggatgagacacgttgcaaggctggtgtaggaaaggagcaaagaccacaggactgtcttcatcaggaacatggcatttcaaaatagatggcagcttctggatgggtctgtgcttcatctcatggtcataaacccgcagagagcctggggcaattgtttgactcagggtttactcactaaatatttcagagagaggagaaagcattgtctgctctgcgtttgccagcggatgggaaaagagagatgatgatttgaagtctaaatatggtgacacctcttgctccagttttatccatctttattcattttttgggggagaatcttccaaataaattcactgtttatgtaatagaacccctttcatgtaccaaacttcttgtaatttaagtatatttgaaggaagtctttccagaatataaaatacaaatccctggatccttaaaagaaaaatctgaacatatttcatcctttttctgggactatacaattcttaggaatttcaatgattgcacctgttgtaatgctggggagctgtcaggagagctaagcaacccgcacagggtcccggaacgtcctgacctggggaagatttgggatgtgcctttcatgcaccaccctgttggggtgtcagcctcctccagcaccagcctgattaatttgctcccccctctctcctgcaggcttgggaaccagttgatcaagtccattacagttatgtgcaaagttagagtaaatagatcctgattgaggacctatggggcttacttatgaataaagtgcattagctttaatttatgggttttataacattgattttggcttcttagaagccatttttcccctttattctctttgttctctctagtttctgtatgattgaagttgttggattggcgccttctaactaataataatagcagcaataacttcagcccttacgctgctggcattgctctatggtccgtgtgttaactcatttagtcccctcgactaccccatgagacctttcttttttttttttttttttttaatgccaaacattacattttattacctttgagcttattaaccagctttgcgtttattagcaaatacatttaaatatctcttttttttttcttttctttttttattatactttaggttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccctttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcgtatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttggttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggtgttatttctgagggctctgttctgttccattgatctatatctctgttttggtaccaataccatgctgttttggttactgtagccttgtagtaaagtttgaagtcaggtagtgtgatgcctccagctttgttcttttggcttaggattgacttggcaatgcgggctcttttttggttccatatgaagtttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacaacccttgtaagttggattcctaggtattttattctctttgagcaattgtgaatgggagttcacttatgatttggctctctgtttgtctgttgttggtgtataagaatgcttgtgatttttgtacattgattttgtatcctgagactttgctgaaattgcttatcagcttaaggagattttgggctgagacaatggggttttgtagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttttcatagatagctcttattattttgaaatacgtcccatcaatacctaatttattgagagtttttagcatgaagggttgttgaattttgtcaaaggctttttctgcatctattgagataatcatgtggtttttgtctttggttctgtttatgtgctggattacatttattgatttgcgtatattgaaccagccttgcatcccagggatgaagcccacttgatcatggtggataagctttttgatgtgctgctggattcggtttgccagtattttattgaggatttttgcatcagtgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattaagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgacttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtcaatttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtactggttgttcctttccatgtttagcgcttccttcaggagctcttttagggcaggtctggtggtgacaaaatctctcagcatttgcttgtctgtaaagtattttatttctccttcacttatgaagcttagcttggctggatatgaaattctgggttggaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgatcgcatcagctcctgaggcttctgcattcttcatgtagttcttgagccttggttttcagctccatcagctcctttaagcacttctctgtattggttattctagttatacattcttctaaatttttttcaaagttttcaacttctttgcctttggtttgagtgtcctcccgtagctcagagtaatttgattgtctgaagccttcttctctcagctcgtcaaagtcattctccatccagctttgttctgttgctggtgaggagctgcgttcctttggaggaggagaggcgctctgatttttagagcttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgctgtgagaggtgtcagtctgcccctgctggggggtgcctcccagttaggctgctcaggggtcaggggtcagggacccacttgaagaggcagtctgcccgttctcagatctccagccgcgtgctgggagaaccactgctctcttcaaagctgtcagacagggacatttaagtctgcagaagttactgctgtctttttgtttgtctgtgccctgcccccagaggtggagcctacagaggcaggcaggcctccttgagctgtggtaggctccacccagttcgagcttcccggctgctttgtttacctaatcaagcccgggcaatggcgggcgcccctcccccagcctcgctgccgccttgcagtttgatctcagactgctgtgctagcaatcagcgagactccgtgggcgtaggaccctccgagccaggtgtgggatatagtctcgtggtgcgccgttttttaagccggtctgaaaagcgcaatattcgggtgggagtgacccaattttccaggtgcgtccgtcacccctttctttgactcggaaagggaactccctgaccgcttgcgcttcccaggtgaggcaatgcctcgccctgctttggctcgcgcacccactggcctgcgcccactgtctggcactccctagtgagatgaacccggtacctcagatggaaatgcagaaatcacccgtcttctgcgtcggtcacgctgagagctgtagaccggagctgttcctattcggccatcttggctcctcctcgagacctttcttgtaatcaccccattttaaagatgaggaaggggcacagggcaatgaactaacttgcccaagtttgcatagctatgaagcagtggagctgggattccagcctgggtgtgtggctcccaagtctgtgcttttaactgctatgctgtgtggcccccaactaaggtataaatgggaggggtattttgctttgaatacgatgccttaattatcaggccttcaactagagtttatgcagtgtgtgcgcttctgtctttaccaagaggaccaagggaggagcaacagtgaaggagggagtgaacgtccccaggctgggtggtgtctgtaggggtcctgggggcatgccatggagcccccaggccatgccatttggaaagcataaggggtaggcaaaggggaggccttttcatctgctactacctgagaggtagacttggctttgaggccatattttcccagggatcagtgattcatattacctgagatcctcaaccaaacaggcccccgggcctcttcctaaatagatgagaatctctggttggggtgagggaacccagaatcagcctgactttctgagacaaacttaaaacttgagggacccttctcgtggactgagtccttggaagcagatcttgggagctgctgggcctgcatttgaacttggggccttcatgggaccccagtcagtactggtggttggcagggctcagagcataacatgtgggggaccccacggcgccccgcccaggtgagagcagtccccctctcgtgccgagaggctccacaggttttgcctgtgcaccctaggccccactggagacgtggaaacatcgaagagctacggcctgaacaccaggatgtgggatgggtagtaagagagtgctgagctgcatgtcctagccctgggctctggttccagttctacctctgcctggtggcacggccttgtcacttcacttctctgagttttaggtttctcggctgtgaaataaagataataattcctacctcactgagttatggcaagggcaaatgagaatatagatagaaatgctccgcccagctctaccaaaaaaaaaagtatatatatacacacacatacacacacattagctgggcatggtggcttgcacctgtagttttagctgcttgggaggctgagacgggaggagtgcttcaacccaggagttcaaggcagcagtgagctatgattacaccagggtgatggggcgagaccccatgtttattttttaaaatgctctggaaaaatgcaaagtgccatataaacatagaggcattattgtgatcattattactgttatgattcaaactagacagatatatttgtctctaaaatacttactgtttttttttttctggcacattcctctgtgaacctttttcctcagcctcctctcaagataacttagagatgcaaaagaactagaagccaagttccaaatttagttcttgacctttccaagatgggtggtgagtggtgtggctgcaacctgcctgctgccaagagtctggcagggctgccggggtccgggagcgccaggccagtggaccctgtctttgtgtgcagtcctggagccgacacatcgcctcacacaggcgcccctgccgggagctcatgcgggccactccctgttttctcactgggtctagctgaactctggcacagcgagtgtagctgctgagtagttcgtttggtgctgtcctgtgacttgcaaaccccttcctcaaatgcatagcagaaatagtgggaaaaccccagggcttttattatctgggctctcgggcacacagtcagaaacatggcctggggcagcctctcttctctgtgcctttgagtcctgaggaacaaggtcaggcatcaagaataaggaaggccaggatatccaggaggagacctcacgtctgcaccgaggcttcatcagatctgactggaagtgctgtggtccctgtggccaggccagccttcacagggctggggagcacaagccttggtgtggcctgtgcttgcagatggatcctggttgtgtgggggaaggcaggtggcaggtggtggatgctatgcttgagggctgggctgtgtacgcagctcacagtgtggaggtgcttgaaccctggcagttgggcacggttgatagggacgggccttgtgggagaaggtgtcgaaggccagggtgtggctccgagtcccacttctgctagactgaccagagagagcaggtaagagagtgaccagcagcaggccggggtcacttccacgcttcctgcccatcggaggaatgttccagaggttatcccagagagaggtgaagcccaacatggtctttcagccacacgccgggctccccttccccttctgccatgagtggaagcagcctgaggccctcaccagaagcagatgctagagccatgcctcttgtgcggcctgcagaaccgtgagccaaatacgcctcttttctttttaagtaaccctgcctcaggtattcctttatagcaacacaaatggacttagacaatccccaaggcccagacttggagtcccttcttgtaggaagttttctctgctcctccatgactggctttggtgctgccctctgtgtttccatagcattctagatgacccctatcaaagcacatttagcctcctgcttactcatctgcgtctctcagtgtgtttgttttctagcactgctgtgaaaataccatgcatttggtggcttaaaacaatagaaatttattgtctcacagttccagaggccagagtttcaaagtccaggtgttagtagcattggttcctctgggcactctgaggagtgtgttccgtgctcctgccctggctccagtgttgccagcagcgcctggcatcccttggcttctaggtgcctcactccagatctctgcctccgtcttcacatggcgcgctcccctgggtgtttgtgtctctgtgtccagctttccctcctctgataaggacagcagtcattggattagggctccttcaccttaatccagtataacctcattttcacatgattccatctgcaaagactttatttccaaataaagtccatctgcagctctcaccagcagcgagccctgtgcaagaagggatcacatctacacagatccagtgcagtacctggagtacagctggggccttgcgcatgtctgtgagggccaggccaggctgttagagtgtttcttgaaggaaggtgtgcttcagtgtggatgctggtcctgactgggccgctgcccttgcctgttagctccagacagggtgggcttctgtacccgtttacagtatagccgcctgagggaccgtggcatgtgtggcagaggagatctcttgcgcccctgaggtcctccagttatatcttagtcctgcagcttagcaccaatgcctcctcattctctgcctcctctgcccgctggcctcagacatgcgccctaaagatgggagcatgcagtgtgaactggaggtgtaaggggtgaggccgctcccaggacacagcgggcctcatgcgacatgccctggcttctggatccctaagcaccgaggccatccagggaagggctggcctcctccctggctctcagggtgctgtgaatcaggtttggcaggggtctcagcaggggcttatctctgccacagttcagtccaaacaggatgagcagctcttggtggaccagcggtgacccaggcagctcctggtgctgtgtactaggctaggagctttggagggcgtccctccctgcagacccctctctcactgcccatacggctgtgtgttgtcatcatattttggcagagaacctgtcccataaccagagaacctctgtcctgggacagggacaggccccagctcactctgggaacagtcacggtgggtggacgatttgcagaatggtcggagaccctccagcaagaggatccattgttcacgactgcagggtgatttctttgggattgcagacaagggcctcccagtcacttttggtttggtgtctgttcttaacacagttcctgaaacatagaaggcactcgatgagtatttgctgaataaataactgaatgaatatgtgaagaagagaagctgttcatggactagggattctggcaaggtgtggcatggctgagacagcaccagatgagaggctaggaggcctccatcccagacctctctctgctcctcaccagctgagtgaccttgggcaaatgtctttgcttctcttgacctctgtttgttcatttttcttaatctaggagaggagtatatgtagaggattcttttatgttctgtgcatctgtggtcttttgcctgacaagtagaccatttgacttcatatgagcacattccttcatgcattccttctgtcatatttattaaatgcctactgtgtaccaggctaggtgctggaaaagcaagatgtgcggaaacaagggtgcgcagggtctctgccctcacagagcttgtcaggtttgataagagcttacgttcttatgatgccagccaataaacaactggcaacttcatacacaccatgctttcagagcactgtgaatattaataccatggagaaagtaaaggagataatgagatggagagttccagggtaagggcccacctggagcgggtaggcagggagggtctctctgaggaggtggcactggggctgagaggtggtgacaagatgggctggctctgggcagacctggggaggaggctgcgggcaggggacagcagggccaggaccccgaggtgagcagggcccactgtggctgctgctcaggaggggagatgaaggaggatgtgagtggggttggaggggcagacaggggctgaattatgtgggtcagcatgaggagtttgttgtgagtgtgacgttggcaggtctgtgtgcttcccaaggctccagaggagcaggaaggatctggaggagggttaggaaggtagcagagataggcgagggttacggccttgactttagcattcccagagcagttgatgtggttgccagagggcctggccagagctcactggggaagaaagccctggacggtgcaagctgccatttcttgaagggaagtcggtcatggaaacatgtcaaagggacctgccagaagcttctgggacacaaggctcttgtgaggtgttttcccgtctcttttgtgtacactgtgggcttggccatccagccttcatttccctagcaacttctctacatccagatccataagagaaacctttctggtcaccccataagggatgcaagctccgtaacgagcactcaggctcctcgctgatgggggctgcgaggttccagaaggttggcccatgcagcaggccactccttagcgcctctggccctgggtagactttggcctcaggggaaaggagcgtggagacagctgtggacacccagattgctgtatatctgacagcgcttggcccccatctatctggaagtggggtgaggcagactgcattttcaagctcaaccctttcctttatggcagctggggtgggtgaccagccctgtgtaagccataataacccagcctgcatgaggataccataaagcggaagccgggcggctctttgaagggatgacgtgggaagggtatcctctcctttccagcattccttcatttggggagcactgcctccttgggacaagactctgtattggggaggcagcactgaatggggaagtccctggtctggtgggggacagccaccacctggcacgtgatggtggcaagaatgcctaatgcttatgagtgccgcagtgtgcagctctgtgccttacacacgtcacctcccaccatctcccaaggaccgtgtggggtggatcatacagtcaggcactgcataacaagagtctgatcaaggacagagcacatgtacgatggtagtcccataaaactatcacggagccgaaacctccctatctttctgccgtcgtaatggtgcagtggcactcattacttacgtgtgtgtggtggtgtggtgctgttgtaaacaaacctactgggctgacagtcttatcaaagtctagcacagacagttctgtacagtactgtacagtacacaatacttgataataaatgactgttactgatttacgtatttactgtgctatacttttaactgttattttagagtatactcctacttattaaaacaaacgttaactgtaaaacagcctcaggcacgtccttcaggaggtagccataagaaggcattgtcatcttaggacatgcagctgtgtattattttccccgaagaccttccagtggcacaagatgtggaagacagtgatatggatgatcctgaccaaggatcctgatccttgatatcgacgatcctggcctaggctaatgtggacatttgtgtgttagtttttaacaaaaaccttgaaagttaagaaaatgttacaaatagaaaaaagcttatagaatatggataaaagaaaagtatttttgtacagctatacagtgtgtttgtgttttaagctaagtgttattacaaaagagtcaaaaagttaaaaaaaattaaaaggtttgtaaagtagaaaagttacagtaagctgaggttaatttttaattgaataaagaaaatctttaaatttttttttttgttttttgagacggagtctctctctgttgcccaggctggagtgcaatggtgctatcttggctcactgctacctccgcctcccaggttcaagcaattcttctgcctcagcctctcgagtagctgagattacaggtgcctgccaccatgcccggctaagttttgtatttttagtagagacggggtttcaccatgttggccaggctggtctcgaactcaggtgatccacccgctttggcctcccaaagtgctgggattccaggtgtgagccaccgcacctggcctagaaaatctttaaaataaatgtagtgtagcctaagtgcacaatgtttgtaaagtcgacagtagtgtcctgtaatgtcctaggccctcaaattcactcaccactcactcactgactcacacagagcaactttcagtcctgcaagctccgttcatggtaagtgccctatacaggtgcaccattttttgtcttttatagattattttttatgtaccttatctatgtttagacatgtttagatacacaaatacttaccattgtgcgacagttgctacagtgttcagtacagtctcaggcacggtcagaggcctgggagcactaggctgtatgtagcatacagtctgcgtgtgtcgtaggctgtgccatccaggtttgtgtaagtgcactttctgatgttcacacaacaacaaaatcacctaacgacttatttctcagaatgtatccctgtcatcaggagatacaagactataattaggggtaaactttaaaggactttgttgagaagaccattcatgtggggcttcctggatttggttgggttgtggtacctcctctagtgatgcagagccttcctatgatttttctccctgccccaccccaatgcccaccctttcgatttgctatttcctctctccacctcaccccaacacccagtgctatttacatgctatctatatgatgtaagttgtgtctttacttttcagctgcctgactgtgaatttataatcactggtattggtaacagtaggctagttagttggtccagtcaaacaaagatgaactgatccctgctctgttgcttgtggtcagcaccacgtgggcacacaggaggactaatcattcctgtgtaaacgctgagaaaacaactaagacacatggaaaaattaggagctatctgcaggattctgactgtaatgtgattattagaaagccaataaggcagtggttagcatgaattggagtggtagaaaaggatttcttggaagaagccgggcttgagtgccatcttgaagggtgtagaagaattgtctggaccaatggtaggagtgctgggattccaggtaaggaaaagaagagacaccattccatgtgaaagatatcattttgacatataaacacagaatttccaaagttcagtctaagatcattcttagggtggtctgttttcattcattcaacaattacctatcgagcacctatcatgtatgagacacagcagtgcttaaaacacacacagttcctgccttcatagggcatccttctatctaagggagacaggtattcagtatctatttacataattatttattcatttataactcacctctaaaatgtttaggtttggggtgtgactatatttgttttaagttaatattttacgcgtgctactgaaaaaacaaaacccaaactaatgatcactgtatttcatggaagcgggggctgtctcatgaagatgacatttgtcttaaattatgattgaaaaaaatgttttagggtagattgtttgtagagtttttcatcctgctaaagtgatccctaaatcataaaacttgagacttgctgaatgaaagggataaaagagtgaggaggacctacaaatcttcatggggagtagattgtgtctgtttgaagtaaagccacacctgtcatgagggaccaggagaggcttctaggaggaaagagaacataccagggaaagaactgagcaaactttcaaccctctgcagtattagaggtggacaggagggcagcactatattggagagattgttaaactgaaaactcaattagcatgcacaaaaagtatatgtgtttaaggctgttttaactgttggtgagatgctgagctgctaagggctgcctgctgtcattacctattagcaagactttaaattctgacttgctgaagtacgtatttccccctgtagctagccatttctagtaaagcttgtttatttttatttttgtaaaaaaaatggttatagttaatttatccttttggaattggaagagcttcctgcctgaataacttttttttcttttcattttctccagtgtagaattgctggttttggccttttggagctaagtaataaaactctttgtttattctgctgggtctttgcttgtgttagagctgttttatctcaaacatttgtaattctataaattgaaatcagcttttcttacacttgtggattcctttagatttgaaatctattcttggttacgtttatagcttcaacacgcctctcattgtaggtttatacatgtgtttgcttgctcatttattttgtcatcatttgctcattttattaccagttattgagtgcctactgtgtaccaggcactgggcaaggggcattctgtgagagagggtatggtacctgcgggcttaagtagtccgtgggcttgtgaggaaaacgctagattaaatcttgattactgtaaatgtcaagtatggccaagtgtgggatttcgtggcaggagtgagctttcctggaatttgtctttcttgcctcaatttgcctgatagtcatttcatgctagggatgttttaaagtctctggggaggccctgcagtgtagaggaaaatgctgatccacaccagaaatgcgaacctggctctctgcccttgggcaagtcacttaaccctcctgagcctcagtttccatctgtcacttagagctgattatacctacttaacacccaggctttttgtgaggggcattatctcattagagataatgtttttaaaagctctttgtaaattgtgtagcattcaaatggaagttattgttatttttattattgagtgccttctaattcaacactgggatagtaacaaaagaagagaggggttattatcacccctcttccctgtcacgtttagattggggcaaggaaaggttctcaacctcgaggaatttatgatcagactggggagacaagaaccagtttgagaagcaggtaatggtagttgagagaagggatagagggctcaagaatctctccgcgcctttctggctccaaaattctacagtaggagtcaggaaaggcttcacttgtgaagtggcacttgagtgaggccgtcatcagcataggaatcagaatcatctttgtgtgctcatcatagtaaaataaatattgattgagtagcagtatgtggcaagggactcacaaatacattttggttgaggagtcaggttacttggataaaaaatgataatgaatggtacaaaattccctccactggcgccacaggaggggcagccccgggcctgaggtctttgggaaaggtgtggggaggcggtgggcacaggcctagggaagggcaggatttagacgaaagcagagccattggaaaggcatattctgtgtttccactattgacagcctcaattattggttttcccattcagctttctgctctcagtaccccattctgtttacctgctggtgggcagagcgtcacacaaccaaactcgcgtagccttcttcaccctttcccctcttttctgcagaatgggtttgttatgacttgactgtgatttttcaggcctttaatcatccaaggtgaatgtctaagggtggacccaagcagggctggacccaagcagggctgagttaactggacccaagcagggctgagttaggggaagcagggaagagaggggaaggacagcctgagcccttccagacacaggcaaaggagagaggacagacatatcctccctgagagctctccaacccccccaattatcaaagcaaatcaatgtcactctaagtcatatctccatactagctctatcctttctcctgtccctatctctaggtctataaattcagggcttaagggatttctagggaaattacagcaaacgaatcactgagagagggggggaacctccaaaatgttgtgagttgcttgtttaatgtttcaggagcttcaaagaaattgagcaatttagattaaatttcaagaagtggggctgactagagagagaggaaagttagaaacagcgtgctatagaggttgatggtgggaataaactctgctgtttcagccaggccaggcttccttccagtgtgcttctgtatgatgttaataaatgggaaagtgattgacaacttccttaggcaactttggggagtgaaatgccaaatttgggcaaagcagacctctagctttattggtattggggctttgccagaattatctgctattaaatacttccagggacctgttgcctctttgtgacaaatgttagataatttccattaactgcattattgatggagaaagcagaaaggtgagagagtggagagagtaaagattgaatgagtgtcagaactaactggaggaagagggaagataaagatgtgaagaagtatatatctgaggataaaatgtaaaatgaaattaatgaaaatacgatggtcagattggaaggagagaaaatgcaaattacagagtgaaagaagacttctttctactctcaaatgttttggggggattttgggggggcaaataggcagtaggttttcacaccttttgaaaaacccacctcttcacacttgagttttcatgttcttggttcataatcctaggattaccattgtcagttgtgcagaatcccattggaaagcaatatgccatcagtacatctggtaacaggaggatgctaggaatgggaatacagaatatttatgcaacttctaggcttctaaaaattgtatgtttacatgcatatatacacatacatgcacacttatataaaacctgtcaaatttttcaaaaatttttgaaaggattagcattataaagtcataaggaatctctgaagggactttagagtagagaaagatgtgagaaaaagcctaaatatatcactctgcagcaaaccaatcatccacacaaccacagaaatctctgataaatctcttatgaactaaactccctgttgcccgatggttctttttggaaactttgtctctgtctttcgtattgaaatatcgcactgaaaagacctgccatggagatgttgatcccacttatgggcaagagggcgtctgaacttgtcttccagccatggctcaaagattgcagatggaaatccctgctgctcacatttgtatatttgatcaaactcttttcatggccagaccaggctccaggggttctgggtcacatcttccctctagctgccatttactttgatcatactagtaatgattaccatctacagcatgtattatgtgccaggaactttgaatttgtcatctttttggttttcttgggacagggtctcactctgtctcccaggctggagggcagtggcatgatctcggctcactgcaacctctgcctcctgggctcaagcgatcttcccacctcagcctcctgagtatctgggactacaaggcatgtgacactacacccggcgagtttttgtaattttttgtagaaacagggtcttgctgtcctaagctggtctcaaactcccgggctcaagctgtcctcctgcctcgacctccaaagtaccctccctccctgcggtctggaggagttgccttgggacctgtgcttccttggctctatgcactaccagacgcagtccagtgggcagcctggcgggtggccctgggactcattgctttgcagcctgtctggaccatccctaacagtttatttttttgacttttccagtggagagtccacagagaatatgacttttccttgggtcatctgtaaagacttggcaagggatgtcttgcatctgggaagatgtggtcttgggggtcacctaagcagcagaggaaaccttgcaagatgacatttggggctaatgtggaattaactaatagactgatgagtttgcttgatctgagaactcacaaaggatgttgaggaagaaagggcagctatgacctatcttggggttttgcattttgttcttgtgaccctgtggaaatgctcagatgagtgcacatgttcagactcatgccaggccagtgtgaagaatcaagctgagtatgcatccttccgaggctcaaagccaagagaaagaaagagaggcctggtgaaatatcataggaaatgtcacggtcttttctggactctcttaaaaagcccaagacccatttaatatttcgattgcaagacatatctctactggatggtgttttggaaagctggagtttaggaaaatcctggctgtaggaatgctctactgctgtgaacattcccgctttaggaatgctcatagcagtagagagtgggctactgacttttctggttttcaacagtatcttatttttcctgaacatttattaactgtctgccctatcagagaacttctcagattgggacttcccttgagtaagagacaatgacctgaaatgcagggcgagagaaatttctttcagttttaggcggaaggtgggacccaaatttaagagagccaaccccaagtaaggaagatcagctctcactgggagctgtgtaggacccaggggggagcacaccccaggaaagggctgccggtggatccggaggcctgacctggggcccaggctgaagtagaacatcagcacctctagtagcccagcaatttggatagcaggcagagtttaaaggaccaaactggaattatgagtcaagactgggcaggaagcaggaagcaaggatgaggagccaggttatgataactagtgatgcatggggtgtccaggcccagaggcactaaaagggggtcaaggacccagcatggagactgggtaacagagagccatgctgtgctcatggaatctgggcagcaagagtagcagctcccagaggggctggctggcaaccttttgtatcagcttaggaacttttcatgttggtcaggagcagagacgcagttccagttttggctggcctggagcttgcaggataagcccgtgtctggctgcactgtaaaaataacacggagaataggatgggtcttgtccttggtctctagagcagccactacatggaagaaagaggtagaaggcaggtgtctatcaagtgacatcacagaactcaagaggagtgaatgtcacctccattccccagtctcccaacattccctggggaacagggcagagggaagacagagtaggggaattccaggataagcttcatgcacccagaatgtggaatgctcaccaaagaagaacaagagccgtgttcacatcatgatattccgccctcttaattcccaaacagggctcccaggctacagagcagctttgataacagcagtgcactccctctcctctagaaagttaggtggctttaaaataggtaaggctaatttcattccttctgtgagttctgatgaaaggggcatttggcgaaaaacacgtgtgggttggcatgcaatgaatacttatttacatgggtgttttgaagacaatgacacagaatcaaaatttaacccacaagtttaggttttcagtttccttctgcttctctcctttgagaggtagagatggagaaactgtctctaccgctcttattttctcactctgataacaatcttttccattagtagagtgctatataaggtacagtgcacttgggaaatgcctcttgggaaggtgacatgtaaaaatggtggtcaacgccacttctgggcaggtgccaaggcctgtagcagcctgtgtctttgggtcctgcatgctttcctttgtgttggctggttcctctggctgagttcactgttggtctgtctgtggcaattacggagaagcatgacagtcacagcttccctgagttctactgaactcatgaactttgttcataacagactctacaagtggtacaggattcctatggccacaactcaactcaactccgtagaaatcaatgtttatggatcattggagctaaaagaaaacttgcagatcagatcatctcatccaattccctgactttacagaatgaggaaactgaggcacagtaagatttttttttttattttttgcccaggtctgaataaaattgaaggcacccttaccatagccaggattctttgtatataccactggctgaccagtggtagctgaaaaaaaaaaaaaaagggatttgagatggtaggaggggtgtctgactgaggagccatttttataggtttttatagacatttgcattggtttggagtagcagaaccagaaatagtctttcccttttcaggagcaactctgcacagaagactcactggctttggactctgtccctatcacatacatttcagtagccaggccaaggcatctggctgggaggctgggtacgtctcagagaataagcgcttgtcatagaatgggtcgtgaagctgggcagagagccaggtttgcagaaatggctttgtattgatgaagaagggagatttttaccttgtcttggcctccatcatgaagagagtgttacaaaaaagtacagatgacagcaggccactctcggagacacacacgaagcttgtcttcctccatcccaaatacataggtcagtggaccctcaggaatccattctgatgcacgggtggatgagccaagggctgggcagaggccatttcaatagcttaatgcttgccaggtatatctgagctagtgctgccccagggacagagtatcctctgggagatctgaaccaagcgagggtgtggcagccggtggatgacttacagtcagcctatctgggcagattttaaaccctggcgtttttagtgccttgactagtgtgagaaacttgaaactcagtctcattgctatttgtggtaatggtcatttagtttcaggaaaacatcgatggtgcccttccctagatagctgcgttgcaatggaccacattatggcatgcacattaatgtagggattgttcatacaaaagagggcaaagatgccacttgtgacagaaatgactgttacccagtgtctgttctctacctctttcatagggatagaattttcagctgggcacatgactgcttagaatgaagaactacagttctcatcctcccttgtggctaagtgaggttttgtgactaagttctagatagtaggatgtcagcagaggtgatgcgtgtgacttccggtgtgtgcccttgaaggcaaagtcatgcctgccctttccctttctccctctgcaggcgtgttgccgtcatggtgaggagccatttcatatcatgcagactaaaagaccctttccaggtgctggagcaaccattcagaaggcggtgatggctgggggagggcttccatgggagagaggaagtaaatgtctctcatggggaatccctgttgttttggtctctgtcaaccatggttcaattcataacttaagttataccctacttattgggaactttgattttggaaggcaaagaaatttaaaaattaagaaataaaaataaaacaacagatagcacttggataagttggccaagttcaagtaacacaaaaaagtcaggacatggaaccaggaggtggaagtgccttgtttctcctcctcctctttccgtttcccatgtcacccacaggactggtgtgcccggtaggaaagattggtaggtcccactggtcccgagtgtcctacggccctttatattggataatattggaactggattctcctagagattgggaatggtggcagaaaaattaaaattgggaggtgaaagctcaaggaggtagttacaaagcaaaggaaaacaaacagttttgggcatccagctgcctttcagtggtggtcactatggcagagatcagcagagtgaagggctaggagatagactcatttcggatctaactttaataatcaattttaatgacccttgagcgaatggagcagttgattttcctctcaatcctctctctgtgtctgttgttcctgcaaagcctattgggacttgcctgaggaattggcccttatccttgaggttaatgaaagacaacactcaagaagcttcccacttacagaactctttctccaatttagaatggaggctacttttttttttactgtggtaaaatatacataatataacattcacattttaaccattttaaagtggcattgagtacattcatactgttgtgcaaccatcacaaccatccatctccaggactgttttcttcctgcaaaactgaaacgctctacctattaaacaatcagttcccattcccccttcccccagcccctggcacccaccattctactttctgtctatgaatttgaccactctgggaacctcatataagtggaatctcagagtatttgtccttttgtgactggagctagttttggctaagtcatgggagaggcaagtggatcccttgctggtaggaaggacagggccgtgttgacagggaccatgaggcctccgccctgcagttttcctttgtcctctgcgtggggtggggcagccctcttggggaaaaggctctcctcatttcatctttacttttccttcctgggagatggagcaaatggtgcctgccttgtctatttggagcacacaggcatagatcattaataagataattggaaggtacttggcaaaatctgaaatattaactgtctcagagaagctgaataatcacagggtctcaccaagtgccacctcaacaagtgcagctttcacccgtccttggacatttatttccctttgtctgcactctgttccctttctcccaaaatgctgggtagaggttctttaaaattcaagaaaaaaatcagacttccccttctccccagtgacattcccggcctcttctctcactcgagtgatttcctgtatgaaattcaacaacaggtccacccagaggagttctttttcctccagcttctctgtttaaaaatcttgggttcttcctgacaaaaggaggcttagtcatcttcccccagtgacaggccctacttaaaaacaaacaacgaagaaatcctacatcccactccagcttgtgctgcagagcctggccggggagggacaggggatggtacacttggaaaggcaatcaaagagtgggcggtcagaaaacaaaacctgccaggttatcaaaaggacaccacctccaatgcacagagctgcttccttcccgcacacacggaatcttcctgctccctgccccactcatcgtggtcgtggccagctgtgtccagcagcctggcgcccacttaacaaacaggagcaatgagggagactcctcacccggggccagcagtgggtcagggaagaggctggggttagggctcaggggtctcaacctggagtcctgtgtttgcagctacaactccaaggccttgggatttgcctagtggggaatcctgggctccagggaagaagtcactgaaggtttaccaggcagacttataaatggggagaaactgaagcctagaacgcccccctctctgatgactgctgcctacgctgcctccttccttctctcagctccaaaggcacagaatgtctgatcggagagtttagctgctttctactgttttctcacagtttcgtttatcagccttgtcttgccaatgatacagaagctccccgcaggacagtgggtaggtgggagcttcccgatgatcatgttggtgttgacaaagctccccaaagtggggtattccctcaggctggtctccggagccggctctgtgctctgaaagcggcccatcctgccgtcctagagtataggtgccgtctatctctgtgtgttgagttatcgggagatgaaagatttttttcacttggtgaatcctggcattgtgggaagactctcctaacacagacataattctcttgcaatcccacaggcgcacacatacacagaggcgtcacacacacacagaggcacacccctggtgtgtcatgggcgttgttttgcgtggagaacgtggagcgtgaagacacattttctatgacagtggttcccttggtgtgggattgatggacctgtggacaacaggagttttgttagtgctcttcagggtcccggagatcatgtactagaacacctttcctccacagaggaagagactgcaacccagagagctttgtcacttagacacacaattttactttgcttgggcttcagtttccctatatgaaaagaaaaaaaaaatagaattgccccaaaggatcttaaggactttttcagaattccgtacataatgagtttttattgtcattttctcaccattctttggcctttgtggaactgactagaatagctcaattgtttgttaaggaatttctgacctcaatcagttttccttatataaggagttaccagttttagagcctcatgtcacttggggctgtgtctcacttaaaagtgctgtgagagcatattggattgctgaaaggagaaactgaccacctcttagaagacatcaccaattcaaatgagggtgtctcctttcctagcgaaaacgggcacttagactagtttagagccaccggaggtgggaggatgagccagatgtccctggaaagccagtttaggggtgcttttctcatgttttccagggtttaattatgctccgtgcttgagagaaatatttttgaacctgaggattttttatcttaacgttgaacaaattatttatctttctttttctgtcccctccatagttccccaatgactctaatttttattattgttataaagcatttttccttaaagagtaaagacgcaaataaaaaaaatctgcagcttagacacaagaacaagagtgaatctgacagacctaaggttgagtgaaagaaacatggcaaaggggtgtgttcagcaggactccattcctgttaagctaaaaatgggccaaatgaagctatcttttaaggtacacatacatacgtggcaaaagcataaagaaaggtcaagaaatgatgatcgcaaagtcaaggtaatgttgtgtttctggattgatggtagttacatgaaagtatgctttattattcattaaactataaaaatatgtcatatgtaccttttaaataaaaatagaataaagtgacatggaaatcagaaaaaagctagtagcgtaaaaattgcagattcatatggtgggttgaatgctctcttccaaaaccacactaacatgatggtaaaggaatcgttaaaaaatgcataaaccacaaagacaaaatgaatccaaagaagacatcacccaccggtgtttatttgttcatttttttgtatttgaaatactctttgatgacatatttggctttgattctttggcgctggccttaacaaccatacagctgcaaccagttgcttacagggctttgcttttctgctgattttgcagaggccttctccattcctttagtttgaccaacctcagttaagctgatgtgggtgtcaacaaacagttcctcaaccaggtttttctacatagactcatgagggtcagatgcaagtacccgtgaattccacaagctaagccatcggggatgagggtggtcttcagcacccttttgaagcagtgttaatgtccatttctcccccagcagcaatgcctttcttggccatggtggaggcttaaggttggagctgaatgttgaactcactggagatgttctgccttcatgcagcccagtggcagctgggaaagctggaaagtagatggacaagtagtaacagactttgcatgtactgtatgagacagctgaatcctaagcggcagtggggaaaattgagacacaattaaacttgcagctcacaacctccaaaaggcttggaaattgtggtatcaggtatttttggaagtgacggttaaaatggggctaagaactggagaattggttcaacgtttgtattcttagaaaatgctaagagtagatggcacagtgttctcaccacaaaaataataactatgtgaggtggtgcatatgttaattagctagattgagtaattccacaatgtaaacatgcttcaaaacatgttgtacacagtaaatatatataattttatctgtccattgaaaaaaattaattagacctcagacccctactcctattctcagcaactaatactcttcccatttcagctgaggactggaggataaagcggaatgttctctaatggggataaagcaagaggtctgcatgggggcaccactggcacaatggagggcagcacgcccggggcgaatacagggctgagacttctggagtatctcccacttgctctcagagtgctgtcccataagcctgtactctctaggcagaagatctgcgtggctttccctggcagagtggaccagcctaaagaggacagccctaagggggccctaagatctagccaacagggcgttccagctgtggggccttagagcaaagcctagtgcatcataagccacacctgtgctcacaatgtcccatcagtttttggtggttctctcttaaataaggtccatcagttaaggatccctaaatgtccctaaatatcttaggaaggccttgaaaatagaaaccaaagctaacaagcaaaggatgcctatttaaatcagaatatacacgaggaaaacttaaaaaaaacacattattttctgtctttagagggataagatattatatccttgatacagaagctgattgctatgtaaagggaaaaattaaaacattgataattaagaaatgtgatgactgagtgctatgaatggttagaaaacaaaattgaagaatatccaagaaagtagggcaaaaaatcagagatggaaattaggagtaaaaaaaatatgaccattagacagtccaggaagtccagtatctgaatactaggagttccagaaagagataactacaaaaacagaggggaggaaatcaccaatgagacagttctagtacatttgctagaacagaaggatattagtatccagattgaaatggctcattaagtgcccttacaaatagatgaaacaggcctatcccaagggtacatctttgtgacatctcagaaaagtagggacaattggatcttacaagtttctaggctgggcacagtggctcacgcctgtaatcccagtaccagaggcagaggcgggtggatcgcttgagctcaggagttcgagaccagcctgggcaacatggcgaaaccatgtctttaccaaagatacaaaaaattagcgaggcttggtggtacgtgcctgtagtcccagctactcaggaggttgagatgggaggattgcttgagcctgggcgatggagcaagactctgtctcaaagaaaaaaaaagtttctagaaagaagaaatgtattacaaaaggtcaggaatcagcctgatttacccgcagccatgtgggaagctagaaggcgaaggagaattgccctcaaagttctgaagaaaaatgatttccagttgacaattttatatctgatcaaactatcactcaagcaagaaggtaaaagagaaacattttcagataggtaaaaatataaaacaaaaagaaaaaaataaaacttagcccgatgcaccttctctcaggaagctattggagttcttcaccatgaggagggagtaaaccaagggaaacataggatcccggaaatgggggccaacacagaagatggagtatgtgagagggggcccttcatagtcgtgataaagtggatgcaggacattgatctaaactaaatcatgacaaaactattgcagaggatagggaagaggtgaaagagggctaaacccttaccttctatgatgaggaaaaaaccttaaaaatcaccaaggggctacataagcatattattaaaaatatggaatggaataccaaaagaaacagctaaggaattgaaagcttattgttgttgaggggcaggttggggaggggggtaagaagagaactgtggattttttttcttcaatgaaccttttagaacaaattgactctttaaattatgtgtataggccgggcatggtggctcatgcctgtaatcccagcagtttgggaggccaaggttgggaggattacttgagcccaggagtttgagaccagcctggacaacatggcgagaccccgtctctacagaaaatacaaaaattagctgggtgtggtaacgtgtgcctgtggtcccagctactcaggaggctgaggtgggaggattgcttgagtctgggaggttgaggctgcagtgagtgcagtgagctgtgattgtaccagccttggggacagagtgagaccctgtcaataaataaataaataaataaattaaatgtatgcataagagataaagattaaaactagaaaaatgaatagctgattattggtgtttatctcctttagatttctttctttctctttttttttttttttttgagatgggagtttcgctctcattgcccaggctggagtgcaacggcataatctcggctcactgcaaccttcacctcccgggttcaagcaattctcctgcctcaacctcccaagtagctgagattacaggcatgtgccattacgcctggctaatcttttgtatttagtagagacggggtttcaccatgttggccaggctggtagcgaactcctgacctcaggtgatctgcccgcctcggcctcccaaagtgctgggattataggcgtgagccaccgctcctggcctagacttatttcatgtaagtaaaacaagagtcctgtgttgtccattcatttattccacagattttgttttgagtatctgttatgtgctgggcattgaggcaatttcttttctccttatttccccttgttttcattgctcctgttctggaccgtcctgctgggatcctatttaatttgctagttaccacctgccctatacgcctctggatttctgctgggtgtggctgtggccctagtgcgatgtcagggaggtcttacttaatgcttctctcatgctctccagtggtgagttgtcagaagtggtacgttttgctttttcttctgagatgggagaagcgtgctgtatccacagattcctagctggcacagttgactgtttatttgcttagcacatggcctgacacatagcagacactcagtggctgaataaacatggtaactgtgacatgtactcactttctctctcctgtctctgatcctcaaagaggaccaaatatctgccaccctgcatcctcagacggctcgtaactttggcaaaaaggggccaccacagagggcctgctgcagccttcccagttccctgttgtttccacttttgctacctgaaatctaatgatttgagatccagtagtttgcgtcttgaagaatatttggaaattaaggaaaatacaggtgtccctaagaggaaaaatactatgacccatcatcacagtaatttccaacctggagctcccacatgctgggatctcataacaggcataatggtggccagagagcacttcttaatatttcaaaacacctaatggaaactgcccatttatttaagataaggctgcaaagagtaactaaaatggcaagtttctttgctttccagtgaaagagtatcgatttggtatggtagctctggttattttttattttattattattatttttgagacggagtcttggtctgtcacccaggcgggagtgcagtggcttgatcttggctcactgcaacctccgcctcccaggttcaagcgattctcctgcctcagcctcctgagtagctgggactacaggcgtgcgccaccacacttgactaatttttatattttcagtgcagacagggtttcaccatgttagccagactggtctcgaacttctggcctcgtgatccaccctcctcggcctcccaaagtgttgggataacaggcgtgagccaccgcacccggctagctctggttatcctttgctgaacagatgcttgagttgatagctgtctatctgtgataaacacaagaatggaaggagagaataatgatcaataacagcttatgtgattgacaagaccttgccaaaggcagtgtggatgtggtgggatgggaagggggtctctgggaggggagagacgggggcactgcatgctacttagttattcctggggtttgttggcagctgcactgaggacagagggctccagacaggggcagagcaggggcacagagagtggtgtgaggctctaaacgccagcttggtcggcccactttgtcattttgctgagggctggtggaggtgccggtgtggctgtgccaggggccccgcctgtcacctctccctgcaatccagaccccatcacagagcccatggcagcggagataaatgcttcggcaaggcaaacgaatctagagggaatgggagcctcaagccgtgaaaaatgatggggactgtggcctactttcttgctttgtaagagtcacttgcacttttctggggcacagccaaactgacggtgctgtagaacaggatgtgcgagaatgctgtttggcaaacaaagagcgctctctggcccccagaggttctggcttttgagcccagactaaagaaagccaggctggagaccgtatatcaaactttgcaagcccgtttatataccttgctggtgcctcagggggcagaaatgctggttggggatctttgtgttttgttttgaaagagtgatgtttggaagcagaagcactcaaaaatatatcctgacctctggcacttagaacctccaccagagcttggcacttaactgttctgtttctcgtgatatgttctaattatctgtttccagccagattgtaaggtcaacaatggtagtttatttacgagtaagtcttagttttctcatctgtaggaatggggataaaaatgcaggtttgctatgagtgttaggggttcagggtttagttttgggcctaactgctcctgtctacctgtctacccttccagggcctctcaggacacaccttactcccaaagcacaatatccaaatggcaaagaggttgtccctttcttaatgagctccacaagcacctgaccaccaccccctcccattcgaggcctccctgtcccctcccgctgaacctaaaccgctctgaggagcagctctccagccatcagtcctgcttggatgaggatgctgattttgtgtctagggaaacaagtctgccccgtttgccttccacatggaggctgagggtacaagagaaagttgggggaaatagcaagcaaagttcagagggcagtggtccattttttcttatcagccacaaaacaaaaaataaataaaagaaggaggaggccgtgtctttgaggcacagtaagcctgcccactgaatgtccctgagagtaactagttataatagctactccttctacagggagacctagagacggggcagagagaggaaaggacgtgcccccgtgaatagcagaggggtgaacagtaggcctgggggagaaattgccttcctgacaagaagagttggagatgatgaatacaaaacccctgggacactgcctggcccatagtgatgttaccatcagtagtggctttgccgtttccagattgacatccatgccctaaacagagaactttgctgagatgaaatttccttgttggtatacttttgtgaaccactccattgagaaccagcacaaagccattgccttcttgaacgtcttcattaaaactagaataatctctgcccctcatttgcccatgcacatggaaaacccacggatatgccttccctgatggaaaatatgaccactgactggagttcgagaccagcctgaccaatatggagaaaccccatctctactaaaaatacaaaattagccaggcgtggtggtgcatgcttgtaattccagctacttgggaggctgaggcaggagaatcacttgaacccaggaggcaggggctaccgtgagccgagccgagatcacgccattgcactctagtctgggcaacaagagtgaaattccatctcaaaaaaaaaaaaaaaaaagtgaccactgaaatgtgtataatgctttaaaattgacagtgcattttctcatccatcatttgagcctcacaacagccttgtgacgtaggcagtattcgtattctcacttcaaagataaggaagcggatgctggaatggcttgggcaccaggccaggttcatacagtaagtaaatggccaaggcagggtgtaatctttggactccacacccagcgctccttttttttttctgtcatctgtgatgcttcttccaccctgctattgatagcctaggaacaagatgtgtgacttttcttaccaccccctggtgggtacatcctgggtacacttttctgttttctagtgggggtaaggaaaatggctttcagtggtgaaggttcacagaaagaatgggatccagaagcgtcttccagcatggtccaggtgccagaagactttggcaggcgagttgaccatggctgagtcaggccctcctcccccgctccctggattttggatcgattttgcagcggctctggcggctgcatgtgtttcccttggcctctgaggcattccagtgatgatgatggctcggcggggtcacggccctgtacaaagcaagggctatttgtggctgatctaaaacataactggagccacctgcatccgaggctggcttctcgggctctgggtcccataacccagctggagtaaaaagttcacgttcccgtgtggagtagataccaaaagtgacgtctctttctttctttaggtttggctgcgtaattggaaaaccaagctgcccgccaccttgccgtggcttcttctatccctagggcctggagtgggcttcctccctcccctcctctatctaaaccctccttgctgcaagaccctgctcctttcacggagtctccattcccagaatgtatgtgacctcattgtttgtcatccatgttggggcttttaagaatatccccttgcaccattttatgactgcttcatggacaataatcctgactgtgttctttggggccagacactgggtctgctttccttcctctctcacagtgcctggctgtgctgggtacacatgaaggctgacggttcactgaatgaggcattgtggagggcgtagaaaacatggagacctgggaacccagagaccaggttttgttgccagggcaaatccctttgcctctctgggttgctcagtccatatctgtaaaatgagagttgaactggatgatctttaaggtccatttcaaattcaaagttctggaactaattgtagactaagccgaagagatgctcattgcctttacctgtctctctctgctccccatattgcagcctggtaagctgttgtggcttatcacccgcacctctgatttgcctgaatgtaacttaaaaacttgtcttcataatatcaggaaggtcacaaaagagaatgagggagtgttgagtagtgtttagaagcagagactggggaatcagacaaacttgggtttcagtcttagccctaccacttaatagttgtgtggccttgagcaagtcaccttgttaagtaccactttcttttcagaaacatggagttaatgccagtctcacaaggcaatggaggaatatgtgagataatacaggtatggcgcacacacagtgtcagagctcactcaatggtggcagtcatcgtcattgaagtggggaggggaaagaagcagaggggtgtgttttctagtcctttggtgagcattttctgacttgtaaactattggttgcattttaagacagtgcctttatcattttcataagcagtgtaatgatttgaggaaaaccattttagttctaataagaacactagcagtactaattgtgcacatgatagcattttaatagagttccataatttatggaattgggaagacttacaaaaacatgggttgactctctagagtcttaggtttctggtgagtgattcaaacaggctgctcttgcttcctgccagtgcaaataaatcaattgtaaacctgcacttttaaacaaaattgtgaaaaaggaaacaaatccagtgataagaaactattttaacaagacacttcattcttgaggtgatttgctaaggagagattttccagattgtccctgaactaccaaaagcaacagacacactgtggtacttgcttctctttttctagctgctctgggtttaagtaactgaagccttctcaagtattaaatttggagggtggctcagtgatctaagcaatgaagacccaagaaagactttgggtctgaatcaaagttttccaactgccttgctttgagtgcttggaaagtcacttcctaaccttggatacctcaatcttaccaactaaaagagtggtagatggcgggatgaacatcgcccagctttagacagtgaaacctggatgaacttaacctggcttaagatgatccctttctgtttaagtggaaaatgcatggtgagtgaacattacctttcaagcaacttctggacagagtccatatgtgtgtgtgtgtgtatgtgtgtgtattagcctgaagttcaagtacttgcaaaggtttctagcacacagtgtgcagtaggtgagctagacttagttagacttaggacttccagatctcccatgtcttgacaattgtgtttaactgagttttaacattgactctcagagtcagaaagaattccagaagataaaggaaaaccagaaagccaaactttaataaatactcagagagcaaaaagaaataatggaaatggcatacgtgcagagggcacgtagttagtgaagaaatagcttttgatgaaacaggacagggtgaaacttcaaagacttgtcttttatccattaatcccattagtgctccagcgatttctcaaagattgattatctctggggaaatgtgttacatcagccctcagctttccagtcccattagacccagcaaacattctgtgctgctgggatgatgggcttctgtgccatgtttacccatattcctccagcttggccccctcctcaccagctccagtcaggaacagagagaggcctctaccatcagtagtcattctttgggattatcactcacacccctttggaagggaagagaaacataaagataatgggcaagcagcatgtgctcaggttaactttacattggctgatcaattcttcatatagccttgggcgtttattaggactttcatggtggatagacacactgtccccattcaaagtgcctctaaattagaagtgagatacctaaggagtgtcagcaatgaggaacaatgggcttctcttgaagtcttgctctctgtctagtatggtgggcaaaggaatttatcggttactaattttataaataaccttctcacagtctctgttttgtcatatgtaaaatggcagcaatgtaatgtatccctcatagcgttgttaggaggactaaatgggttagtatttgttaaatgcttggcattgtgcctgcctcacaccatacaggcactcaataaaagttagctgaaattatgttaactagtctaagcagaggattagtaggcacgttggaactgatgctaagaaggaataagactcaccttgggaaaagtggggatcagggagaagactaggcagcaggcttctgagtgtgggagtgtgcaggatgtgagcacatctctgcagtgcctgcgccctccttgccacagaaataacctacaccagacgtagtaacagaaaaagaacccaagcattttcaagacaatgtgagcaaggtagaaaagggcgacccatgagtcaacaatactcaagcttttatcagtctcagtttcttcattctttgtttcattcattcaacccacgtttatcatcaaacctgtgctgttgattgatgttatagataaaaatgaaccactccctactctcaagaaagcagaagaaggaagcaggtaagtaactagacaattatataacaagttcctgagtgatcaggaggaatgaagtgccctgggaaggcttctgggaggagttgattcctaagattagatgagtgagagttatctagtgaggggaaaggcatggatgacagagcattgtgtgtgacaaatccttgtctgctaattctcacatttaactcatctcagagtcagtctccattgattgcctattaagtatgggccatatttttatgtctagtaattttggattatattctagacattgttgatggtctagtgtagagactatggattctattatgtttctctggagagtgttgactttttattttagcaggcatttaatttgactgaactcaaacaccaaactatctcctccatggggggcagaagctgaaatctctgatcagttctattaattttagatgggttgcttggaatctgccccatgcatgtatagctcaggagtcagccacagatttggatggagtttatatgcagaatttggagcatcccttctgaggctttctccttttggggatttctgcttccattttccagctgccccaaccatttgctccttccattttccagctgcccttctgatcctgcagatttctatctagtttctaatcactctatatactacagattgggttctgctctcaagcaaaaaactgtgaaacccagaaactcatccaatgctcccttctcccaggttctgcctgctttgagttgctctctagtgcatgcaaataggtatttttaattttttgctaagtaatagttatgttcagatgataggtccaatatacactactctgagatattggaagcaaaactcccacaatggatatttcaagaactgcaagtaggtcagtttgtgtgtgggggggagtgtttgtgtacatgtgtgcatgcgtgtgttacaggggcatggaaatatgcacagcttaaagaaaggcagaggtcagatcatcaaaagccttctgggttatattaaggaatttgaactagatcctgaaggctgtgatggagagctttaatcttaagagtaaaatgatcacaactgttcttagaaacattgctgggcatctgtatgaaggatgaatcaaaagaggtagaaagataggggattgatggggaaacagaattcagtttttgtcctctggaagatgaggggttgaactagatgatcattaatgtctcttatggctctagtattccgatcttcccattaatgactttacttggtcctactgtagccaggagttcccacaaggctgttttttgcagagcactatacacagcccttgaagcccaggctttaaaaaatgccatttagtgatattttatggcttgtgaatagattaaggtaatggaggcacaaaacaacacaaatgaatgcaccacgggtgggtaacagcctttgaatttctccagctctcccttcagacctcctgtatcacaacaggtatttggtcattttatgtgatcttaaatggcctactattaacctgactttgattttttttcagtcctcagagaggtggaggtgggcctagcaagaacccaatgctagggattcattgcaaagtgtacccaaattgggaagggtgagaagctattctatgatggtcttatgagaacctcaggagatgctggtggtggtgtgatgggcatgttggtttcatcctttcctgtttctgaaccaataggaaaatgaggcttcctgagcctcaggatgccctaccctttctaaggcttcctggagagcaaagagttcctgctctgccctggtgtgagtcagagactgtgatgacacactgaacagcaacacctgtccttgctggggaggggatccaaagtccagccgctcgccttcagcatgacacatttttctgtgctttgcctcgttaagagctcaggtcctttagtgcttgaaagtagctgagtgcaccacctctgtaaatcgatcccgcactcagttcgtgaaacatcaggttttaggaattggagaggcagcaatataatttttgtgtgctgttgcttgagtgaactgtaaaccaaggctttctacccaggattgcacggctttttactttgatgaatgtcattttactcagagctgactaaatgatattgtcttatatggctctcaaatttttctctgatctgttcccaatctgaaacgtgtgagtacatcacttcagatatttgctaggcatctgagcttggcctgaggatattcaccagcatgattgagaaaacatgcttgtcctcaggaaggcccaagtctaagcacctgctcatgccccttccttggctgtgtggcttttctacgctgcaaaccaagcttgtagacatggtgtacctttccataacaggtctctctcttctgtcatgttgtggtcactgaattggatttggcagaaataccagaaagtggaacatgtggtcgcagcatgtgaccttcaagtcaggtcacggctggcatttgccagcctctgtttgttggttctggtggaatcaggcctatgtgtggactctgctcctactatttgagggcattgtgaggccttttctgagtgtgtctcctgcctccttgactccgggcctgaagtttctgccattgatgtaactcatatgtgttacagcattgcctccagaattctcctatttgtgaaggcctattctgttagaacaggttgattgaggagcacattacctacttctggtgctccatctggggactgtggacagcagaagagtggggtgaggtgagcttgaggggttgagggagagtgacacagaagagcagggctggctcccctgaaacaggaggctcccctgtcagttgtggcaggctctctgcctggttttttccactcctttatccccagcacttaacctcatgtttggctcatagtagatgcttaggagatgaaagcctcatgtccaaccatggccaacagttaaatctgtgaatctcaggcttgatttcagcttggccaggtctgagtcattaaaggacgctttgcatttttggatagtggaacttttgccatcttattctttttccatggtgtcatggctttggcatgatcagggttatgaaaaaagggggataagccctctactctgctttacctgccgtgactgagatcagacactggtttttagagggaaatgtccattttagagcaagagagagaagaccttaagcatgacctaaagaaaagagagaggccaggctgtcccaccacttcatgcttggttgactgagccaagtttgactgcaagactgggtcttggcccaggatggagaatattcactaatgaggcaattgacttcaagaagatcaaaataattagtcagttttcactgctatagtgagtcacccttgtgaagacattatgttccaactgaagagtgagggagttgaggtggaagtctcctggctcctgctccctggggagtgcagagtgtgtctagaagcctgggctggtaggccatggagtggggacctgagctgtttccttctgcctgtgctttttctctttcctctcccacgttcactgggaagcaaggaagttgaggacacgttacctcagtacgtaccacaatacgcattagaggtctgcttcctaggcccgtagattctagggagggcactccaggcctgcaggggccctgaggcaggggttggtgggcatgagaatgggacccacccctgctgcttgggagggtatgtgttgcccttggaggcagggagaagggctggtctgtccctgtgcttgggcactcccatctgcacagtgccctgtggcagggagagatggcctcagagcctgtggttcctttaccgtggatggcttttcacgtgtggggctggattgctgagaacatcttttacctggcggatccctgaataggtgaggtggactcgggtctggaaagttaatttacatcttttctgaaggccagggaagggcaggggcagcctgacctgtcagggcgatacagtctgtagctgtttggccagagtgagaggagtgtctgatggaacaggacttgccttggaactgagcaaactggccccgtagagattaagccttggacctttgttcgcctgagtcccccaccccagccagctcacagataggaggctggagaagggagtggggtggatcacacgccatccccacatgctctctgtgggcctgttctctccacgtgcgaggagggatgagcattctgcagggagtccgtcaagatgagtccatggtggaaaagctcacagacggggaggtggggactccacagggttccgccatttcctgggaagggaaccttaggaatgtcacttaaactctttgagccttctttctcttctttcctccctcccttcttcgttttctccctctcttccttttccccacaaatattttctgagtgcccatcaggagttgtaaatgctggaaatgcagtgaagaatagcatagacaaggctggtgctatggcaggaagagagggaaaaatgaagcaaacagctaagtcagtcagactttcaaatacgggtaagtgctttcaagaaactaggataacaggtggagaggggcatgcgactatctcagatagcagaggagaggaaggcctccccgagggaattccacttgggctgtgaccctgtgataaagagccactcatgataggtctgggaggacggccactatgcacagaggcagcagcacatgccatggccctgaggagggaagaccagtatgcagatgaccacagggccctatgggaggacagagaccagtctctgaaccgagctgtgggagagcgtgaatgcagggttgttcctgctttggaccgtggacaataaataaactcctattgtgcctagaaaccgcctcagtgttggggtgtgtttgctgcagcagctagtgccaccctaacgactgcagtctaatcattgtgtgtggcagtacacacaggacctgaagcaaccaggagcttgagcgcagggaagtaaagctcattatcacctcagcaacaggggccctgggagaaccaaaggcctgctcctctctgccgctggctgtttctgctagtctgagccagaggctctatcctgctgtaatgtcagtttaaaaggcagcctttccagactcttgtcacatcaccaggagctcttggtcctctaattaagtagtaatgtgcttgtccaataagtgccatatggttgcaatgaatcaaacccaaattatcttagctctaaaaattaatattactaattatgataatctcacaattttatgtctgcttttcttctgaagagctcaaaatgcaagtattaaaataatatgtccaaatatcctacattaggaagaaaggaggacccacggagaagttgggaagatggcatccaacgttaagataaggctcccgtctttctcttgtctttatctctgacttcataaagatagctagtctttcctggcaataagccagaatagtgataggattagggaaacgggattatcttaacgtcacagaaaggagatgaggcacaaataagggaatgaagctaattagatactgcaaaatgccaagattggagaaaactggaatagacttaccctgatggaccttgtctgtggagaacggatatagggtgggtccagggagactggccagccttggctggggcctcatgggaccagaagtggcagtggacagcagagttggtgaggagctgggagggggattcaccaggaaggactgagttctgaatggcagggacgtttgcagacaggagactggcgtctgtccaggagagagcagggcttactgtgagcgagggaagcagtgggatgagtgtgtccggcggtgtctcttacttaagagtgacaaaggaagagtgcaggagtttccgtgtttggccctaacccaggtccacttcactgccctgagagatgtagtgggatgatggaggggactgggggcagagtggatatttaagtctgaggggagaagttaggaaagggttgtgggtcacagaattagagagttaccaaggaaactgcagagaccattacttagtcagttctccatttccaggaaggtttgtcaccataggaaagaaattcattaaccttttattcaacgggtattaattggctatcatgtgcttttcttaccccacaagagcttatgatggaaggtgatcatacaatttatcatccaaattgggatacatttgagaaggaaaggcggcagattatgtgggaacaaagactggcccatgccagctgggacatgtggtcaccttacttatgatctatgagatgtataatcaccccatttgttgataccaggtgcagtgagatgcatgctctatgtgcagtgtgtgttttcaccctgtatccccatcttctgctgggagcgggactccctttctccccgcctgagcctgttctcctcagtagcaggatccagctcaagccctacccccacctgctccaccacaactgccccactgccaccaccactaggcttgctccttaacctttctgtgcctcagttccctgatcagtaaaacggggctaactatagtacctactactagaactgtgcctgactcaaagtaggcaccagatgtgtcctgctatgatgatggggagccctgtgatttggtaacttccccaatctctctgcacttttgtttcctcatgtgggaatcagggacaatattacctaccttttaagggcctggaatttaagaaaaattagcccccttcccccttagaatcagcagcagacatcaaagggcgagttttaatacttcccacacaagttcacagatttattacataatatgtttagttgtggttaaagaacatctaaggggcgaaggagctgcccaaggggaaggaggcagacgagagggacatgtgtggctttgcatggaaaagggaagtggtatcccagataaatggtggccagccttcgagggctctcaggcaagagagaaaactctagacatcaccagtgcctgggctttgttgcaggcagaggtgctttctctagaagggaaagcaagtccctatagtcataaaatgagcagctcttcagctgctagtacttgacctccaaccagaattgatggggtgctcagaactattctaggtactttgaatttttttaacctcattaagttcatctataagacaggtagtttttatattttaaaatgattttataacagaaaatttcaaatgtaatcaaagagacatagataatgagttcccgtgctccagcttcaacagttataaacagttgctgatttggttttatctatttccctcaagatttttttttcttttctgggatgtttggaagcaaattccagcaattatataatttcacctgtaagtacagtttacccttgaacaacatgggggttagagatgctgacccttggatggtcaaaaatctgcacataaattttgactcccgcaaagcctaactactaacaatctactgtttacctgaagcctgactgataacataaacagtcgatgaacacatattttgtatgttgtatgtattatttagtgtattcttacaataaagtaggctagagaaaagcaaatgtcattaagaaaatcctaaggaaggtaaaatatatttactattcattaagtggaagtgaaccattgtaaaggtcttcatcctccttgtcttcacattgagcagactgaggaagagaagtaggaagaggaggaggaggagggcggctaggtcttgccatctcgggtggcagaggcagaagaaaatccacatgtaagtgacccacgctgttcaaacctgtgttgttcaaggtcagctgtactttggcatgcatctctaacagacaagatttaaaaaaatatatatcaccaaatgcctctatcactccagacaacaataacagtaaaacgcaagagatccttaacatcatctaatattcagttcatatgtaaatttcccttattatgtcgaaatatctttgccggttggtttgaatcaggattctaataaagtctacacattacatttgcttgtaggtttgtaaatctctttttatctatgattgttccccctcccattttgcatgtcatttgtttgttgaagaaactaggtcagttgtcctgcagaatgtccctcattttgatttggttggctgcttccttattgtcccttaatttattccttcatcctccatgttttctgtgacctcggagttagattcaggttccgtttgttttgaagggagggtcaaggatgtgccagctgtggttatgccccttcctgttgtgacactgagatgggtgggtgggctccgggattggcagcctcatccttcatctattactgaggccccatcagcctttcccctgatggttttcacatccattgacgattgttgcccagatccattatttcattagggcttgaaatgctcattttctgattctgtcattccttttgcgttgagtagctggaattcttctataaagaagaacgctctctcatcaacagtttggttaccctgaaataccatgtggcagaaaaagcaggacaggtgctttctcatcacttaccggctttcaaagtaatgagttggtcccttgcaaaggaggataggtctttaattaattgattaaacaagtatttattgagttcctgctatatgctgggtatcgttctaacatcctgatggttcagcagtgaacaaaacagataaaaatccctgcattcttggaatttacattccaatgggggaagatggatagtgaacaaattggtgtgctatatatttagttcagggatgatacaggctatggaggaaagcaaagcaggacagggacatgaggatgctagaggggtgggatgctagaggatgctaggaatttgggtttgcaatcttgaatagggtaagcaggctcaggaggtgacatttaagcaaactcttgagaaggtgagaaattgctggagaggagcaggccaggcagaaggctggagtgcgtgaggtagggatgctggtgtggagcccgtgtggggaagatggtaggagacgggcctagagaggtggttgcaggggcagaccaggcagagtcttagaaaccattttcagggccttggttttcccctggatgagatgggcagccctggaggactgtaagcagaggtatagtctgactcacgtttttaaagggtcctgctggccgcttggggagaagatggagaagtcaagtaagggtagaactgagtttaggcttgaaagcagagagccttcagccctggtcaagcttccttccatgtcagctagggcctattgggggggttggagctggggggcagcaagtgcttcacctgttcctaggggttctctgtgcatgtggcattacaggaaatgcttccaactcaatcccgtcctttaaaattcctaggcatagcattctcgagcgcttcaggacataaaatcccggagcagaaaccttcctccccgagtctctaaacaatggctacatgtccatcaccccagagaactggaattccattttatactgaaagtgggatacacgaggacaatgctatcacttgacccatcttctttcatggttggtggtgagtcttttggaccgtctttaccatcactgaagaattggcattggctagcaaggcacattcagggggaacttctcatgattccagaactcagcatttgtggtgggatcggccatcagtctacggagggtgacccctccacccatggccaggtcggcttaatcaataggtgtctgatggcataaggtgcagagcaacagggcaccttttcctttccatccagattttcccagccagcttggagagcactttttacccaggctgccttcccaacacccagagagcccttctgtggatgagcatctctccttgcctgtaactctctcctatcaaaggctgctcgtgaatttctgggtgcttagcaaccaggagaggggacgatacaagccgcctctatccctgtcaggtagctgctcccgttgttcgtcttctcctctgggtttgtatatgcagtgaaagtagccagagagacactccacctcaacttaaacagcaacttcctaaataaataaaaaatacacagaatccagttcaagcagatcttgcctcaaagacagcttgaaagcatcccttctcattattccctgcctgatttccagtgtttctctccctttctttctttctctttcttttcttgtctttccctccctccctctctctttcttccttcctctcctctcccttccctttccttccttccctttccttccctccctccctccctccctccctcccttccttccttccttccttccttccttccttccttccttctctctctctttctttctttctttctttttctttcttctcgctctgttgcccaggctggagtgcagtggcacgatcttggctcactgcaacctgcgcctcctgggttcaagtgattctcctgcctctgcctcccaagtagctgggattataggcttctgccaccacaccagcctaatttttgcatttttagtagagatgggattttgccatgttggccaggcaggtcttgaactcctgacctcgggtgatccatccgcctctgcctcccaaagtgctggaattacaggcatgagccactgcccgtggctgatttccagtgtttctatgtaaccctctgagattcccacaagcctagcatgaagatgagacacaccaagggaggtgaggagctaggagaagggcaggcatctccaaattgcaagtttcttctcaaactgcagatctgcagagaaaaggaaggacacagtgaaggaagcagattctccaaggaagggatatcaggacttaggaatggactctttgcctcttattaaaaggaaagttgcttgctggggaagtagcagattatttcaaatgggtatccgtccttggtagccaccaatatccatcagtttaacaggagaggaaatagagttgtcatgccaggaggattttggaggagccagcggctggctatcgagaagggaagggagctagcacttgctgagtttcttcaaggggccatgcactaactgtaggaagcatggactttgctttttgcatgggatgaacctaactcagagttgatgctgcatgtaggattatgtttttccgacaatccagggatctgcagaaggcttgctacaggatctgagcaggagtctaagcagttgtcttgtggtatcaatgctcctgtgtctggagagctggtcgctaagacctggagtctgggccccttgtgggggtgtcacagaaggctgtgaacacctctctgctcctggaaaatgccttcctttcctggccccaggacagactctccgacttccttcatgaccgggttcccactcgggagcctttggaaccgcttgagtaccagattattaacaggacccgtgattgtgatttcttcccccgtacaaattcacagaccctgagaagaaaaggagaagataggctgggcacagtggctcttgcttttaatctcagcactttgggaggccgaggcgggcagatcacccgaggtcaggagttcaagaccagcctggccaacatgacaaaaccctgtctgtactaaaaatacaaaaattagctagttgaggtgacaggcgcttgcagtcccagttacccaggaggctaaggcaggagaatcgcttgaacccagaaggtaaaggttgcagtgagccgtgattgcaccactgcactgcagcctggttgacagagcaagactctgtctcaaaataaataaataaataaataatttaaaagaggagatagatgtgatggcggtcttttctgtacttagaacaacctaatagttatttaatggataaacaggcattaaaatgaatgtttgatgacttggaatccagtcttttataaaactctcagtgttctgtgattccaggcactcatggctgtggcaggcatcctgccaggtggagctgggagttcagcacagaagtaagtcggggaggaggtatgcattgccacagacttaggaagtgttccctggacctgctgatgataggttggtcttagccatgttcctgaacaagtaagttgtctaatgaaaggaaaacataccaacctgttagtggagttagcaccctagacccatagactctaaggttggaaggacttttgaagtcatctagccccttgccccactcgatgcgtgattaatacgcaccacagaaactccgggctctgaatactgaacattgacccagacccctattgcgttagaaaatattattgcaattagtggaatgctgctagaatattggctccagacctgagtctcaaagttggaagagatttagaaagaaggatgtccagaggaaggaacagacatgagtgaagttggaaaatggagactggcaaagagtagctcgaaaaagaacaaagtttcctaataatgaccacaaatgagtatttggctgttcaatggatatatgcttgctccacgctcattggatgctagcctgctctcaggaagagctcttgccttcctgcctccaaaccactgtacacaccgttgctagattgatctcccaagaatcagcttctaccatgctctttctctgcttcaaatgaaattttgatcatttctcttcatctgacaggtgaaaatcaaaattttctgagcttggtcctcaaggcccttccttctccactcatcctttggccaggcaggccctccaactgcctcctgagcagcctcactcaggtctttgctcatacttgctagaatggagagcacgtcttctcgttccctgtaaccccaacagtgtctgttgtaaggttgagcacacggtagatggatggatgaagccttcattctgagtaaacacgcatgcaagtataaacacatacctacacacagaaacaccacacactcttaagtgtagatgaagagaaagaaccctttctttcttccctggtgtctggcaaaggccaaaggggtggtggggaaagcattaggatacagaggctctggttcttgttcctccctggaactggcttctgctaggaagcccagcagggcctgagtgctggcaagcctggcatggagccctcctgctttggaggaagcgaaatgtcccagcaggatgagtcagtgggagaatggaaccagaaagtgagtcattttgggagcagaggctaaaggatcttctctgctcaaagatattttaggtcttggtaggttttccccacttctcttgtttagatataagtttggggcatgtgactacagtggctcagttcccagatgtaatgctgagagactgtccagtgcgctgcgttctagaacatttttgctgatagggaggccgtaaagtgaggggctggttttggagccaggcagattgggttctaatcacagcgtgtcccagaatcagctggggacctagagtgagttgtttaatctcttaaagtatagtttttatcattttcaaaatgagggttgttggaaatgtcaaatggttgttcagcaagtgtttgttgagtccctagtgtgtgtctggcacagagctgagtgcagagtatggggtgctgaatactgcagccacgcatcctgccctctggggacgggtgcagcttgggattgtgttatatttgtagcagttctgatgacaacaagaataaaataaaacacctggatttgtttcatgaacataaccctcaaatctgcactcccctattacgtgtttgggcaactgagttttggaacctacatatcagactcaaatgttttcttctggggggttacagtctggggaagacccctgtgtaaagcatgtagcatagtgcctgtggacaggagagcccagtccgtgacggcggtaacaatgatcattactacctctgttatttcctgtagccaactgacatctttgcacctctgtttcctcatccagaaaatgttcagctgaattgcagtcctttcacagaggcagttcctgagtctctagtcttggggctcatgcttgaagttatttagagaatctctaagatacaagtggagagacagctggaaggggcagcacccaggccttcagtgtggggacagagttaagatcaacatgatcacagcagactgacacggcgagctgaaacaaacaggaaaacatttgagcctgatgttaggttccaaaactcagttgctgaaaggcgtaataggggagcgcagatttgagggtcatgcccatgaaaacaaatccaggtgttttattttattcttgttgccatcagaactgctacaaatatgacacaattccatgctgcacccacagaatagtgagtagtgtgtaggccagggcaagaaaaagaagagcaataatattctagttattgtaggccaggggacccacatccacgatatcgtttttttacagctcattactgaatcctcacaataaccccatggggtagatattactgttattacccttttatagatgagaacactggagcttagcgagggtaagtaatggactgcaaggacactctgtctctggcccagaggaacagctggaggatgcaggcaagatgtgtgttaagggggtcctgcagagtgggggtaaactgattctggattactcattaatgtagaactccgaccagtgggtggagggtatgggttcaatagggagctcttcagaaatggaacatgttgagaggccaggagttctccatccctgaaagcattcaaggagaggttgggtggctgtgggaggtattggagaagggattttaacatcgggagggaactggggagattgtgtgtgagtttctgtctgcaaaaaaaaaaaaaaaaaaaaaaaatgacggtaccaaccttgaacccatgtaatcttcttcagtaatattcaagcaagaacagccaccataaaattgtgtgagcaaatcaggtaatactggtgaaagccaaacacaggctccccgttgtgtgagtgagaacatgacattgttacagtgatgggttcatgcaccctggggtgggtatgctgatggtttcttctgcttctgcttctacgaggcccctctcccaatgcctttcccaaatctctccttatggggtttttttccccctcctaaaccaccttaaatcgaaatccactcacatttgtagccatttcacagtctctttgcatattggtgagccctgtcgggggtcgctggtatcttatagtattgatgttacaaaatgtaaagttactttggggaaatgacttctcttctgaagcttttatagggagaaggtggtgagcttacccctacactctctcctttcctttgtctaattcctccacagaacatttgtccggtgctcactgtggactggaagtgtgctagggactgtgtactgcaaggtgactgggatgtgcgcctgagcatccctgagtccaaggtaggggaaagaggaagtggtccacgatgacactgtgatgacggccatcctgatgaaggcacaccccaccctgcagcggctcagggaaggggcgcgtgtgcagacatcttgcaggcagggtttagatggtgctgtcctcggaagagaggactttggaagaaggtggtcttggtttcggtccttagtccaccggatgccaggtaatccttaacctttctgagcctctgttcttcacctcttaaatggggatatcacttcccccagatgatcttttattttgtttttaaaaaattattatttttagtatttttaatagaaatggggtctcactatgttgaccaggcttgtctccgactcctggcctcaaacaatcctcccatctcggcctcccaaagtgctgagattataggcgtgagccaccatgcccagccccctgacgtgatttctatgaaaatgaaattaaatgagttaatttagggaagccacttaacataattcctggctcaaaaaaaaaaagaaaaaagaaagttttcttcccttcctgaccttgtaggagaacagagctccttcgcctgaggggcatgagtccctatgcagaggttccctaacacctgctcataggtctgtgtcccgctgatctggtaagcaccgggaatggtctcttaaacacaaagtttgggctgccttctctagagattctatttccacaagtgtgggaaggggctgcacgggaatcagaaatgtttccccagtgattctgatgcatagttcagtttgaagacgtgctaacaatatataccaacaaaagttgtctgcgtctttttctggggacagacccccccccggctttcatcagaatgtcacggtcccacacaaatgaagatgcatcctctcatggtatgtgctagcgggcacagagagtggggctggagaatgagggcttggtaggcgaaaggccccagggccagccctgctctgccctcgtctcttgccttcccgccaggtgggtcaggaaataggaacaggtggttagtcacggggctctccagcaggtagggcagtggctgaggaaatagcggtatctcatcagctctgtctctagaggttcttaagatacttagttgtcaccagcctgaaaagtcagcgtggaaaatgttccagcctggttcctgtaaacgtaaaatctgttatgaattatatccatccacgtggaagagggagacagagtgatctggtatgtgcaggagagggccagcctctgcctggtctgaaagcttttgcaattgttcctaattggcccagtctttttctgcaggaatctcctctcttttctccatcccatcccccactgcctgcagcttctgatttcttggcaaggcaagcaggcaccagagctggggctgcggttgttctgaaggattttcaggtgtgcgtgttgaaagccggcaggaagagaatgctggctctgtgtttagcagccgaagggacttgttatttaatgtgtcttctgaagccacgaggcctcggctttgtaacttgctttctttattcttataaatcttctaggatgctccatggactgtaggaggagctctgacttcccgaccatacccttgtgtttaccactacagggacagaggttcacagctgcttctggttgctgtagatgatctggttccctgataatttgagataagtttgtgttagtttggagtcttcggtgaatacgttagggtacatgtttcttcgtcgttcctggcagggctgatcatagaccacatcaacccaagaatgtgtttgcctctctgatgaggctacatctagaatatgaacttgtcgagtgcttaagtatctttctacatagtttattcattagcctgttcatttatctgttcaacaactatttcttgcttgtcaaccatgttctaggcatgtcatgggctctggaagcagagtgagaagcaaggctaagtcctgggctcacggaacttaggttctaatgaggaagacaggcaaacaaggcgccgtggagaggcaggcagagaaccttgctttccaaccctgctcagaggtgcagtctctttatatatcccacttccgctatccccaaacatgcccattagcactgacatctaaagggctcatggtgaattaaaatgtgaccccacctctgggtatttagtcatttagtattgaactggggttaaagtcctaaggaaaggcatgtggagctaatatttttggggggacaggccctactggcagccatggaatcttactccgcgtggctcattgctcctgggctttacaactcaacgcagctgtagttcattcaccatgctgtggccaagcagcaggagttcaaatgtccccactgccatctccaagttgtctctctcgggttcctatttccctggcttttgtcactcccacctcacctgtggcccacattcttctctatttgaatgtgtggcaggcaggcgagatagacaatggggaggagttgttctgcaggagagaaggggacagtccttcctccagcctggagcacttcctgcaccgctccccaccccgtctactctccatatcccaccacgccctcagggccttgccctaaccccggaagcccacctgtctcttggctgaaatcctatgggctgagttgggtccccccaaaactcatgtgttgaagccctgtctcctgtacttctagaatgtgactgcatttggagacagggtctttaaagaggtgattaagttagcatgagaccattagggtgggcctactccaatatgattggatttataaaaagaagaaacttggacacagacacacatggacacagacacacatagaaggaaaagcatgtgaagacatggggagaagaggggcaactgcaagccatggcgggaggcctcatgagacatccaccctgctggcaccttgatcttggacttccagccttcaggaagttcatttctgttgagtaagctgccctgtctgtggcactttgtcagggcagtcccagcactgcctcctgccctgtctgtgtggccctgggcagaagcggcctgggagtgtcactcacccttcctcctgcaccacgtgtctttgcccggtgggctccagccgcgcctgggcagcagtctagacttcctgcagtctctcaggcttctctgtggctgtcccgtgccgagcgcccaatgcacacttgtagcctgattgattggttttctcagccagggcacggatcgtttcctggccgctctctggctccttttccaggcacctcactcggttccctactctgaggtggctacggccagactcgcctcagcagctgcctccactacgggctgtggtttttggtgagcttctttcagtcctctcatctttatgggaaaactgcccagcccaggaccaattagcgtgggatggttgcaataaaggtctcccttcccgacatgtggccagcacagagccttccctggttccctcccggcatttagtcacagtccccagctgtgtggtcggtcctctcggctcatgttatgggtggccgggaaggcaggctgtcttgggatctaggcccaagtgactaggtccattgtgggtgaggcaaggtggccacctctgcatcctcctaggggtgtcctgaagcggctgcgggccatgggcaggtggccgctgagggggtaagggttcctttcagtgtgaaatgtgcctgtacccaagagaacttgccttcacttttttttattttaaagaaatgaagggagaaatagagactaaaaaccctgggggtcagggtctgtgagacaaactgagatgtgctggagacattgcttatggatttattgatccctgacttgttcataccatgtgcctggaattcagcacttacacgtttccatagcacaatggacatcagtttaatcataatgggatttcttaagtgattactatatgccaggtactatgctaagtcagttatcaacacgacctcctttaatcctttcgacaatccgatggggaagctctcattagccccacttgccagaagaggaaactgaggctcagagtaggttacatgactaaaagagcaggggctctgcattcaggtctgcctgacccagagtgtattatcttaaacatatgtgacacttcttgcttgccttcctggtgctgcaccatctgtttttccctgtgaggtcccctttccccacaaactggctgtgagcacacccgacccctttcctgtcctgctgcccccttgcctgtcctgctgcccccatccctcggtgctcagcttgttgccagcagagtcaaacacacagactcatggtaaaacgttatcttacatttgtgtaccttttcatgttttcagaaccttttccaggcagtatctaatttaatttttaccatcattctgtgagtgaatattttctgtcttatggttggggaaactgaggtcagagaggttaaatgattgcctggggtggcactgcctagcctctgtgtggtggagctaggacccagtcgaggctcggagttctaatccaccagtctaccctggtaggaacctctgtgcaaagccagcccccatagcagcctctctgtcttgggccaaagatacaaatcagcaacggccaggaaatgatttgcatgaggaactgaggtggggcggtgggcaggagagaggctgaggcagcaagggacagagtgggcacacagaaacttccctctggaggcctcagcctcttcccaaggctgagcatctgcgcagggcttagtttgttcattcctgggagctccaggtaagtctccctctcagagggaaaagctgattcttccaggcaagggtgaagagacccacctttctgagtcagtgaccgacaggccagagggctgaagatgtgggcactgcggtgagaaccggagtagccaaggaagcagggtggtccccacaggggcggcgattggtttgtggggtccctgcctgtcctccggagaaagattactaaggagcaaaagccgactttgctcggtgacccctcctggtgccacatccctcatgcctgcagcagaaggtggggggctccaggcccctgacaggtcatcctgatctcagagaagagtctgctgcccccaggacggggactgagctgagggcgaggaggatgccaggagaggcaccttggcccctgctgtggtattggccacaggttgggagctgcctttccccgaagccctagctttgcttctgtgagaagcagacacccagcagcataagcagcctgcctaggaggcttttcactaggaattaaaaacaccaaaaaggaacttcttatcagcaggtaccctaggggccacatggactggtaagtggtatcttccccatggtctcttaaggcctctgaagtcccagaccctcagatagttggcaactctgcctttccgcatatcaaacatctgaaaatgcatctacctcgcacatcaaatagaatatatttgctataacacaattgggaagaatggttgtattttttataatgttgagttttattaagaataaattattcattttagtcttgcaacataaactcttattctgatagataactatggatcgagatgcatttgactagttggcacaatgttaatttttgtagatgttgtgtgaaatatttattttgattttctagttttatattttggacccaatctagttttgtttctgattttcacattttttttcaggacagtgaaaaagcttataggatataagagttgaacctattgcacctaatggataaaatctcttctgtctctccccatccccagagagagagaaaaaataaaaataaaaagagaaagacactgtttcagcaaattgatattcggtttttaggcctatattatacttgggtctcaggtcctctaatctcctatttggtggtatccttataaaatacaagaagtgttctctgagaaatgtggaaaatttctgacgatcccagatgatactaaatcagttgccccaaatcctttagaagaaggaagaataaggccaggcacggtgtctcacgcctgtaatcccagccctttgggaggccgaggcaggcggatcacgaggtcaggagatcaagaccatcctggctaatatggtgaaaccccgtctctactaaaaatacaaaaaaattagccggccgtggtggcgggtgcctgtagtcccagctacttgggaggctgaggcaggagaatggtgtgaacccaggaggcggagcttgcagtgagctgagatcacaccactacactccagcctgcgcgacagaacgagactccgtctcaaaaaaaaaaaaaaaaaaaaaaaaaagacacattcccaacgtgaagcatcaaacagctcagcttttctaagtgttgggagaagtggagaacactggttctcctgggatggtgcctgggttagcaccattgtgtggatctggtgtaacctgatacaggatttctccccttgcccagtaagagagccttgtgctagatggatgcagcgaggacagaggtcccttgctggctgtgtgtgcaaatattgagcaccaaatggctaccagaggaatggggaagaactgactcgggataagagtgggatgcgtacaaggagagaaggctggagaaaaccttgcacgctgcgggagcaggctccccaggacgtgtcagaagggcccagtccatggaaacagggagacttgccatatgggccatcgtggctgcctgtgtggggactgaagctgggcgctggctgctgcgcgagatgagggggccaggtccagcttccaaagggcagcttccaggcagagggctgctaactggctggaaaactatcagcgtgtggagtggaaacctgtaggggcagggaaaccaaggaacatttggccatcttccgccattgtgatttacctgccataagagaagctaaagtaaaacagcatgaagttgtggccagccccattaaaataacgtgctcattaagggctcttacaactagtgatatttaaagaagaaagaaaaaaactcacaaaagtacttgaggcaattatctacagcaaaagaagatgcagatcccttgagatcactgacgcaagagaacaaaggaggtcccaaaagaggctgcctgtgatccaggtgagagccgaaaccttcaaggctgggtaccagtgcttcttacacctgagtgaagcatcttgggacatgccttgtggttcaacgttaaaggaatagcacagccaaccagaacctgctctttgttaatggaatggaatcctctttctgcactaaaaatgagatgatgtgaaatcctttaaaatttattggaaggagggagggctttttgtgcatgatgcgttaccaggaaatgacactgtctctctccttattgcctaattagcaatgttgtacttctgtgtgaaatggcgtgtttaaacattgccaatcgatttaaacaaaagatttcaaaatactgtaggatggagcacagtgaaaaattccttgccagccagcgttctcccaggtaaggtttttgtcattcaaggtgtggctgcacagcagggaaggctttgctcatccccgccccgcagtgccccattccctccatcagccgtttatctagcattgggtctggttttctgttttttgttgtttgtttgttttaattttttcagggtatcgtagacgtgttgggttccactaggccctgccagccattcacttatttattcattacgcactcaatgaagacataagctgtgcattctaggtgcaaaggacgtagaaatgagtataatacagttcctttcctcaaggaggtcaatccagtgggaaaacaggtgtgtttgtggaaaatggaaatacagccggcaggcgaggaggctgtagagagaggagcacagtgctctgagtagcctgtctgctgtagcaagtcacccccagcagctggtggcttcacagagtaaaggttagtttcttgttcacatcacagcccagcttggattggtggggtggcaagaagggttattcagggtctcagaatacttctgccgacaggctgtgccatcctctcaggccttggaacccgcccccttttaaacccctgagtctggctgacagataagggcccaagtcgcacccatgttttagggtctaggcctagaaagggtgccagtcatttcctgcaagtcccattggctgggactcagcctgtggccctgccttgtccagggatactgggaagtgtggtccagtgccgtgcccaggaggaagagcaggtgtggtgcacgtcagccatgtccccactccacggagcagcccgttcaccctggggcgtcaggagaggctctgtcagaggggattttgccagggagatgtggggtgtggggtgctggatgtggggtccaggagagcaggggcatgagaagagcagcaacccaagcaaggaagaggaaaaggcctggatgtgtcttcagatagagacagactgaagcgccggcccacactcaccagcagcgtggctctgggcttggtccttaggtgtcccaggtgtctgtctccgcacatcttcccaggccttctccagcgtaccggcatcacctggggactggccctctgcagtcacgctggctccaggctcaccgggagtcacgttctctggctgtgactttccttttgctgtggattaacccagacatgggcctgatgctttttctttaatgtatacacacacatacactcacacatacacacatggacacattcactcacatgcactcacatgtactcaagcatacacacatgcactcacacacatgcgctcaggcacacatgcactcacaggcacacatgtaaacaggcacacacacgcacatgtactcatacaggcacacacgtacacccaggcacatgcacacatggtctcatacaggcacacacgtacacacaggcacacacatgcactcacacacaggcacacctccacaggcacatacatgcacatgatctcacgtacacaggcacacgtatgcacacacacatacacaggcacacacatgcactcacacatgtactcgcatacacaggcgcacacgtacacacaggcacacacatgcacacatggtctcacacaggcacacacctacacatggacactcatacacgcacacatgtactcacaggcacacgtgtacacgcacgcacacatgtattcacacacatacgttcacacatatacacgcactcacacatacaggcacacacatacacactcaggcacagacacacacacacacatgcacgcacatgggcgcgcacacacacaccccctccctccctctcacggtttttggttcagcctgcactcaagtttttgggaagatggagctgacatcacagtaatgtgaatgttgaatatctgaaacttctgtgctgagaaatcccctcaggcctttttgccaggttggctgctgtgtcttcctatatttcttgccctttccacctctcccactttgctgctcccaaacaactcttaacacccaccgccccctgtttttgttatacagagcagttcagccctctccagtccccacccctgagctcagctccaagccttcttctgcgcgtggattcccgtgcctgcggactcacagcaggccgggccggctcacgtgggatggaccctgtctccttccacagggagaggggcagtaaagacgtccatttcccatgctttgaaggatgtcactgtctcagaaggcagaagctaattgtgtcggttttaagtactttttccttttatgtttaatttcattaaagttaattttcccttatgtgaaatgtgaatgctgccatcacaactggaaagttgtcgtgagaattaaagatgataatgtatgaaagtgtgtaacacggtacctggcactccccccactctccccctcctccacacggtacctggcactccccccactctccccctcctccacagagccctggaagacttggcggtgctgtgatacgtgtagtgtgtgatggggagcggtgagggacagctggagagggtgcgctgagccagagtttcatgctgtgtgtttttccgaggaggtgggcctttgtcctctgcattcagagtcagaagagagttcatcaggtacaaatgggaagagaaccttttaaacagctgtctgtttgagcagatttccccacctcggattcaagatgtcattccatgtaggtttgcatttgcagggtacacccaggagaagctgttagttgctgtgattccacacctggagtgaggggagaacatcatggtttcctgccaggtgtgctggggcttactggccctgccaggaacatctggttgaaacttgtcacgtcaaggccgggtgcagaggcccatgcctgaaattccagcactttgggaggctgaggcgggtggatcacttgaacccaggagtttgagatcagcctgggaaacatggcgaaaccctgtctctacaaaaagtacaaaaattagccagacctggtggcacatacctgtcatcccagctacttgggaggctgaggtgagaggatggcttgagcccaggaggcagaggtggcagtgagctgagattgcaccattgaactccagcctgggcaatcgagctagaccctgtctcaaaaaaaaacaaaaaacaaaaaacttgtaaaggttccatgcactccttccctgtagaggctggtgttgagagctcgccacctttccttctgtttagaggtaggaagagaactcaggcaagcgatgagcaagccgtctgaattgagcaagggccttgggttggaacccttctctcccctgctttcctggtatcacagtgctagactgggcctctgcagcccacccagccgaggaggcccttctcctacagcagccttgacaggtctgtctggcctctgccctgacacctccagggctggccatctatgtggggaagattatgattggaaggaaggtttttcttagagctgccagtctttattttctacctgctgctcttcattttgtcctcagaggaggaacgtgtcctctcttccctaggacgtctgtcttggtattgaagacagtgcttctgtgcttcttacttatcttccttgaggttagccatccttgtctctgcaccctctccctcagtcctggccactcccatgtgaacctcagtgtttattcctgacccaggatacctcagctccaactggaccccaggcagtaagaggcttcctcttagagtcagcggattcccactgatgcagcccaagattacctgccccgtcctcctcctcctgctcctcctctggctcctcccactctccctcctcctcctagtgcttctcctcctgttcctctcctcttcttcccctcctgctcccccctgtgttcctcctcctccttctactccttttgttcctcctccactgcctcctcctcctcctcctcctcctcctgctcctatccctcctcctcctacacctcctctgcctcctcccgttcctcctcctctgtgctcttcctccctctcctcctcctccctgctcttccccttccccttcctgctccccctcctcttcctgattgtcccctcttccccctcctctgagcagccatattacatagcttactcacgttgaccttgtgctgctggtgagctttgtttctccctttctgttcatgtactgttctttctcttggatattttctgccaaatgtttttcattgatgactttgctcttgggtctccttgcctatcttccttccttcccccttcctgctctgtgacattcttgtttacataccctctccactgtgagcctggtatttcagtgactggagaagttttgggccttatctgagctgctttccttgttatcacttatgttccagcagctcgatccatcttcccatgcaggaacgtttctccccaaagtcctgaccctgccgtggagcacctgaggggaggagtcactgggtttctggcctcagaggagcacagtgttccccaggacttaccctgcatccgtattggaatatctgaaaatttcatcactgttgaaaataggaatgttttctgatctaaggtcttctgaggacattggggacactttattcccaagagcaaacactgactaggatgtctttttggctatgatgggatctggtagaaagtttcaagctactaaaatagggaatgtattctaatgttgtcttgaaaatgaatcaaatacacttccctgaatgaaagaagagatgtgtgtgtgtgtgtatttaaatcaccgatagcagcagtgatgatggtgacagtcacccatgccgtgcctggcaccttgctaagtgcctgcacacattgtcagttggtccaggcggtaagtcatgaggagtgggttttagtgtcccaaagcctcagggaggttaaggcatgtcctgatcacagctggaggacctcaccacgcccctccctgtggaaggagggattcttccgcaggaaatggagttttcccacagaacacaggacaggcagggaggaactcactggggctcatggctgtgctactgctactaccactgggcaaatctctgggcctcagtttctcctgtagtaaagtggcaggattgaattggatgcacttaagtaggtttccagctctaaagatctatgatttgttgtttcccttatttcagtgacaagttcctttggaaaacattgctgtcacaagaaaaaatgccatcatcaaaatgtcttctgatgttggacaaactgaatgggggttaggaaaccacttctgtaggaagcaggggtagggatgaaggcaaggaggacagatggatgagcatcctaaacagaatagggaaataattttagaactgatttttcagggagtcgcaagattatattactctagctctcgctctgcacctggaattcgacagtgcttaggatagggaatgtcgaaaccgggaaggggcttcccctcagccccaaactcagaattcgtatgtcagatctggaaagggaccacagtgaccacttagtccactccttcattttatgtcagcatccctggagatcccagcctttgggagaaaaagactcctgaggccacgtggtccgagctcctggagcatcgctggcagaggagtgttcagatcagatggtccccagcctgtgcaccaagtgtaccatccctgctaagtagatcttagtggagcagggcttacttcagggatgtggagcttattgggatccttcagcctctcttccaataacttctgctttagagattatgatgtaactgatgagaactgtcttgagacttccttttgtacttaaagtggatggggcaggctggtttagggcagtgtacctggggcaaggagtctggggtccttctgttggtttaggaagctcctcttgtctgtctggcctggatacttgtgatttgccagcttagtctaacagttaaccacctcttagtgggaagtaatgaatccaggattctctgctacgctcaggtgataaattgtgataaagtcaagtcagaatttcccagcttaggtgttgtgaaagcccaaatgaggcctgataagatattttgagtttttcacacagaagtaatttatagatgattcccaacttttgaactgctcttttatttattattaagttggtgtttcaaacttagaaaactgcaaatggcatttagttttccaggctggcctgtttagtgcataacacagctgacacactatatggttgccataaatcataatggaaagtagtatttttgcaaatggataatgtagaattgcagttgcagactccctgaaggccttcagtggttccagccagcacatgaacacatttacactgaagcgtaaaagacggttgctttatgcatctttactctgctgtgagggccatgaggagcaagaggtcactgggtgtctgcaggcagtcccagggaagcagcgaccagagcagcagggtttagccttcttatggtcatgggtgtgtgcagccacacgacctcctgaaaaactgctcctgggctcttcagaactgccccagaccaagggtccagagttgttaggagccaggggggctggggaaagcgaagcctctagggcttctcagattttgaggaggacagaacctgttagccacctgccttttgctcagaaaaggtgggctggagctgcccagcaaagtaaatgcaatgcctacctccagagcctggctttccacgaggtacaggctggccctgaacacctgcctccttccaggtgctgtgctgtgcttttgagatcaggagtggaagctggcagaaccaagagaatgcaacacactggcctccaccttggcccagaacatacccaccacgccctcgggaagtttaaatcccatcactctctctgctgcttttccctgttacagtgtgtaaactgagattccacacttggaaatgcatgtgttcctctctgggaagacctccttgctgcccccatccccctgcatcttgtgtccactggatcctctcattgactgttgacaatgctcagtttaatgccaggcagcgtacattcagactgtaccccaggaaatctgacacaaactgtgtttcccattgattttaaaaattaagactcagtgatataatgtcacttattattatgtaataaagccctattatggctagtaatttttcagtgactagctgaattttacttattagtgttcatttaagtcagcctgtaatatgttcagtgcaagtactaaaactgcctttcttcaaaaatcagaaatttgacattttttaatcagtcaggacttccttcctttcccctcctccaaaaacatccagagaagtgagattttctcacatttaagtcaatgattgaatagaaccaaattgggggaagattaatttttgaaccagtaacaccaaactgaaattaattttactaatttcaaaatctgacagttttgaggaccctttaatagaaccagagcttctgaaaataagcacctactgatgggttcagtgcagaaatgaacccaggtctagaactgcagtgttaagagatgatttccaaacgaagctgtggtttcatttggaacgctttcttgatttacatgttctgggttttgtaagtttaattcaaatttattttctcctaaatgcatttttactaccggaaggcccccgtatggaaatcaccttctctcattatgcagcttgcctggcccagagggtgagcgggccttggaatgaggacacccgccctggctgggagtcgaggccgagtttgcatccaaagctgtagcacagtgcggcccacagcaaagggcatcctcaggaagcaaggtgcttgtgtttgtgccttcgtcctttaagacaatacccagatctggcagcatcttctgcagcaagcaggagctgattacctggagctctgcctgcctctctccccgcctctgcctccccccggagaggcggcttctgaggaggctgctgttggcggccaggagaattccttgtctctgtggaaccggaggcctcccctctgcggctatttaaatgtgttcctccggcatgaggatgactcaccgtttaacaattaattacagctccgcatattgtaggcactgcacctatatgggggtgtaatctccgtgcggcaccatgttgatgagctgcttctccacatcaccaaattgtgaggacttcgattttaaaaaacagaaattgaaccaggcttggaggaaaaggcaaatttatacaatgcctttgatatgaattctttttattttcttctctgtggcttgcagtttccaccagggtaaagcaggcagaggtgggaggtggggagggagagacagggggttctggctaggaagggaacgggcaaggaaactgcccactacgtgctgtcacctggtggctgctgtggccggccctcattcccaccacatcagagagaggcataataatcttaggtgattttttttaagttttcaaggtgaggatgcattttactatatgctaatttttcttaatcatatgttatggtttattatcgacagatcttttaagaacttttcctgcagtaaatatttcaaactttataaattaagtattggctgcataaagtcctgttgcctgagatttgttgcaagtttgtcctttttgagatacatcgagtggctccaagtcatttgatcatgatcgtgtccatgatatcttgatagacttttaagcgtgaatccccctgatctctgtcttgctgccttccccacaccatcccctcaactcccctcccagccacgaattatacttcctcactacccaatttcttttggtaccaggagagggccactcttgttctggcctcagggacgttgcacttgctacagctgactcttgaacagtacgggtttgaactgtgtgggtcacttacacgtggatttccttccatctctgccacccctgagatggcaagaccaacccctccccttcctcctcctcagtctactcaatgtgaagacgatgagggtgaaaacctttatgatggtccacttctacttaatgaatagtaaatatattttttctgccttaggattttcttaatatattcttttctctagcttactctactgtaagaatataacataaaatatatataacatatataatatgtgttcatcgactatcctgttggtgagccttctggtcaatagtaggctatgagtagttaagtctctggggagtaagaagttaccttggattttcaactgtaagggagtcagcgcccccagtccccacattgtttaggggcaaactgcattccatcttcttggactgctcttcccacaggtgttgcccccctcccttttcctctgtcaggtcccagagcatgggttaccaccacagagaggcctctgtggatgcctatgtaaagtggcaccatttacttcagccgagaggtgaaggctgccgtgaggcaggaccatatcactgcactcagtctgggcaacagagtgaggccctggctcaaaaataataccaataataaaaaaaagtgctaccatcctcccagctcctcactcccaggaatcactcaggagcccatggttctgtcttattttgttcatcgcacaattactatctgaaatgatctcatttatttacttattttttgtctgcctcccaccagaatgttctctgttctctgccgtatccttagcactgagcagtgcctgcacatggtgagcactcgacaaaaatttattataaggatgaatgaatggatggaccctcgattctgttattattatgttttaatccagacaacactcaggagtttcactgtatcagtatatccattaggaaggttagtaatgtgtaaaaactctcctgtgaatgctttcattcagtactcagtctgtaaggggtaaatccttcagcagactcttgaggagtgtttaccaagtgtcaggcactattctagagcagtggctctaacctagggatgattttgccttccaggggcagctgtcaatgtctaggaacatttttggttgtcagggtgggtggtaggttgctactggcatctagcggatagaggccagggaagccgctaaacatcctgccatgcacaggacagccccacaacaaagaatcatctggcacaaaatgtcaatagtgtcaatagtgtgaggttgagaaaccttgttctggagtctgaggatacggtggtgacagggcaaggctcctactcccatgaagcttatattctgttgcaggaaccgggatagatacacaataaacaaatgagattattctgggaatgacaagggctgacaaagaaagcaaatagaatgttgcgatggtagctgtgggagttacttagatcgacggattggggaaagctttctgagaggtggcatatgagctgggacccctccagatgagctggaggcaaccctggagatctggcagaccctaccaggaggagtcagacagcaagtgctaatggggaaggggaaaactttccaaaggttctgaggtttaggttggtttcaaagagggccattcactctggggcttgaatgtgcttttatccaatgaaggtagcctagacatctgtttgaaaaaccattagattagtattcttttttgcaatatctcgttttttggaaagagctaagcttcctaaaaaacgtatttttctagacttcagagttccttaagagtggtggtttatctttctgaggttggctgccatgttgattcctcctcccctttcccagaattgggagtcttacagctttgtctctccactcagtgctcagagaatcacacacacagtcccaggataggacattccaaaaaataaagaagggcacagagaaggtgggggaccttccccgcaacttagccgcagttggagattcaataattgagcctgaaagatcactttaatttcctcaataatagtttggtgttcttatgtgttaggttataaagccctaaaacgcagtataattcaataccattgtgctacaaacccactaacacttttttcttcactgcccagcctggctcctcctcttaggagtcgcatgtccatacagagtcccagagaaattctacatctttctctgtgttctcccagactgaacagaagactggaaatgtcttcccttaggtctttgctgccaatctgggaaatgtcaaaggaattagcttttctttctatacttctagcatgtatttatcctcgctataaatgtcactttttttactgcttgtgtgtcagtcaggttgcttttggctgcaagtgtcctcatgaccctaacaacaagttactgtgtcacatatcaagttctgggagagggaattccagggggaacaggaaagcgtgtcttccttgagtgaggaaccctctccaagaaccctccagcagactccgccatgcttcattggccaggggctggccagatatctctttagcagggaagatgggattggcttgggtgaattgtgatgtgcctccattgcttggggagaggtgacatccaaacaaaatctgggcactcccagcaagggagaaggagggagtgcttctgggtaggcaacgattccaactttatcatttgtcttcctggcaaggactcagaagatactgaccatttatatttttctggttcttcatcacatgcaagaatgtcttttgttataatgattagagaaatgataatgatcgtgggcctttgtttccccttgcctgagctgggccttcacaatgcacaggcattgcttttgataaattggattgacttagaggattttagacttggaaagccttaaagaacagccagttcagtctttgtctttccacacagggacactgagcccaggctgccatgtggcctgcccaggacctcaccgcttgttcagctgaggcccgcacgctttgggtgcacaggctcttactttgtgtctttttcctaatttcatgaagcctggtccccgtttgcctccagctaatcaatgctattgtacacgtttaggtctttatctcagttgaaacctgcaccagaactggagaactaagtagtagtcatatatagctcagcatgaatattagatatttcttattttaagtcttctcttgaatcatttaaagacatttcaatcacttattaacaggtatggaagttgttttgggggatgaggaccttcagtcctcttcttggtccttcagaaccacatcatctgggtggtgcctcttctgccccttcctcctcgaaggcagctctgccaccactaacagccacagaggagaagaggaaggggacttgcttcacgtgggaaggagtgtctcacctgaagcatccttggacgcttatttaatttaaaaatgtttcatgagcaacttctgagctctgttgtcctcttccccatgagcggagggtggaatgaggcttgaggataaaggaccctgggccttgagaatgcttcaagccccggagatgaagttgtctgtctgacagaggtccccaagtctgcatccaaggagaggacctctcttctctatgaagagatgctttgcttctggaaacccaagtacaatcctagaaacctaggagctggccatttgtacaccgaaagttttctttttttctgtgtgaatggaatccccatcaggatcctattaaagttctctggggaatttagaaaggtcttgatttccatgctgggggtgtagccatgcataccctgtctatagtgaaacgtacatagtattttccatgaagggaagtgcctgcaaactattcaaagtatcaggccacaggagcgaccagccaggactgagaaggtggtgtaggatgggatgtccgcctgcgatccatctccatgctgtcctgtcctcatgtccccataggaacagttatggacattggacttttccttcttacagtccccctcagttgtggtgctgttggcatttttgcagggactgttcgttgttaggggctgtctcacccactgaagggtagaccttggttaaggttaaggatccttgaaggtttaggatccttggcttttacctgcattcaattacccacccaggtattgcagcaaccagaagtcccgcaccagcttctcgccatctcccgtggagcagactgctctgggcctctgttacaggacggattaggagtcaggattctggaggtggctgcagtcctatggccaagccggtacctgtacctccagggatccgcattcttaggagggttttctgaatgtagggaaagagagcaccaggggacactgctccttcagggtcacccaccagcccctcatggcttcactcagccaagaagcacattgtatctccttggggccctctggcatctcctctgccttcatacttggtcctgggttgcatgcatttgggatatgttttcacaccagagagcttgctagacagagcccaaggggatggaactgagtgaagtgacctataggcctacttctggccaaatctcagggcccaggtccccggcacaggtctttgctgcgtgtgatttctgccccttcatgggggaccaggaggctctgcagtcttttggacattaaatgatgcttgcaaaacaacaatgtgatgagttaggaatgaatcagaagcagacgagggacatttaaaacctcttagattacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtttcttggctgcataaatgtcttcttttgagaagtgtctgttcatgtccttcgcccactttttgatggggttgtttgtttttttcttgtaaatttgtttgagttcattgtagattctggatattagccctagttcaaccattgtggaagtcagtgtggcgattcctcagggatctagacctagaaataccatttgacccagccatcccattactggatatatacccaaatgactataaatcatgttgctataaagacacatgcacacgtatgtttattgcagcattattcacaatagcaaagacttggaaccaacccaaatgtccaacaatgatagactggattaagaaaatgtggcacatatacatcatggaatactatgcagccataaaaaatgatgagttcgtgtcctttgtagggacatggatgaaattggaaatcatcattctcagtaaactatcacaagaacaaaaaactaaacactgcatattctcactcataggtgggaattgaacagtgagatcacatggacacaggaaggggaatatcacactctggggactgtggtggggttgggggaggggggagggatagcattgggagatatacctaatgctagatgatgagttagtgggtgcagcgcaccagcatggcacatgtatacatatgtaactaacctgcacaatgtgcacatgtaccctaaaactttaataaaaaaaaataaattaattaaaaaaaacaaaaacaaaaaaaaaacctcttagatactcattccctcatgctcacgttcctccccaaagaacctcctcccttcccagggagagggtcttggccacatgtgtgggaggctctgcaaagccagtgagctcttccacccacagcagtcccagggccctgacattcctccttccctttcctggttgccagactttctagaaggaagccatgtattcgggcacttctgaagggctgggtgaaactaggcaacagacttctgcacgttacactgggaaagccagtgtgtggaggtgcagcgtgacctgaaccagtcctgagaggccaggtgtccacacttggctgtggggcttggctggtgggggcagggcatgtagcctgggtacagggaggagggggactgcccagaggcactcactcttaatttggctttctcttcgggtctcattatgtgtcacttaatgtgaaaagtctgctttagactcctattctaaatcaccttaacctttcatcttgccctgtggtgctcttggctcctatagcactgaaaacaatgtgtaattctatatttatttatatgtttattatctgtcacccccagtagatggtaaactgcatgagttggggtcctgtgcattgcaagtgctggcatcttagtagctgcagaatgaataaacagtggcagtagcatcctctccggctgagtttttagagtaggaagtaggcagaaggtttggggtcatcttagtttgctcaggctcctataacaaaataccgcagtggggggactacaaagacggaaatgtatttctcacagacctggaggctgggcagccccaggatcaaggtgccagcagatttggtgtctggtgagggccttcttcctggctcgtggacatttgtctcctcactgtgtcctcatatagtggaaggggcgagggagctctctggagtctctaagagtgttaatctcattcgtgagtgctctgccccatgacctaattgcctacgaaagcccctcccccaatatcatcacactgggggctaggatttcagcataggaatttggggggacacattcagtctgtcaccatgtacatggactgtgcagtgggaattaccctgatttgaggagtgtttagggagggggagggcgagctggacagacctgggatggctccgcgtaaaccgtgtctgcagcatcctgggagcctgcttgagatccggcccttctaaggagctccaggagacttacaacccagcccttggaaggagatccagagggaagaaggccagttgatgacttatgaaatgtggatttgtattttcagaagtgcagagtagtattttaaaaaagcagatgagactctgagggttgggagaatggcagagcatgggaagtggaggctgcttcggatccgagaggaggcactgtgagatgtggaaagagcttgggctttggaatggaacctgcatttgattctagatttcaccgctgagtagttatgtagcttttggccaagtcacttatccagtctgagactcagcatttttatctgcaaaatggggctagtaacactgccctctttgagttgtcatgaatattcaatgagatgatgtgtgtacccacctccctacctactcactgtccaatgagtgtttgttctttgttccttttctctcttgaatagccagcgtggccagttttaaatttctcttgctctccaatctagtctaatttattctgtcagctgtcacatctactaactaggtagtccataggtgcatattatatgcatgtaatggacccattgttgtgtgaagggtggtgaagatttaggagcacagatttatcctgcagaccatctcccacatgaatgtgttcctgggagaatacattttggatttttaatacccatgcttcgtattttatacacatattttaataaaatgattttaagctgctgtttatataggaaattatatttacagcctccaaatgcaatataacattttagtgaaaagtcttgagttacatttcaagtacagttgatagaatgtgggaatctcttgtgggtgttgtgtagagcccgtcgagtgtcaataaaggggacttgctttggggatgtgtctgggccccaggaccacattcgaggagcatctttcccttcccaaggcaaggcatcttggctacatgtgttggaggatttgcagagccaggatttgggggatagaccaggctgctttcccgacccatgacacacctggactcttcccttccctttttctggctgacagtcttcctagaaagaggtcatttgtttggcccctccatggggctgtgtgaagtcagctgacgggcttctgcacattaagcggagaggtcaggagcacgttatattcattgtgatagtttgtgtgatagttctactatataatagacattatgctgtattttgttacttttaggaaatacatgatgaagtgttttggttacattttaggaaattggctttgagttgacatgtaatgcattataatttttcttatttaaaagatgagaaataggccaggtgcggtggctcaagcctgtaatcccagtattttgggaggctgaggtgggaggctcacttgagctcaggagttggagaccagcctgggcaacatagcaacacctcgtctctacaaaaaaaagtaaaaaaaattagtcaggtgtggtggtgtgcacctgtagtctcatttattctggaggctgacacaggatgattacttgggcccaggaagttgaggctgcagtgagctgagagttgagatcgtgccactgtattccagcttgggtgacagagccagaccctgtctcaaaaacaaaacaaacaaaaaaaaccatgagaaattggctagcgtttcccacagaacatctgactttcgggaaagtcttattgatgtgtgccttttttacaaatggtccctatcttcaaggcgtggatagtgtttttagggagacagaacaaacaataagaatggagcattcatataaggaacataacaaatagcacaaggaggtacgcagccaaattagtggacctttgaggacggcagggctggagaggatgggtagcaaccacatacgccatggctcttggaatttcagactttagcagtttctcaatgaatgttccttaagtacctgtcatgcacaggtgctgtgccaagtataaagtgataagcaaggaagcggaaaacgtagcatgatgcccagcctgaacttctctatgtctaagaggaatgagaagacattaaaaacacacagcacaacatgattcaaggtagaaaagttacaatgtgctaaaagagaagaacagctagacaacgcactgctcagagaggggagatgacgtgcacatctgagaggttgctgtggctttggctaggacagttatcttagctgagatggccttaaggcaaggtcttgatgagggctgcccatgttattaacacctggcactgcagtgcccgttagagtggatgccgccggctgagggagctggcaggctctggagccctctgtcccctaggcataaatctgctatgcagtgcattggagggaagctccagggacctaaggaaggatgtctgggtggtgggtggcatttgagggactcagggcactgatatttaccaacccatacagtgttttactgtttaatgaccagtatgttttaccatgcacagtagctgaagatcagcccaaattggaccccaggggtaggtaagctaatgaagccagaggtgtaggctatccatcctcttttgtcccaatccaggaaatgtattttacccaataacaacagtcctgtgttcttggagggtgttccacctggcgtaacctaagggtctaacttagggtttaagtaccctacattgaaataatagagaaacctgtgacctgaccactctaatgattctaatcaaagtgctccagcactgtgatccctgccccagacccctgggcctcacccccatccagtaaatagagggtttgtgcatggcaaagctgagggccgcagagccccgcgccagctctcccggccagcagcgtccatgctgatggtggtgtttgtgcagcacctggtatgaaatcttgtagctatcacccccctggttcccatgcctgccacttctatcagtaagacgcagcgagtcacacagtaccacagtgaagtcttggttttggatgaggtatgtgattataagaatttgtttttataaaaacaataatcatcctaaaaacctgtgtaagcctcccctctgcaaaccagtatggtctgaaagaaaaccaagtaaaacaaacaccaacaatccttatgaacaaaggagtgggaaggggtatgttcgacggttgtaatagtaagaaactcacggggaggagtcatagtgtgcttgaagtttggtggctctctgaagacaaatggcgctccatctgtgtgaaagggagcgagggagtgggggaggcacgcccgtggctgctctgtagctggggtgctgtttcataaggtggttcactgactggtaccaccgtcacacagcgccctattaccagttgtttacccaagaataaagaatccgaattatattttagaaatacaatttagggagctgaagtttaaaataactatcttgagcttcagaaagctcatctctggaaaatattcacagagggatatttgtacttccaagggaatctgatggggcaagaagcaagtcagatttctctacttttcagttaatggactccttaaagattatgttcgtattcctttaaaatagtaattgctttgtttcctcaagagccaagatccatccagtccctaaatcaaattctcaactaaaatcagaaggtttaagatacagttattttaagtgctgcatactcttaaaaatgtgtgtctggttatgttgtgtatataagtggctcatatcagagatgcagcaagtcaagctatataaaattcagtaacacatgccagagaaggaaggagggaagagagagagattgaaagagagaaagagatgcttatccttttctccaggagaggctcgaattttactttcaacttgtttctaaaaatggcagatgcaaagtaagaaaacaaatgtatctgttgcaggaaggaaggaaggacagagaggggaatctgatcttcagcctgatgtgatatgtttttatctgaatgcttttgcaatagaacatctgggaggcaagtgagaattggggtatgcctatgtttcaacagtttcattagggtcacagacctttatttcccagggctgtgatagaaaatatgaactcttccatagttgggagttgaggaaggggtaggctgaaacagtggcatctgtaacagtgcatgccatcagtgggatgtgatgatagtgcttatcacaatagctttaagacttatgccctctttctttggaagcatttaaatagctagccttgtttctctttcctaggaggaagcctgggattgatgttggtacctccaacctgaagtctgggaaattggtggggggtttgttgactcaagtttataagtggatttttaacccagttcacgtggtgcttgtgctgacactgacattttgtgctgcatgatctggaagttgaggcaaacattatcaatgttagactggcagaatctgagaggacagggtcccagtttcaaagtttagaaacatttcattgatcaaagtgtattagagaaaaaagcattaagttaattttttcattcagtcattcagtcatgcaacatacctttcttgatcatctgccaggaccccagcacatttctggaggctgtatttgggggcagattgaagctaggtgcagtatcatctcctctctggtaactcctttccaattgaatctgcagctataactggtattttgtgccacagagaaggaagaaagtatacaggtgggcaagctgggattatgtgtatcaagatggttatagtaatggaggaactatctcttgggatgcattttagcagaaaggaacataaagcattcaaaagagttctattctctagttagtgtcaggactgacttttctttgttctgtggtcaaggaaggccctactgaaaacccaggaatcaaggtgggtgtttgcatgaaggtcccttcagcgtcagcaatgagagcagtaaatcaggcagagctccctgaattaggagtcctcccaggcagtcaggtcaaggtcagatttaatttgggattttgtagtttacaggatgctacccactttcttacacctcacagtaaccatgttccagcagcttattggattggtccaggctgtgcctggtggtgagaacgtcaggttttgtgggcacatggcttcaccaggagaggtctggggtgtctcatgttggtagagaaggagtatgtccgtggactctaacttctctagaggcaatgccaaaggcaaactggatagctgttgctgctgtagttttgtaaatctatgaccctctgttgaggcctctttaactctagcagccttatgcatctttatgattaattcagtaggaccccaccagcagactctccttcttctaagagtgtaaagtcattcatgcaggtttggccttgcttggaggttagggcttggggggacatgagcagggcttgccctcaaattcccagtcatttggctcctcctttctttcacctgttactctttctgctgctttttttttttttttttttttgagacagagtcttgctcttttctcccaggctagagtgcaatggcatggtctcggctcactgcaacctccgccttccaggttcaagcgattctcctgcctcagcctcccgagtagctgggactccaggcgcccaccaccactcccggctaatttttttgtatttttagtagagatggggtttcaccatgttggccaggctggtcttgaactcctgacctcaggtgatccacccgcctcagcctcccaacgtgctgggattataggcatgagccaccgcgcccggcctctttctgctacctttacgttatttacacaagcttggaggcctagaggcaggagctggtatttggatcaatggctgggtaatccagagcagttaaagaaccaagaaattattaatattttgttccaggttatatgtttttatggggtgatggtgaaacaaagaatgaattttgtttcctaaatgtgtgtttcttgcactgatagcaaaattagccactgtttacatttcctgagcactcatcagcctgtggtagagagaactcaaaggtaagtgtggttgcaaggaaagaaaccgggaatccagtggttgccgctagcttcattcaatgtatagatccagattattacatattatctgaattaaacaattttactttagagagatcatgcaggttctgtgtttgaggaaatcttacggttgcttataaaggaaatcattgccccaaaattctggatttcaactaatctgatctgcttaaagcatgacacctgcatacttgctaacttattttttgagaatagagagttagatcaggaataggattcagtccttagaatgcagagcttataattttagaaaggtatgtattttatttaggccaggtatttttactgttaatatatttactgttttatctagaatgttgactctgttatgattgagtcagttgccccttccccacttcctctttcctctgtgtatttattgcacactgactaagtgtctggtgtgacagcaggtgctgcggtcatgagggtgactagttagacatggtttctgccttcatggagcttacagtctggtgggagggatggacaaaggaagcacagaactggacaccatgcattttctcctctgacatcagagccaaactggaagatcctgaaaataattctattgcatgtcccttggagatattaacacattgctcagtgatgttgattgttaaaatatcctcttgtttggaattgttatcacagtggctcctctggcggtagcatgcttataaaagcaaccaggaactgcccatgtgcccagtctaggctcctgactcccacagatgcctctggggctggggcccggctaaatattttccaggagaaaagtcagtcaggagccagcgcctgccatttcccattctttcagagccaaggagctggacgggcatctgacagcctggaagggccctgctccaatctggaactgaggttaacgcttcaggtcagctacttcctaagggaaggaaaaatccctcccagggatttttttactttgagctttctctggtgctgcttgttgctggccttcagattttggccaccactatcttcgggtactattttctctgcctcccttggagaggtgaccttccccttctgtgcagggccctgtctgtcccatgtggtcttccagggctggggtgaggaggaggcggcgagattattgcctgttacacatggacatctagacgggggaagaaacataacagctttatttttaggctttgctaattctcactcttctcctagttcgctgctacctggcaacagcttattgtcatggcaacaccgatgttaatgagtgaaactctcagtgtgtctgctctcctggtgctctgacagacaccgtgtggagctatctttctggccatcagaggctaaacgctaggcttccttcccctctgcaggcctcccaggccccgggccccgtccacagagggaaggcacggaggcagcgttgacaagggatttatggctctgcttacacattcccagcttctcctctcttcacggatgggctgctgctctcgcactgcccctcctcccgcagtccatccgtccacatttttaagcggtagctgtagcccattttctcatgtctagggcacctcaagatttgagccggtttttacagcaccttctctgcagttgatcagcagggctgaatcgcgagtttgggagaggagatttgtggctggaactggcgctcacattggggagggaagacctgcaccttcagctcttaggctgagagtcagtaacaccaccatagcttcttgtcttgcttctctgacatctgtccctcaagggtgcctttgcagcattacaataattgtgaggaagagcaggcagagtctgctccagcctccttgtgcctcagtttgtccatctctaaagcagcgcatatctgaaattggatggtccttaagttggcgctgctgaggaggggttcatgtgaagtgctctgggctcctgctcaccatttctatgatgtgggtaacttgctcgacccctctgtgactccacttctcacttgtaaataaggatagtaatagtacctacctcagagtgtcattgcaggactccaaccagatacatatgtgtccggggcttataataaaatcatggttcaataaatcttagttcttactacgtgtggtcattattcagtcttcacactgatctcgtgaactaggactattattcttgaattacaaagaaggaaactgaagcatggagaggttgagcaactgccaaggtcgctggaagcaacatgaagcctaggcgtgccctgagtcaccacactgcacattgcaaggtgagcctgaaggggatggccctgtatgccctcagtgacttctccctgctccggggaggtgggcccgggaccccaggagtgtgcctgaggaccttgcactccttggataagaggtgtcaccgccagcccccttcctgtcttccctgtaggcccagcactcattcacaggcagacacttctagttagcgcacatggttgatggacatgtgaggttcctttgaccccatcccttctagtctatgcttctgcttctttatctagaaaatgtgcagccatgtctcatccccgccaaaagaggtactcaagaagagagaagaggagtgttcagtgtcttctccccacgtcccctttcccccagcgaggcacaggggctctctctgggtttggactggagcacctcatgggtgtgaagtcgggaggagccggaggcagtgaggacctgcattgcagcgggtgtgtcggagggctcagcaaacgtgtgctgcatgagatggggaaacgaagccatgtttgccggcatatctggggttccctggtcactgagacatcagagacatgtcaatctgagtccctttgcttggatttaatctgctatttgtgggtgttctgttgcattcagtggggcttcagtcttcattttccttgtcctttgcacttcctcatcattccctttctgcgagcttgcccacttgctaggatggatcctggtcagtggatcaggtggtggtgctgagggctctgttaccctgatggcttgccagcttgcagggcccagcatgcctgtgagggcaaaagggttctgagtggggcctgttcctctgggtgggatgcgctctccctcctcctaggcttggttcctctccttcctcggggcctgattcctccagctcatgctctgtctttcctcagagctcctaccacagtccctgtcccccacactgttaacacttttacatcagcattgcacatggacataaaggggcactgcagccagtcccctgtggaggatcaggatgtcccagcccttcagggacaggctccagggtaggcctggcagagggaaggaccatgttctctcccaaacaggccagtccttggagctgctgccatggcttcagcttccagtaccctgtttggagggctctttgcaaagaggcagaagagccccaaggtgagttgaagggccctggagccccaggcctgcctgcctggggagcagctgatggcgaatctgtgtcctagaacacgccctgctgccaccagtgtgacatcagccgtggttgtgaaatttctgacaaagatgctgggaactcatcctgttctcgaagtcaccatgccgcccatcagttgacatgctctgttgtcaagaacacaagaaccagagagaaagcacactcagcagagatgtgtcctagggtgttagaggaaggaaccccatcacaaaagaaaattagcaaagacagaactgggcaaaaccaccagaggtccctggggcacgccaattaactagctgggagtcttgggcaagagcgaggggaggccagggcttagggatgaaatgtgaggatggggaggggcctcttgagctggctcagtgcctcagtcgggcactggatatggactgggaccacatcttctggcccctcttattgtccctactgccttgaaaggactagattataattacctgaaggactgagtaggcctagaaatacttccctaactgcttactcatatcaacattccttccaagaaagaagcaggcacgcagtccacaattagagataaaaggcttcaactggaggaggtaaggccgtggagcgaatgtttcagttggaatgcaatcagtcaaacaactagggcaattgactggttatcaaaccctcctgggttttgatgggaggaaagaagaggaattactcataaggcagagttttcttaaataaagagaagggccccccagaagaagaggcttcaggacactgattcttactcttgtctgtacagtagaataatctgggcagccttttaaaaatactcaattcctctgcctcaactcagaggagttctgattcagtggccttcatagggctgggacatcagtattttttgaaagcacccccaggtgattctaataggcagccagggttgagaaccactggtttagaggtgtttaaagacagaaggcaaaatgtgtagactccagcacagaatttgctgttttccaggctgagaccaatagaaagcatatcctgattttaattcacagcggcacattctaaaagtatactccaggatttaaaaagtctaggggcttttggaaatatttgtttgcccatgttcatatcaacattatttgtaatggccaaaaagcagatgcaatccaagtattcattcgtggataaatggataaacaggatgtggtatatacatacagtggaatatcattcggccttaaaaaggaaggagatcctgatacatgctacaacatggatgaaccttgagaacattatgctaaataaaataagccagacacaaaaggagaaatatggtatgattccacttatgtgaggtacccagaatagacaaatttatagagacagaagtagaatggtggttgccaggggctggtgcagggggaagtgcggagctgttgtttaatgggttcaggatttcagattttcaggaatagcaaagtgttctggagatggatggaggtgatggttaaacaacaatgtaaatgtttttaatgctactaaattgtacacttaaaaatggttaagattgtaaaatttatgttacatgtatatattttaccacaacctaaaaaattaatttcagattaataagaatcatctattttaatatttgagaaaaacagaaatgtataaaggagaaaatttcaaaattaccacttgatatctagatgtattctttctctgcatgtgcttaatcatgcaaatacatacacacattgaatcttactttctatgatggcttgcagtctgggttttcatttgtacttgatttggtttaatccttatttcttgacagagatggttccatctcaagggtggagtaagtgaggtgacatagtaggtgggcatcctaacatatccgtatattcagctttggaatcagacactactgggttcaaatttgcacctgtcatgttcacgatcggtgtgaccttgggcctcattctgagcctaagtgtccttatttcagacttgtttgggaagttaaagataacttaggtgccaggtccctgctcaggccgtcgggaaatgggagctgtaactgcagagtcaccggagacttccacggacacttttacgtacttgagatagatattcagtctccacttctacccgtctaacttaggagagagcttcggagaagccctgatctgagattcaggaagtcgccagggctgccacatggtgctgtgaccttggcaacaccagattctttctcggtctctgttactacatttacaaagtgaacacattgggttttggggtctctgggctcctcccacgtccctactctagcatcctttgcctctccgtagcctctcactccctgagatgcagggccctcagtggatgtccagtaaatgtttattgacaacgcgtctcctgcaggttaatcatcaacaacatgcaacaatatcccagatatgaccggctccctccaaagagagaaacctgctttatggcaaactcattgacttttcttcaggaagaaaatttctgctggtgcagcaccatattctgcaggagtttggatagggtgtgctggaaagacagggatatttttccctaaaggcagtgcataggggcagaggggcaaaactcccttttttattcctgtagtgcttgtactggggcagaggaagcagatgcattaccaagagcgtggaaagaagtcctacgtccagcctagagctcagcgcatctttcagctgccaaatggaaggtctctctgtggcaatgctggggagggaaattgagttaggatggcttgttccaaataaaatgctatatttaatttcactctgggaaacatttgatgtccgggctactgtaatacgtgaaatagatttaagaagatcctttttttgttagaacaacagaaaatacaaaacagggaggttctcagatcagttgcaggttgcacgtaggggtctgatcatttcagtgtggtttttaagcatctggcagctgctggccaacggttgactagtcagtatctagcagcctgagtgtcactgtatgcgttgaatctgtctcagtagttcagcctctgaaatgcctttcaagttaagccaaggcattcggcacaggaatgggaaactgtcagtttgtaaatctgggatgtgtatttgtgtgcttgacatgtggaagggaagggttgagtatgaaccaatgctgagttagatcaacaaatatgtatctgactatatgatctaaaaatcagccaggtagagttccatctccagaactgctgtcccttttatgatggtcataagcgccatggctgctggacgcttctctccctttgtggagctctgccctggtgcatttctgggctaactggccatgcagggatttggggaaggagctcacagacctactttacttttcacattgttcctatcccttcaggcttctgcctgtttccttcttgactcctgttactttttagtgtgaggtcagaaaaagctcttctcccctcttctgccttcattcatttaccattcagaggacctcactgaagtggagagaccaacagatagggctgccaactcaaccctggaaatgctcttttcttattttacctggccatctagaaaccaagtgttttatttttttgtccatttatttaaaaaaactacagaatgaagtatttttggggactgtgccactctttcgggctgtaagtagaaaagaacaaatatatccttgtccagcttttcctgttagaccctcagaggaagaagctccagcccgtaacctgtgaggctttattccttggtgatgatgtgaattagagagaaaagctaatctttttgaatgactatgaaagtttctctgtggagcatctgaaaccctggaaacacttgctttcacgaacactgagtgcacccttatatgtggaaagaatttcagaggccaggtatcaggagaggccctgggagagtaaggaaatacaagcagccttttggcctgggatctggaggcctggagtctggaggcctggtgacctaggcagtggagggcccaggagggaggctttccttgaagagcactctatgatgttggttcagctctctgacattgaatttgtcatgagaacccaagctgctttccatgatagaaaggatttcctcctcctcagatgctgagggaaatggttctttgcatcctgcatccagaatcagcacaagacggtggaagtggtcagggaccagcatctgggctcccctgttctccaactggcagtgctgtggggtccctgggcaattgtacagaaagcatgtatatagagtcagatagatatgtgctggaatactgacacaattcaaagctccctctgctcaactcctttgagctgagcttaatccatagctctctgaacctcagtttcattatctgtaagagtgggaatgatgatactgcagagttgtgaggcctgtgcatgctaacgcatgtgatacaccagctacagtgctggctccctggtaaggctcaggcatggggaactggtacaagcattacctctgccctcccatgagacagggggtgctgatatttggtgtgaagaggtgctgacactagatgtgaaggggtgctgatactaggtgtgaaggggtgctgatactaggtgtgaaggggtgctgatactaggttgggttctcctagatcagtctgatgtaggagagccatcttcagctggagctttgggatctgtagttactgaccagtcttgactcaccattgtttgtggtgtctcttgtcttttttcacttgtttccggaaggcagctggtggtaagttttacattagttttagcttgagtattatgcttggttagcgcaatactaaaattatttcctttttcctgtgcattcatctattcaacatgtatttatcgaggatgaactatatgcgaggcactttgacaggcactgatgatgctgtgcttggcgctgagcgagagtttacattctctgtgcatatgagggcaagaagagaagagagagaaaatttaagatgtaagcaaataaatgagagagcttcatattatggtaggtgctatgaaaaagaaatcaaagagaaacaagcagagttttgtggtaacatgactgtgggtgggggttactttaagctgttggtcagggaggtcccctctgggacctggaagacaagaaggagctaggcttgcaaagaaagagaggaagagccttccgggggatggcatagcaagtacaaaggcccagaggcaggacaaccttggcatgtgtcagaaacagaagagcaaggctggcacacagtgaatgaccaggcgggtgcaggtgaactggtcaaagggttggcggtgtggggagagggagtgctagatcatgactggtagggagggtgacgtgtcttttttatttttagaataccatcattctgcctgtggattagaaaagggagttgggagggaatgagaaactggttgggaggccagttgggtaggagaatagaggctgggaccaggtgccagcagtggaggtgagatgaatggacagaatttggccagtgggatgaatgcaagtgcctgggaggcagagttgccagggcctgctgggcagttgggcaaggaggcctcaaaggatgccaggcagtttgttcagaataaacatcaacagtgaaagtcttgtcaagagtgttgggaagttggacatttttagatacagctgatggcagtgcagaagttccactcaccttggagggtcatttgacaaaatgttcaaaggcttcaaaatgctcatttcttttggttcagcaagtccataggattttatcctacagaaacagtcagaaatacacaaggattacttacaagtgtgttcattgtagtcttatttgtaatggagctaaacctgggataatttctctcctctattaatcaccagagggctgggtaactaagttaggatgcgtccatatgatggaacaccatgtagccattcaaatgataacctagaaggacagttaatggcacataaagatgttcaactgcactgctaaatgaacaaacatagaaagttatctacaatatgatcccaaattttataagatatataacctctatttacatctcatatgagtgtagacaggatatactataccctggaaggtataataggtatacattagagtgttaatgataagccaattcagggaacaaaattacaaattattttatttcattctctatttatgattcttctaaattttctaacataaacatttgaaataaaaacttaaaaaaagccctgttatttgaaaaaacttgtgatgtcttaccatgtccaagtataaactgaaaagtgaataaatcagtgggctggtggcccttcttaatacactgccatacataggacaaccatttgtattcagaaagtttgtgttgagtaagtcactggatttgagtcagaagacttggagttggagtcccagctcagccattcactggctttgtgatcttgaacacgacgcttaacctctaatgcacagactcttggctgcttcaatttgcagtgggaatgaatggtgataacaagaacaagaataatgctttcacggagttgtgaggattcagtgatagggaattagaaaatattttgtaagaggaaaaccacaatgtaaatattaatatttcagggcccaagtctttgacatggacgtgactatgggcaccaatagatttttggatggatcatttatggtaccctgtcgtgccctttagtacacctttgcctggtgtacatctcatgcaaccaaatggccagctcacgtctgatcccaagccctgaattaagtgagcaatctgaacatgagggacaatgagttgtcctgagtggcaggcggctctcaagtgaggagtgctttctcattcactggaaaactgtaagtgaaatgctgcttcagcagccacacccagagcccctttgatacatggttcagctgttctgttacataaacctattggaaatgaacctgcaaaggagttgagcagagggaggtgcccattggaataaggacaaaggagaaatgcactacctctccatttaaaggagacatttgctttttaatggaccctaaacactgggatctgaaatgtcacaatctttacatactggaatggacacgcacataaatgctgatgaacagctcagcaggcacttaatttttaaatccttgattgttcaaggacagggatatcctacttggctctgcaagactcatagcatactggacaatgttgtctgcatcggaatgtcttactggggagtcacacctccaaaaagaagctgtgtggtgaatgggtccaaacataagggtttgagcccctgttttcagctgggatttttgggtaaagggagatgaagcagccaggtctaaccaactgcagaggtttatttcttggggactcccagctccattgaggtgtagaaaatatagcacataccagttaccaacaaggatacctgttcctggatggaactgcctggttggaaagaatgctggtggtcagtagtgccttctgatcctaagaagaggaccctaacctggccattttgaataagggccccatagctgctgattaagtgtgtcaatagtgggttccttgtgatgtaacattcatcgtccttcctgtggtggatgaccctacagacccacctgctgataagctaagctgcttgcttaaggccataaagctacagaggtattaatctagagtttgaatcggatctctctgactctaagactcctgctctgaagtcctccattatccttcctcttatagagttgttttgccagtgctattggatttgaattcaattgtaccctacgtacattagaatgaaaatgttatacatcgtagaaaatgaataaatcatggttccatccctcaagaaacttatatgtattattatttaagagtttgaagtgcatagcaagagctcaataaataattattgagtaaatgataatacacaaatatattctagtttatttatagatatccataaccccaatcagattatgatgcatctcataaaaggtgcacacacaaaatcccatcggagtttaaagacgggagagaatacctctggagaaatcaggaaaataaaagttggatgtatcatttgagatgggtcttaaagacctgtaaacactctgacaggtagagatggtgaggcttggttcccaccctgaacctcctgcctgctgattggttcctgcagtagaccctaggtgccctggtttgtttctgctttgtaattccacttcttaatgatatcaacaactgggagctgggaaatgaagtttttattctgataaacctgacttgccacaagaggcctacaagagaaagtatgatttctggtctcctctccaccgtctccgatatgcaaacgagtcacacatctgtatcttcattctagagctctcttttgaactgctaatccccctggcggagcctctgatcctggttatccagcattcttctagatttaaggttgaaacatgatttaaggtcatgaatgcatgaccttcccagactcccttgtacatgagctcccacattcccagcccctgttctgctccaccccttgtggtgatagccagggtggtcagctgcattgcatgttagtagtaagggaagaatggggtggtgggtccagagttgtgtgttataagatgactttggaggtcaggctgttgttttggctcactttgggattttggggagtagcttactttgccatcaatttcctgatgaagaaaaggcaacttagcattcttcgtataagtaaacaggtcagtgttggagataattacatcatgaagcaccgtgggtcccagaggtgggaggcctcatgtaagtactactgtgctattgccatcattgtctggaggggatgataatgtcgtatttgcttgcaaaatggttttctgatgttgggttgaaagagacggttatgtaccttagccaactgttagggctgtttttcttctagcacaatttataaagtgatttttgtcacacccaaatttttgcaggaccgcagaactcagacatttaaggttgtggcttttcagaatggatgaataaacgttcgcactctaaacttaagagtgtgaaggcttgtcaaggctccatttctggtttgctttctgatctcatgcaagtcacttcacctctctgctttttgtttttccatctgtgagacattgctcactttgccaggatatcttcaatatgaagaagataatgtgtggaacgctgtcagctgctgcatcattaaaaagcatttattcagcacttatgtagcattgcacaaagagaattataaagactagatccctgccttgtctgctaggttatattctaatatcttcttaaaaaggcagaaactaggcaactaaagagagcaataattcaaatgttatcttttaagctacacaaataacagtagcataaataattaacaagcaccaatacgcaaagaaatcagttatcaagaatacacagaaatagttatcaaaaatacatagataaaattatcagaaatttctcaactttctggagccaagtcatgcaagaacctggttttatgtaaatgaaattgcgatactgccccctggaacctgagcaagaagaagatcctagtgggcggagtggggagggaaagtgttctggagagttttacttgggattctggtatttgggtttctgtcactgtctcttctccctccaaagtcaactaatactcagacattaaggcttaagaccctgttaaggggaaaggtctatgctttagagaggatgctgtagagtggtaggcaaccatcattcctcttgtgaatattgtggtcattgcattatgggccttcattgaattatgaaccatcatgaggatgagatccaaaccaagctggatggaaaccacatggatgaggccccagagagtgaggacgccatacaaatgtaatcactgagctgtctgaatcatcttgagaaaattctacaagtctgtatacatctgacttccccatcagttacacactttgaaaggaaagctctagggagaagagtaccatttgcttccccaatgctaggagaggaaggtgatgagaccgagattactaactaaattatttcctgtgacttcttagaaaagctgaactcccaaggtatgccgcttggatatggggacgcgcacacacacacacacacacacacacacacacacacacacacacacacagttttcttcatacaggggtagtaaaacctgtcaggaaattaattaaattagctattatttgtgtttctcttatagtttacagcatcctttcactgatttgatctcatttgacataaaaagactagctgtcaaggtaggtgagactaagattaatcatccccattgtacataaaaggaaaccaagactcagaggttaaataacttggccaaggtcacacaaccagtgtgaatctggcagagaccagatttagatattcactgtaataccctgactttctctctggaagatggtcagcagtctaaagccaatgtatttaaataccacctatcacaaattttgcatacaaagatttcaagccccatctagatacctagttttcctctccatatctcatgtttttaaattactattttgtgtcaccatagtgcacagcatgcttaagacctggcttgctgctcttaataattacatagtgtcattgtttcctccacggagactcacagtggaagctagcaagccaggaacttgtccttcactgcacttgggtcttaaacagctacaaaatacaccgagtttgactcccatctccctccagttctcgagctctctgcctgttggttttcagcacgagtttcaagtattctttcggcaggagaagggctcttgaaaaatagcccatcacagtgcaaattcttttctaatgaatgcgctgggcaggcaataaatctgaaagggatgcatctgaatcccggtccaggtggaagatgctaaactggcctaaggttttcaaatatgcctgtccttagcccacttgcagatattgctgccgttactgctgatgccatggcctgtgtggggaggcagtcctcaccaagaactccctccacaactgctgggtgatggggggattgctgcatgctttctctgttccctgccctcccctttttagctattcccctcctctctgaaatcatcccctcctgactttagtccaggatctccttccagctcctcgccttcctctaaccaggaccaactttctggaaaaatggttcttgcacttcagtgtcaattttccccaagaacatgagcatttcaagctttgagtgctgattcgggaatttatccagtcacaggagtttcccagacagacacttcattctgttgattcagagtcatagtgactctgtgatcagagggacttgagtttgaatctctataccacctttgactgacttttggcaagttacctaacctttcagagtctgccaaatgaagacaatgctattgtcctgttagaaggattaaatgatatcacataaagtacctggatgtgctcagcctgtggtgaatcattatatgtcagttccgtttttctgtttctctcctgaagaactcacaaagcctctttatctgttcaaggtcattggatgacttgctaagaactaggcagaagccaaaggtcattctcccatcagttatcactcctacttgacaatacaccccaggtgtcaattagtttttggtttgacctactatattttactgattctactgatcctaagacatgttttcccctacattttcatttctctaaaactaaagtgcaatctaaactaataggttacactttagttggcaccattttttctttctcattgatacataaaataatgggcacatcttacaacttacaactttgacttgatggacatatggtaattatttttaaacacctgactttaaattccctgaactcaaatggcaaacaactgccctgacctggtgattcttgatgcagtctcttcccaggtgccttgtgctggagcgtctgcaagatgtccttaggtggtgggctgccatctggataaaggggcagcaggaagaagagtttctgggcttctgggacacatgtgaatagagtgcaaatgacacttagggttgcattcttgtgtcagagttcagttggcttgtgcaaccccgcccctgtgtttggccccgagatgttttcccacaccttacacagggaactccctatcatgtaatattcaaagtgggcttttcaaccaacatttattgagtgcatactgtgtattaggccctgttaagcacttgacacgtgtatactcttttaattaatatgattactccataaagtaggtacttctttatcttacacaaacccaggcttaggaattaacttacttgcccaggtcttaaactcagatctgtctggctccaaatgtcctgatctgaatctctctgtccttctgcttctctccaagcctgagttggcaactctgccttacctagtggcaatgacaaaacagcataggagttaagcctgagttttcgttctcctaagaatctggttgacaaggtatgtgctaaagaggtaggggtagcttatagagtttgtagaaaaggggggatggagaggaggaaaacccagtacagattttgagcctttctgagtgaatattcagctccttttctccaggtacactcattccatcatttcatctctggcactgtgccagcatggttccagggccaggggtgactctggctacctggcatgaacagtgccccacttttcccatctgtgactttttctgtcttctgccttgaatcagatatgccccaggtgccagggaaagaggagtatgtgcttgatggtctgtcaagtcaggtagaaagaaaattaacatctctaacagtgagtgattgagatggagtattttccaggagctagaatattatgtgtgtgtgtgtgcatatctcctggaaaaacagagaggaggagacgctcctgtagcctcaagagagctcagtttggtagtgaagacagcagatgtatgggcccattactattagcggggcaagttcttaggggtgtgagaaccaagagaacggttgattggtggaaagagcacaggatttggagttctgaagagcacgttgagctttgtcttttccttgctggctcacttgggcaagttccttaaactccaagctttagtttcagttttataatgtgggtagtccatttttacctcggcctcattgaaagaattaattagacactcagagtgcaggcttgatacaggcctcttccagggcctgggatgtattaattgctggtgctccctcagtggcagccttgatatgcacacctaggaatatatacatatgcgtttgtatatgtgtgtatgggttttaaaagtccgtccttcattcatcaaatatttatcgtgtatctgttctaggtgtcagggagttagcaataaataaaacaggcctgaatccctgcccacggggagcttacaatctagtagagagacaatgaataaaataagttaaacacactttgttgggtggcagtaggggctgtggagaaaggtaaagcaggggaatggggtgtgagtggaggtttacttttaaataagacgatgagggaaggcctccgcaggggatgcctgagcaccatctatgggaatgagggggtcagcagggtagactgacattcgagaggaacgcattccaggcagagggaattgcagttacagacactgacagacgaacggcctggcaggctcaagggcgagggagcggcatgagcagggtgggcgctggttgcaggtgaggggtcccgaggcgggcggagcagggcgttgcaggccacggtgagcacggcagcttttgcccggaaggaggccagagccattgcagattttgagcgggtgtggcgtggtctgacgcgggctatcccaggtgagcatggctgctgtatgggaggtgacgaggggtctgtcctgtgtgcgcgcccgcctggctccgcagtagctctgagaactgccttaagctccggcagcgattccctcaggttagaggcggaaggggaagaaggggcctggagaggtgtggttctcgtggtggcgcggccctcgctgactgtgctcaggatgtcccctcccggggctgcgacctggagccgcgggcaggcagtgaggggctgctgccgagctccgcagcccggggggcgggcctggcgcgtctagctcgcggtcagaggtcgggaagggcgccatgggtgtacgtggggacggcgccgggctgcggctgagccgccagggcctgctgagggcaagcggggcctctcgccttggtggcgcgcaaggtgccttgtgaggagcaatggcggtcccggaaggggaggcggggccgagcctggaagcacagtcagccctctgccggcgaggaactctcagtgcgacccctcaggaagagactgagaacttaaaagctgagggtagaacctgagtgtccaaaaggctaagaggagaacagaagggaatgctggctgaggttacacagcacccatcgtgaccctcgacggcctcagtagctggccgtccccgccctgctgaccgggctcttcccgcgcctgatcactaacggtgggaggcctgggccttctggagaaaagaggctagaatcttccatcttgggttgtgcgggactttattccactgtcagtcacaaagccataaatacatttctccaagacaagaaaagagtaacagcagctaacccttctccggtgcttattttgcacaaggtcctgttctgagtgcttggtttgtactaactcctttaatcttaaagaatgatctggtgaggtgggtcgtattattatcccgattttgcagaggaggaaaccaaagaaggacttggcccaaagacccttgctaacaggtgttgggacattatccaaacgcatgcttctgactttgtcaatctcttaatttcttatttgccacgcggactattgggagggagtttttggaaataacatatacagatacgcacaaaggtcagaaagggaaaataaaaaccggcttaagcccctttcttcccatatccatgtgagcacctgccaggcagctggtgactggcaattttcacttcttattttatgttataatttattgatgtatatgtcatccctcttcctaaggctggagactcatgaggccagagtccatgtgcaatccatttttatattcaccatagtatctaagccagtgcttttaacataataggtgctcagtaaatactaaatcatttctaacgttaaatggatgcatgtggtaaccagctctcacttaagccattccgttctgaaaacaatgagaatgagaacctttaaatatgtgaatcataacacagttacagctgcataatgtttttatggttttcaaaatgcttccgcacagtttatcttgtttcgtcttcctgctaacccttttgagagtgggaggcacgcattacttaattataagaaaatgagaaaactgaaggcagagacaacaaatgagctatccaagatcacaaatgggttttgtttctgtttctgattttgtttttaaaatcagagcggagatcagaaccatcatctcctggtcttcctattttgcaagcagcgcccggtacacacctgttggatacacagcttgaacacaggacctaattgttcgctaggcatgaacaacagggtgttttgactcctgcaagctgctaacagtcttgcacagtgctagactgtgcactagcactatctagaatgtgatcctttgaccggtaggcaggttatcacttaccagtttttggcaagatcaggagcttgtgacagaatgtaaatcagctgtgtctataaacacactgcttagtttgtctttttatttttttttacattttattttgaaataattttaggcttaaagtagaagaatagtgtagagttcccataaaccctttgggaacttcctctaatgttaatatcttgcatgaccataatatagtgattaaaactgagaaactgacatgggtataatacttttaacaaacttcagacttcattttgatcttacgagtttctccacttcagtcctttttttctggtgcagatccaatccaagatcccacatgacatttagtcatcgtgtctcctttgtctcatccaagtggtggtagttctcagtctttccttgtttttttttttttttttttttttttgtttgtttgtttgtttgtttttaatgactttgacacttttgaagaatccgggtcagttatcatgtagaatgtctcttaatctgggtttgtctgatgtttactcatgattagatggagggtatgcatttgttgcatactaaatgcatacttctgaatatcacagaagtgatgttcccttcacaatgtgtcctatcaaagggtaaaggatgttgatgtctttctactggtgctgttaaccttcatcacttggtgaaggtggtgtcttttgagtttcttcactataaagctgctatttccccacttctaataagtatcctgggggagatattttgagactatgcaaatatcatgctttttgtcaagcttttgcccatagttttagcattccctggtacatcttgtttacaacagttattatgtttggctaattatgatttttctattgtcctttttgcctccatatttattaactagacttctcccattaaggaaaaactgtcccttcttccccagttatttatttatttagtcattaatttataccagtatcatgtttatttattttattctatgagtaataatccactactactgttaatttattttcttgctcaaattgttttagctttggccattgggagcgctttctggttggcttctgtgcctcttgacatacccccaacctttctcaagtgttttcttgctttgggaccacaagatattccaggcacatcttttatttccccctcagccctagaatcaactgttactccaaggagtactgattcgttttattggagagtggtagtatgtgaaaaccaagacctgggcactaggtgtgctcattcctatcagcttgtgtttatatggagactctcctgatgaaggaagtagtgtgttgattcacattttggtgctagcttcctatctcatcatatcaggaccagttcgtgactctcccactttgagtctcagtgatctttaagttctgttgtgtcaccgtgtccatgtgactcatctgggggtaatttcaaattctattgaattaaagttatgaatcagtgttatcctttcactcattcattaagtcaatatgtcttgcatgtacactgtgtgttgggccttgtgataggcactgggtttacattagtgagtaaaattctgcctttaacaagtttatactatagtttctttgatggcgtctaggagacattactccttttcttggttctgtatattatcagaactcatctcagattgttcagcattctaaaatcatgtaagttcagcctagggaattttaaattttgattttagattcagaggttgttggaatatgaagataccattccctgtcccagtagctcctggggccattaaaaacctttgcccatgccttgtttctgatacatagatggttgacttcttcagatgcaaggaggctgaagatatatactttgacttgataagacctctgaagtcttagctgctccctctaaccaatactctctggtcagtgcttccctctcctatggggttggggtataggggaggcatcctcctcttcaaaccactctcagaccccaaaaggatcccttcagcaaagattctcttgcttgactttcctccacctacaagtcaagttggatctgggttcagcttcaagggggtcgaaagtgaggtcagttaaggtcatttggatgggcatgatccttactcccaggtccacccttcccacttgatttaatacaatctggcattattccaacacttctccctttggctgtttattagcatttcctttaactttttgagcataaatggaataagaatcactttcacggcccagaaaggtgtctccagcaaggagtgttctgctggacgatgcagccttttcaaacgagtcagttagctggaagtgtcccgtgtctccttttcttttggaaaagatgggagtgctgaaaactcatgctgaggctggttctctgtttctattggttcctttctggcatgtgttaaattatgtcttttgtgttctgaacaaatatgtgttctcagcatgcaaaatatgcacacaatggctgaccgattgcctgttcttgagaggaagggaacactcaagctgtggtgagttgattgccaggcactctgtggtcaaaaatgtgagggcaccatgggtcacctgcatgtgccttgaaaagtaatgtagggtctaggcacctgagcatctgttcgtcaggtgtgccgaagatactgccagagatgggctcctgtatgcaggctcctcaacagcctggagcgttcgccccagctttgagcctggtgtagggccaggggccagattgtggaaatgagtctttagtgcctccctccatttttatgttggtgtttttcacaaaaattttctgtgtgtgtgtgtgtattttaatatatgaaatccggtttagagaacagcctcgtatgtcccatcctgcttgtaatgcagtgatctgcccttgagaattttaaattagctgacctacatagcttaactatttcaattaaaagtaacaggcagtatagattggcaagaggtggaggagagggaggggaagatccctcccaggagctttggttcagacaaaacaatagaagtgacgagcgattctgggaagaaggcatgactgatagttgtcatggaagctctgacaccctttccatgggtgaggttctcacaaaggtggcttctggatatccgcctgctatgaacacatagcctttgtgggatggtgccaagcaaactctcttcaagggaaggattcaggcagcattattccttgctcttctgcacatccgctcttccatttccagtgtctctatacgtggctctctgagggccagtgttctcccagccccttcggcctgctcccgggggaatacctggagagtaaacactgtctgtggtacaggggggccattcttcctccctttccatttcttctctactgttcagaattctgattccacagaaatgcctaattaactcagttgctctgcaatgacaagctaacatctggagctaccaagtcaggaaagccattcagccggggtccaacacagattttctcccctctgcacccagctcagctgctgggcactgcaccaaccctgatgtggcaggacgaggatgccaagggctggagcaacccaaggctaattttttttcacccagaaaatcatgggttagatatttttaaattgctggcttattttgcagcatttttattatttctggtagatgaggagatcttgccatcactaggggtccatctctcccacatgctgccttgcagtgcttctctacgtagaccatctctgggtgatgccggtttacccagggatgggatggggtgcagtgtattacgcttcaggttgtatttgtggcccccttgggaatcagttgcaaagcagggccgtgtctgatgtgatggccaggacaaaggtctgaatgactaacaaagaagctgtctctggcaggcaggtaggagcagtccggtgcaccagagctgtggaatgactcccaggttccatttttcacttccactttgcatccatcctcccatctgcctgcccactgtgtacagtgcttactacatgccttacctagtctaagtgctttacataaatgaattcatttgacgttcacaggacatcacagataggcattaccattgtccctgttttataaatgagaatactgaatcattgaaaggttaataattttgcttatggacatttgcttctggagctggaccaggcagtttggcttcagagtccacttggctctatcaaagtcttgctatcaattacataagttccattccatctcagcccgaagtgttttcagagccggagacctcacagtgtctctcaggacagtacctttcaggtttgaatgtgcccaagagccatctggggatcctggtaaaatgcacatcctgattcagcaggttcgggttggggcctgagaatctcaggtccagcaagctcccaggtaatgtcagtgtgactgattgctggtccacacattgagcagcagtgctgtagtagactactatcatgcctgtgtactaatttcactgtcagattggagttaactgcatttggatagggagctctttcagcaatagaataataccagtaagaatttttaatgagtgatcaactatagtagcagttagtaatcaattttttgtttaaaaactaagtttcctaggactctaatggaaaatggaaaggttatgtccccctttttcgtatctttgccaagggtctttcctttgttgctgggtttaacttggcacttctaggctactttagtcctaacttttctcagttaccattatatgcagttctcccagccacaccccagcagtgtgcaagggatcagacacaaggttgaatccatcacaaaagcagaatcaccatggcaactgcatcctttgattcttgagtgtgcccagcaacctgagcagaggcgatagttgaagtgaaccaagttctcctgagaaatggaggggagtggtgccgggcccacactaggctgtggtatcttcctccctacagtgaggggcttctgtttactctgaagactccagacactcaaaatctcctcccctccctccagtcctgcagttagcctccaggggtttctggtcctaaacttccaccaccatgagattactacaatgccttgtgatactcttgttcttctggtttgagttttggtagataagcacatctgagtcttgctgtgttaatgtgtctgtattttggtgtatctgcttgcttgtcgtgtggggcatatgccaagtccagtagtggatgggctggggaagaccagaccttatcacatggtgcccttggggggaaatcttaattccaatgtgtgaaaccagtgaaagtatgattttctgggtcaattttaaaaatatacgttcaagcaaaaagcaacctgttatctcttctctttctgcctctgcacacagcagcctccattgcctagggtatgatagtgtgggttcactttgtccatctcatttggatgacatcagcgaagatgcattctgtatctctccactgaggcctgtgacaggacctaatgttttgtggagctgagagaaaataaaccaaaatgacccaatggaatataaatgctgatttctgttcctgttgtttgacagaaaggaagtaatgaactaagatgcagtagcctggccacgtgatgtcttgacaggcagctttcagatttggagatgcttcagagtgttgtattgagtctctgggaagaccctaagcactcaattcctagtggtcaatggttggcctgttttgagacataaccagttggaaggaaggatgggcctttctgctccctatgatgttgccttaaaaagacatttcctgggaagaactgggcagatggtggctttaatctcactagccttgttcttcatttttatatccaagcttcaaaaaaccagcattagccaacagcactgtttttactgctaagcaaaacttcaggaaagagcatccttcgatagaacattaattaacaaatgtgccgtcagtccaaatgaagacctgtgctgctccctctgccctccctagctccacctttatttacgtacccaaaacatttccagtggtatcaaggcgacaatgataggttttagtattgaagacctaacattaataaatgcagttttgattgctgttcctatctgtatgttctttaaggaggtttgtttaaaagccaaacaatcccacgggtggcagagactctttgttctagccttcgtcgtcaaaacagacagaatcaggtttgggagcaaggcttctacacaggagcctggaaaactattatgcagaagaagcattttttgttcccctgagtaaccaatatagttagtaggcatgatatgtgtataaactgggatgtatctcctgtgatggagtgacgaggtaactaggtgactttggcatgaccttcccacggaaataacggtgctggaccatatatagacaaagataagctttcacttaatatagaaagaactgaagtgtggccaaaaactgtctcctcacccttgccttcaatgtgatttctgagctgcagactcggaagtttctcacattccttgagatagtggtgaacagtaaaaggtttgggaattggggaactgctataggaactccaccaaaatcatgttgaatcttacagagaaatgggatgagtctgtcagtctgactttcttgtgaatgagaatggtcaggtagctctgacaggcctcaaagaaataggctttggaactgacctaccaagtgccctctgagaagaggactagccattctctgggagcagagggaacctggatgatgtggttctttgtccaaggagagtgtcctggaaaggtgttccccatctaggtattttctctgagaagcagaggatgagggctgaacttgcaggaagccgagaggaggaagtaaagtcaggagaaaatctgcctggttaaggctgaaatttggggactcatgatccagagaggttctgtaatgcctaaccctggttttggaggccagggattttcattttgactggcttcactccttggcttattaaatgtctttgactgagtggctaaaccaccctaagccttagtttccttacctgtaaagtgggaataacacttgtttcagaaggtggttaagaggattacatgacataacacatatgaaccatttagctagcgtcatgcctgtcacatggtagctcgtgaaattttagcagctatttttactcctagttttactacaataacctgactgggaaagcgtccgtgggcagggcaaaagggaggagccgtgaagataatcaggaggtcagcgttagagtgggtaccaaaacagccagagaactgtttgggagaagttgcctccagagcactccggtttggtcccctccatcagggcccactggtcatcgggtaccgtgtcagtcacctgaatgacggtgagggctgggccaataccagctctcccaggcggtgaggctttccttccacacacacaggcttcatctcgtaaggctcttggtgggagacacagctggggcactgctggaggaagggtcagctgcacagacctcgcggccctctgcccagtccctgacgtcaaaagggccgttcattcccagggctgctctctccacccagctgctgggtctcagctcttttcctgggaagcccggcgcttcccgggtaggagattctatcccgacagtctgttctagctcccttccctgtttgtgactgtccctcttccctcccactcgcctcccacgctgtcccccacccctgcctggtttccaattttagcggtgttaccagggcaggttttcaggaagcctgctccagtggctctctcctgggccatttccacagaggctgtgtgcccggctaccattccctaaggctcagccattgcgcccatctgttccccgggctgcagccagcgagcatctgcggggggcggtgaaggctgaggatgcccagacaaggggcagggagggctggcccacgtgatggccaggggagtgggatgcccaagggaaatgtcataaagggtccactggttgggaaaaaatggaaaatggaaataaggttaaaattgaaatgtttttaaaaagtgatttgtgaagacttaaacaaatttctttcaaactgctttattactcatagaaattgtatcaatcaacagtgatcgctaaattgctggatcagtcagaaaatattgttgctgctgaagaatcaatgctaattggatcattagggcattattacatgaaacacaaatagctcaggatggtcgctctttgcttggcttgatctgtagtcttcagagaagcagagaaacctcgattgtttcctgctcagctgacatgcagtttcccctcccttgctccccttcttgctggagttaaaggtggatgctggttgcagacatttccccctatttagaaaaacaaagacgtaccatggtccttgaaatcagtgatattgaacagtcctaaaaagtagagaggttaaaaagggatttggattgcattttagcaatcttctgttggggtctgtgatgtgtgaagacacatctgcacctttactgaggcaggtagaatccaacaaaagccactgatagggctccaggcatggggcagggcctgcactgagggttatggtgacagcggcctgagccacaagctggctggaaggactcctggaggggtgagacatttcataagatctgggaggccagcgtcagcgttgggcacaccatcccccagagtgcctgatattggtgaccttgctgcatggcggatgctaatgggtattgactgaagggacaaggtgccttctccacccatgcttggtcattagcacatggttaggtgggcacgcgtggcctcctcttccacctctcttttggccattttccttgccctctcccccaccccctgacctctggcagcccagagctcccctcagcagtgctcacccaactccctcagggcctgaatttccagggtgagagtcccctctctacaccgtctcagtgggtgcttctgccagggtgggatctcgccagggattatgcttgcatcttaacaggaatttactggggatggaagtattaacccaaatggagttaccacagaggggatttcacatgtttctcaaataatgccagagtgagccaaggtttacataaccagtacgaggtgaggggggtgggaagagggcaagcatttccttgcgaggctcctggcagctttatttctgacttgcgagtggttcaagaagcctccatcctcccacgcatggagaagaccagcattgactgcagccccgctatgtccccgcgctggcctggctgtgtattgtcacatagatgatgtcatggcagccttagagaaattctctgaggcaaatcatattgtccccatttttaaagatgagaaaccagaagccaaggatcctgtaatttgcccaaggtcacgtgaaagagctggagttcaagtcatcccaattccagatctttttatcatgccatgttttttatgcctccccccttgtcccagagtgtggcaagcagaggagagcacgcgtgtgggatgggatcaattgcaaaacgtgtgcagcctggccaagcaggtgggggagtggcaggaccagctatgtgtattctcatgctcaagttcctctgggtcttccgaagacagatggggcaggtagttccagctgctttgtgccttcaccagctgagcactggcaggtggggcatttttaacctcacgccttgactatcccctctccctgtcacagtcagctctgcctattgtcctccgtggctcagaagcagctatccttaatcattcatgggggaattttgtggaaagatccctcccaatgtggctgcatctgccataaagtggagattttttgttatgtttgatcccctgctgtattcccagagaactcagtgtgcctggcacgcagtgggtccgcagtaaatttttgaatgaatgagttcgcaaggcgtttctcctggttcttgcccatcagaatttccatttctcctgctccctgggctggcactaccatgcatggtgcccttgtccctgccatcgccatcatcattcaagctccctgctccatcttgcagcctcatttcttagctgtaaagtcttcccagtcctccattgtccttgtgccctctgcatagcccctcctcccagtcaggccgcatcctccgacctggcctcccacctccacgctcagttttcccagccatactttgctcttgctacattcctgccaccctatctcctgggagtctctttgtccttcaggtcagacaatgcaaacttaaatcttgctgaaataagcaagaaaggtacacaggtgcaggaggagtcttcactttcccgcagaaacatactcacttccattgctacacagagacagcaatgcaaggataatgaaaactagctactgacacttggcctccgtgctggaggaacaatgggggaccagggtaactgtgatgaactgaaatgacaggtgtttcctaaaggtggcggccacagcagacggtcatcactgaggaagtctgtgcccgctgttatgagctcttctgacttttcaaggcaaaaatttggattttgtatgaaacctactgtttcttaaatgatgactcaaaaaaatttattcttaatcaactatgtcagtggcctgttggcctctacttcagggagtcttcctagattattgaggcccaaccggattctttacttcctacctgctcctagttagtgaagcatcgtcatggagaggacagacctctggccaaagaacctaaagacttgggccctggtcccgggtctgcttccagcctcagtttccttgtttgtaaatgagagcaataatatttggcttgtccaataatctaccatggtacagctgtgtggcttgtagtttcaaagtgctttcatatgcgtgatttcatttgatcctcaaaagaaccctgtgtggttagcaggggcaagtgtggttattcttaatttaagaggaaagaactgagggtctgagaggtgaagtgacttacccacgatcatagggtttataattggtagagctggctgtgtcatttgggtcttttatctgctgtgtggtttggtgttttgtttgaacttttggatagaatgagatctgtctttgtaagctgttaagtgctatgtgggtgcataagaaggagtaaggagcttacttatatgggttattactaataagtgtatgccctccatttcctcatagtgtggcactcatccatacaccatggtaattgagctctgacgatttgatatgtcatgatcttacctctctaaccaggttgtgtgtgagtacctggaagcagggatgaagtctagtgcagagaggcccatagaatcatttggtaagtaattgctgatgaattgaatcataggaaagtggagatgccacctgagagagaaccataacttgaaaccaaagctgggctgtgcctgaggttagtcaggggcctggtggctcatagtcctaaaccctcagctcatggtctgctggtagccactgatcaaacatgcatgatagcacgtgtgactgctgccatcagtgcgatcaccatccaagaagaccacatggggggatgatgagaaggtatgaaatgacatagtggaaatggcattttggagtcagatctgggtttgactaatccctggctgtggggcaacttaactctgttgagccttagtttctttacctatataatgggataatagtagctacctcatgagtctgtccctggaacaggccaggtgctcaagtgcaatgtgtagtccagttataaattgctttgttagagcagtactcacaagggcactgtttatctggttttgccaatgctgggcactgaattcctcgctgcaattgtcagatgaggttcagtcaatacaaatattcctttataacagtactggtaggagccttttaacttgaggttttattaagataataaagacaactggagaatgactaggtgcacataagggaaatggtgctgttttcaattaaacttcaggccaactatgtacaactatggatatagaactgagttatgatgtggaattccagtttctctccactgaggacctgggtgaactgttaccagagagaagcatctctggagagctcccttaagcatcctgcccactctgtggggccatcccctgctgctcttggctcagattcatctatctgtttcagggcctttgccctcctgagtctgtagttagccacttgctccaagagtctttcagctacagccttcattaatttcattgtgaaggggccttcggctcccctagcatgcgttgtgggacgtcagctgcctgctgtgctcattaccactagcccaggaatgcggtgttgactcatggctgcagctccgcttttgaacagaagcactcagggcctgagcctgtatttatcactaggcagggaaggtcctaagggaaggtgccaggtgaacacagacctcatccttccatcattacctatgcaaaacactaaatacagtcatctcctccggaaactgccccccaggtcccagcagtagttcaggattcccctgttaaccatgttgtgcccactacctttcaggctgcacacacttccctctgtgtttagagagaagggaatgcagaagtctgccgtgtagggcatgaggggtgaagccacaggtcagtcctataagcacctcctccttcctagagcagagccatcacctgctttgggctgtgccaaggctcttgttgagcagttcagtgcctcacgtggactccccctgcaagaattcactgaggattattggttaatgctgataaagcacttgggctgtaaatatcaagtttaatgttaataaacagggggattaggttcatttatgtaaaagggaatgcttcacaatggatactgggcaggggaagactttacttttatcaacaaaaaacaaacagagtaaactgtaaacccagacccatcgaagccaaggccttcttgtctgctcaccctgacattcccacagggtttttctctggggctgtaaatgcaattctgctgctgaactgattgcctgaacgtacttgtgtgcttgatgtctttcaaaaagaaagtgtctaggaaagtgcaaaagaggagcaggcaagacagaaacagcatggccatgtggaggggccgcgctgatcgtgagagcaaagggaattgtattattctttgggatttgcatactttaagaaggtggttcaattaatggcattctgttcctcctagttgaagacagcaaaatggaagcataaggatttgctgagtcctccctccaggaagcttcttagctgagccattctcagctccattctccattgagaacccttcagcacatgcatgcttgcttagccacccgggtttaaattttcattgactgaacagtaaaggggagaagcaaacacacatgagatctctgagcagtgtgtttcaggtgctttataataaacctctccttgccgggagagtgtcatcccatttcacagaccaggcaactgaggctcagagcgggtggtctagaatgtgcccatgcttgggctcctttccttgttcctcccaaaggcagcagttatactatttcctttgtgtaaaaatatttatctttatgaccccagaacacctagtacagatccatagccatttctctgtaattctgaaatccccaagtctctgaaaagtgaaagttcatttattatccctttgacagcaaaatctggcctttcctgaattcatctggggcagagttgtcctaaactgacacaagggtagttgcagtcttatttaacctgcttagagtgaatattcatatgatttactgcagaaatacgttggcttctggggcccttcaccctgctgtgctattacatacagtagatatgcaaatgactttacctgacacattctgaattctgaaatgcatttggccccaagggtttccaataagggaccgtggagctctagaaggccctgcacacagtgagcactacctgcatgttgttgcttagttggagtgaaacctcagtaccctaactttgtgcgtggtacacccatggtgggatggacatagaaccaggccccctgttcagagtcaccacaaagcacctgccgttagggtggcaggaggaagggcaagcaaacagagcaagagaagatggtgccggcagcaaacagcacagggcatggcgtggggacagttaaggtgaacagtgcccacagtcagtgctgtggcaggacaactgcagtggggcaggctcggcagagctgggcaggggatgcagatgctggagaccttgctgcccagcagatgagagtggacccaattctgtagatcgggggccgaggctgaattctgagcaggaaagtaatctgctgaataggaggctgtagtaaggccttttagatggtggctcccggagtgaacaggatcctgaatctcaggctttccttatcccactgagccatgcctccctgcctgaaacgtgtttctgagtaatagcagctaacacttacacagtgcttcctgtgtaataggcactcctgtaactgctggacccatgacgactctgtgcaattcataccgttgttgtcccctttgtatagatgagaaaactgaggcacaccgagggtaggtcgtcaggtcccgtgagtcgcgagtgtgggggctgtggtgagaacccagccagcatggtgtgtgtgtgctcttaactgctacgctctgtcctaacctgttcttttataggtcccagcaaggaagcttttctcctggtccacaccgctgcctgggcatggagaaacctgctggcacattggccaaggttgggggtgaggggtgatgtcatgacccatccaagaactgtaatctcctgtcttcaaggaggccagttccctgggctgacgcttcatgcatagcggctgcatccctgtctccccacttctccatccccttccaggccgttcttcccccatgcacacacatgcctacacatgcctgcaataactccccgataggtagaattaaaattttgaaaaacttaagctaagactataaagtaagaaaggctaaatcagcttccttccttcttccctttgactcctgcaaatctgtagcttccttcaattcattctggaatttttttccagttttcaccctgattatcctttattcttgtcttaaaaataggcaggacattttctttgggcagcggggatggcctgttataaccttgctctctctatatggtcacagtgcattgcatggaagttgggagcaccctcgccttttcctgtgaggtcactctttgatttcctgcaccctctctgccctgtcaatgccgcagggtctgtttttcctataagtctgatgctctcttgtccttgaactccttttccgggtgggttttaattagctaaatttgcatgtgacaaaatgagatataaccttcgtggggaaattcctcacagctttctaggctgggagaaatcgaccatgccattttgtgatggagtgtcccagtttaacacggcaatgtgactgcagacttcatccgcctggtgggcactttgtccccatggctgagtttcaggcttcctgaccttcctggtgggcagccacggcgaaatctagacttcctggtccctcctcagttccctatggacgatggcaagattttgcaaagggacaaaaggaaacttttgctgaaaccttctaggtctttaatcacttgttctttttccttctaaaattctggattcttgccgagcctctttgtgcttcctcttttcattctctgtcacctccacttagtctcgttctcacctgctcctttctctttattctccaagggaggggaagacaacttgaattttaggaacaaagcaagaaacagtacatggaaaggagaaaaggtgctgtggccactgcagaggggggacaggtggctgagaacctttgtaagccagaaagaactcttctctcccattctcaaatataattagttatttctaaaattgagctgaatcgtgggcatctttttccactcaaactttttttaacttaaaattaagttctatgtatatatgtgtgtgtgtgttcattggagaaacagtaacaccacacacaacttagctaacctaggaaggtttggctcaaatgtccattgcaaagtaattaagaatctcctctcctatgctgtgtttacactgtacattcccataatgtccacttcctggctgctggactctgctctataaatataaccagtgagcagtgtctctttcatgctcagctcctgaccagttaaggggaggaggagatgagtccaggaaccagagttggatgctgggaatctccgtgctgtccttccagggaacatttctctgcaccgggccaaggacccacgggatcatccctttccattgtgaaggaaccgaggccgcctcactgggctccattttccagtatttttagttagcagcctgcaagtgagtgttctgcctgcagtgctgtagaaactggcagatgctctgtgttgagtggtgtgcaggacagacaggagtcggtgctggagaggcgatggctgcaactggggcagagaagtgagccttcctgtcttcctgggggtgatcatccccaaggcagtgcatcacgctcccgtgttcaaagccgcagtggtataaactctcgaagagaacagtgtctacctttactctggaaagaagtaaccgaaagacaggagcggatgttgcctcctggcaagagggcctcacggtgtggaggggcaatgccaaccttggcggtgacggacttaggttctattatggctctaatacttgctgactctgggaccttgagcaagttatggtaaccctcagcctctgtttctccctctgtacaatgagcatcacgatagtcctgttctcacagagctgctatgaaggttgcatctgggaagcacctggcaccgtgcctggcgtaaaataggccctcaggaaatgttggctattattatggccatgcttgactggcacctcagtttgatgtagtggttgtcacgtttcatttctagcgttctgaataggctgtcagtagagaggtaaggaggtaaggactctggggccagactgcctttcttcaaatcccaagcctgccacttaacagctctctgacattgagcaagttaattcatgtgactgggcctcacttttctcatctgtaaagtgagtatgaagtgacgtatacttcactgggtcatggtgaggggaagtatgcaaagcaggagttggtgaactggcgaacaggccacatccggcctgccatctgcttttgtaaataaaatggtatcagaacatagccacacgtatccatttatgtcttgtctgtgactgtttctctgcagcagcagcagagatgagtaattgtgacagagactgtctgtcctacaaatcctaaaataaaatcctaaaatatttactacctgaccctttacagaaaaagtttgttgccctctgattgtaaaaggtttaaacagtgtgtggcacagagcagatgccaggtaaatgtttgctgttattcctgctggtactcctctgcagttcgtcacccccaaccctcacattagctctgtgaagtgggcacacagaggtgatgattgttccctgtttattgcacctgggattcaggggactcacgtgacctgtccaaggtgaggccaggcctaaaatctagtctagggctcactcggccggtggctccgaatcagtgacatctgccttgccttctctcttttttttttttttttgagatggagtctcactctgttgcccaggctggagtgcagtggcgcgatcctggctcattgcaagcgccgcctcccaggttcacgcgattctcctgcctcaagctccgcctcccgggttcacaccattctcctgcctcagtctctcgagtagctgagactacaggcgcccgccaccacgcctggctaattttttgtattttcagtggagacggggtttcaccgtgttagccaggatggtctcgatctcctgacctcgtgatccacctgcctcggcctcccagagtgctgggattacaggcgtgagccactgcacccggcctgccttgccttctctttagattcctcaaggacaaggatgcatcagtccatctccctgaggcatggacagtgcctcacagagcccacccagtcagtatctgcggagttcatttgtcttctgtgctccacctggccagcatcagcactgagcactccaggaagagacatttccaaccctgggccgttcacctcccagcacctggagttgggagcactcagcttattaacagggcagaaactcccaggttgcacgcacagcaccgaatcctgaagggcacaggccaagaccctctctccatcccgagacctttagtcaggattgtgggtgtggttgatgacagctgatatctgggtagcaatttatggttcactgaacacttttacatccatgatctcatttgatcttcatagcaactactcagggggacaaactgggtgatggcctacgctgtagctgaagtggagagagactggcacctcctccaaggccatgcgttaaatacccactgagccaatggagccctggtcatccatctctaatccagtgacctcccaaccccagccggccctcctgacttgatcattgtggtgatgccagtgctgtagccttgggcactcattccattgtctaatgaccctcactgtccaataattcttttttgtctgtaatggaaattccacatgctttaggggtttgttctgctctcagtggagatgacgacaagccacccagaataatagctctactttttagtcttcagccttgaagctgtcctctccctaaccagcccaggctggctcttctgtccttgtgggtttgctggaacacagaccatcccatccaccctggtgacttctaccacatcctgcacttagagcaacttccagcatgacgcagaaggagggacagtgtgttctgcgttggctcagcccgtctgcagaacagtcatgtcactttggaagagcctgagtttgagagggatgtgtgtctgctcatatgaatacttcttgatcatttagtttctgtcatcagtatctggggagtggagaatcgttgctgagggcttctgaagagcaggggagaaaatagatcacgttgacagtcagcataaggtcatgggggtgaagggcaaagggaagctgagttgctgctggacagtgtggtctactgacatgtctcctgggatcgtgaccatcatgagggcaggcggtcaatggctggtcagagctatacccagctttctagtacagtgatcctaaaggacatggctgaagcgtgttgaaatcctcctttgtaatgaaaattctcccctgcaaggggagaagtagcttctatgaaatttccagcagaggtttccaagccagggaggttgaggtaggtcagggaggccgcaggtgcttatctaagtggcactgccacagtctttgagtttccattactggcctcctggattcagtggagtcctgctagacgttgtcattgcagggcaaccaaacccagccccgggcccatgggaatgaacatacatatcttctaatggttagagaaataaattgctttataaccaaaatacccttttggttatgtgtctctcttggaaaaataatcagaaacagctgccctgcagttctccagagaatggagtcttcctagtttccatgaagcgaaaatgtttcggaaatcagaactgaatgaggctggggcgagaggtggggctgaggatggactcctggcacctcctctgattgatcctaaatcactttctcactctggccttcggtttctgcatctgttaagagggctaatgaaacctgtttcttactgcaacttgacaccatgaaaatttagtctctcatctgcagcaggcttaggcaaagtggctggccacataaaacagcttgaatccttgagcatggtggatggagtttgtttaatgagtgaagctgtgtagcccactccatgtctgtcctaccattaaaatttttattgttatttgtgaagtatccactggagttcagaaaaagactgcacaccactaaatcaagttggctcagctcctgctgcggttaaaatgagtgctgtaaccccaattaataacgatttttttccaccagagatggctgcttggatgaatgtattatttgctgggggctcttgtggggcttgcttgaagtgtgtaaatagtccgcctgaaaaagaaagtccaaaaaagggctggtttagacagagtggcctctgcaatctggccacagtcaaaggcttcttcacatcagcagctctgatacgatacacaaacgtttgggttgtaggacagtgtagaaagaggaccctctgggaggccaacgtgctgagtggaaggtggaaggacatggaaagcagcaaccgtgcagctgaggctaagaagccccggagcaggcttgggggcttcttgtgtgagtcatcatttgtcctccactgtctatcaagaagcagggacaagagttatgcactttaaatgtcaaggttgcctttgtaggtggtagaggcctggtgggttccaggagattattcaggttctatgtagagcaaattccagatcagatgaaggtgtttgtgcggggacagctgtatgttttctgttacagacctgttaggtcaaaccccttctttcttttttctaagctcttactcttccccagtttttacttcccaagactttcttgggtccttccaagtcctccttagaggatggcactttgctgggtccatgggtttaactttttttttttttttcagtctttcccatacattcgagttagcttgaaagtgttgatggccctctcccgcaaaaggaatatcatttactccctaccccttgtgttacatgggcaggggaaggagggagtttctagctcatgttcccggaagggaaggtatggcaggaacacatcccacttttccctgtctctttatgcccttgtccccaggggagaagtgacctatctgactggtgagtttggtgtagccccttctgggactctcttttgaatccacttatccccaaagaagggttcaccaagttattgggactgatctggccctgtggggaaaacctgtgatggtctcaccttctggcagggtaagtacatttaatagtggttgaaatattaggaagtccttcgaagcccgtctaagccacttcctccattttataatttgtttctaatcaagcttttggtttgatttaatctgtgtgtcctatatcttacttcttaattggttctgagtttataaggggcagaaaggatgattatttattggctgccacccaaaggcttagaactcctccttggtcattgactgatccatgtggaaggctctccaagcagctctgggtacagtggaggccaaacatatgtgcatacttttccccaccagggtactatttgcaagtcattggaacctaagtccgtggcttctgttttctaagaacatctgctgtggaaatgctattcttttcctctttcttcatccctgaaataatgataccttcctcgcaggagggtgttgaggattaaataaaatcaagcacattcacacacgtaggtagtcagtaaatgtcagtttctgcctctccgtccatccactggtaacctacattgtttaagtagcgcttaccactattcattctgatgtccaaagtatgcctctcatgttgcaatggaagatttcttctatctcattgggagcacttaataacctttaatacatgatgtgaaaaccttctgtctcacatgcctgatttatgggatcactggagagagaaaactttgaaaccaacagggaagtaagggatgcgtactgagtgggagaagcaacagtactgggatccaggggagggctggatgggaagggctcagtcatggataggactgagggtgtgctggtgagcctggaagccatcactgggtgaccaacctcacctgggcacttcttagtttggatgtgccttatttaaagtaaaacttgacacagtccagaaaaactcgcaatgcaaaaacaactcacttttctggagctttactgtgtgtgcccagcactgtgctcaccactcgagagcccctaggcaggcaccctccctccagttgttctcagggagtggggtggagagtatcagtacagaggagagcctcaaacgaccccagactctgtctgtcagtatgcttctggaggatgtaggctgagtcttatcttctcaaccgccagttgtctgtagtggcccttccatttcatgtcttccttagacacatactccagtctgttgttttgagtgttggctgtgaactctgtaaccctgtattttctgttttcctcttagtatgagaacgaaggtgtgggcccggattgccccattactcttgtgtcctgtgcaccttttgtatcgtgctgcggcaaactggcacaggggatgtcagctccgcaccctctgctgtggattgtccagggtccaggcttccccttcctactgctcacccctgtcccctttgctgttaacacctgcccgtgggataagggaaaagaaaaaagccactcaaactactccattgtgagatttgctatggagtcagggctgaagtggggttggttgacttgcagaatctgtgaatgggggacgatatatgttgagaaagtgcctgggtgattctgatacgtcccatctacactttgagaactacaggttcattaccactgccaagaaaaagatcttttcatatccccccgtcctctcttcacttggatggcagttgagtctctgaaagagattcatcccgaaggtcttttaagtgaagagaggcaaagcttagcttagtatttcctttctgaagagcacatacccctgtgtaaaattgaggagcaacagccttaaatggaagcagctgtgattccccgcccctgtgaaggggctgtggccctgcagatgccacggctgtggatgcgtagagcttgggtaccctccctggcttcatggctgacctgctgtgtgaccttgggcaagtcagatttcctctctgtttgccatctgcaaaatatggatacagacccgtgctccctcctggttttactgaggtactgtgagagccagtgaaatcacggttatgggatgctcagcattctgctgcagaaaaaaaaaaaaaaaaaacctagttactaggaaagcaccattccccaggtgtgggagttctcagtacctgtgtggagtttgctaacagacctggggtcattcggggtgtgacaggcaggccctctctcctagatccaggtccatttactaatgtccttgcccatccatgcctgcaagaaggaagagatgtctgaactgccaggaggtggtggctacagatggtccctggcacagcaagaaggcagtgccaatcaaaggaggtcggcctcttcaattagaactctgagcagatggggctgaggcagccagaaggggcacttcccagtttactaagtgtgtgacagtaagctggtggccttcagaagaccaggagggtcacctggttcatttcctttctggaaggaagggcagtgtttaggataagtcagatgagattcctcctcattggacagataataagctttattgtgagttaagcaatatgcttggccctacggatatcacattaaacaaaatagacctgaccctgaccttactagtttacaatcacacgatcctgaccttactagtttacaatcacaggatcctgacctgactagtttacaatcacacgaccctgacctgactagtttacaatcacacgaccctgaccttactagtttacaaccacacgaccctgacctgactagtttacaatcacacgaccctgacctgactagtttacaatcacacgaccctgacctgactagtttacaatcacacgatcctgacctgactactttacaatcacacgatcctgaccttactagtttacaatcacacctcctgtttcttgccacttgcacacaactcagggatggggtaggaggaggaatatcataaatgcaaattcctgtgccttacactggagctactagatcagactacctggaggctaagcccaggaatctacatttttaacaagcttcatagttcagccttgcacatattaaattttgagaactggttacttctccatcaatgcatggggtaatcagtcaccttgggcacattggtgtcttaaaaatgacttaaacacataattggaactgttttgctaagtctagcctgtgtctacgttgctagaaaagccctttttccccttattctgatggtatagaagaaaacaactgcttaaatcaaatgaattaatgtgttgattgagctttcattacctgtctagcttcatgctgtttggaaaataaatataaaagctataatcctggcccctgatgagcgtacagggttcttgagttgataaaacacaccagttaaccagttagagatgacgagaagatggtgcaagattaagagccaggacgtaaagcagatggcgcgtttccaggggtagagaaatgaggacatcggcaggtcagcattgcagccacatcctttctagccatcctcagattccagcctaatgatcagttgtaaactcctaaagaacttaaaaaaaatcctggaaaaattcaggagattcagggtgtagtataggaatctgtttgattaaaacactccacaggtgattctgatgggtgtttccaggtttggaaaccagcatgctaccttttaaaatagtaaatggattagttatctcttttttagagggggcatgagaacaacagttcctttatccattcttctattacaccagatatgttacagttgcactcaaaaatcgtggtgactcaacacaacagaatgtaaacccaatcaggacgggggtggctctgctccatattgtaggggaccagggctttgctgtcttcgttggtggctttccaggcctccctgggtgttaacatccagcactcagacagtcacagaggaatgaacacagttgtttgtaatggcggccaagatcgtccaggcccggaagttgtgactatcactttcactgacatttcactggccagaagtcagccatgggccacacctgtctccaaaggaggttgagaaatgtagtccagctgagtaccctggaggacgggaccaggctgtggtgggacagttcagtcttctctagcacagcggtctccaacctttttggcaccaggaatcagtttcgtggaagacaatttttccatggaggaccgagaggggatggttttgggatgaaattgttccacttcagatcatcaggcattagattctcatcaggagcatgcaacctagatccccagcatgcacagttcacaatagggtttgctcccatgagaatctaatgctgctgctgatctgacaggagctggagctcaggctgtaatgctggcttgcccaccgctcatctcctgctgtgcagcctggttcctaacaggccatggaccggtacctgggggctggggacccccgctctagcgtgttcccttcctctccaagtctttaagcattttcattgatctcttctcctccagattctcccaggttctcaagcagtgaggttccaaactaaggtttaactctctagtcttcagaatgttcttttctaactgttagaactgcaaagacagccttgaaatggtatattctttatacctgttgcctccacttcacttggtcttactgttaggtttaaccttaggaaatcactgatattttttgacctacagaagcggcattttcatacaagtgaatgctacactctcaacttgattgaagagcaccctcaatctgccttcagcacgtgcactcccactctgcagtaggcagaggtttgagaaccaagccaaaggaaagagaagagggaggcagagtttctttgtactacatctcatcacctgctgtgtttggggtctgccctgtcccaccatagtaaagctcatatcccacctcttcctgaaaccttaataatgacatcttatttctggttatttgccagaagctttcacacacatgatctcattcattgctttgaggaattcgcttgtttccgcctctcaatttatgagataatgagagttatgtaataattcccttcttcagtttaactgccaggaaacttaggccagcatttgtgattagtcagaataattttactgtgtgtttttggttggtatatattgttttaaaatatgtattttactcattaatttttgaaaactcattttttcctcaagttttttttttaaatgtgaaattttaaaaatctcaagttcttaaaaaatgatgtgggataaaacaactaaatttaattatatcatcgtctttggaggacggtgttatcttcatcttgcatatgtagaacctgaggtccataaaaaccaattttccgagcccataaggctcctcagtggggtaactgggactgggtttcccaaccagatttaatccagggccccttctgctgtatcaatgctgcccttccagactgtccctttcatcatcactttaatctcttccctctcgatttcagataactcgtattttaagacgcctgaatattttctatcttattattgtagatatgtgagcatcagctccttaaagttaccgaatatttctgatcaaattctggttatttttgtctcattaaaatgaatatttaagttttcaggagagaagaaggcacaaatctcccttaaaaagtaatccatttgagagatggattaataaagtaatattatgaattcaatataaattaacatatgtgttttcaaattccaaaaatagatgagggagatggaattacactagtgagttcagcatgattcctaaccaaggccttttcataagtggaagtctttcacctggccctggggaaatcacggaactcaatatttccttcacttaattgtttttcttttccatttaaggaaaggtagcttaaagcagtggttctcagaatatggccctgaaccagctgcatcaaaatcacctgggaacctactagaagtgccgattctacaaaaaggaagctccccacaccccgccctgccccacacgggacccagcagtttgtgttctaacaagcccaccaggtttttgtgatgtatgctgaagtttgagactggttagcttaaaacagcctctgagaggggctgcaagccactctttatttggatcataactaagtagttaaaacatccctgagtgaattcaaaatgctaatgaggaaaattaatgtctttatcaaaaaaagaaaaaaagaacaaaacaaacctcaggagaccagaagtaagttgcctctttaagaagcagagccgctttgagatgttgcaagggggagctaagagcagggcagaattttccagtgtcttttgacaggaggaagtggttggggacgacttatttttttggcccggagacagcctgtcattattagactaagcattgtatcagatctaagtgtgtagctttcttaatgtaatgcagagcaggagctatacgttttgttttgtttttcattttatcagtaagaatgagtgcattacagcctgggcaatgtagcaagacctggtctctactaaaaaagtaaaataattagccaggcatggtggcacgtgcctttggtcctagctacttgggaggctgaggtgggagaattgcttgagcccaggaggtggaggctgcagtgagctagaactgtacttctgcactccagcctgggtgacagaaagcactagtaatagctttgtgagctaagtcccgctttcttgggtgttctcatggtcatgctcagagaatccccctctccccaccagcatccaccagactgcacactggtgtgcaggagaaaccagcttgcctggcagcctgggtccagcagtcccaaaccatcagaaggaagaccgacatcctgcacctccacatggtcactaattccctgctgtggggggcacattttggcctgacttggctgacacaatctggggaaaaaagagaagtatgggctgagtactgtggctctcactggttaatcccagcactttaggaggcagcagcaggaagattgcttgagcctaggaattagatcagcctgggcaagatggtgggaccttgtctctacaaaaataaaaataattagctggccataatgccacgtgcctgtagtcccagctacctgggaggttgaggtgggaggattgcttgagcccaggagtttgaggttgtagtgagccatgatcatatcactgtgctacagccttggtgacagagaccctgtctctattaaaaaaaaaaaaaaaaaaaagaacaagaagaagaaagagacagaaagaaaagaaagaagagagaaaaggagaggagcacagattgctcaaccccatggaggcaaggctctcacttctgctggtggggccctcggcccgtcctggagtcggggtagcatcatggttgagatcacatggactccttggctaaagtcctgttttgaacacttgttggctgtgtgatcttagattaggcactgtttctctctgcctcaacattcttgctcctaaagtggggttaattatatataccttgcagggctattctgagaattaaatgagttaatgcagaagttctgagcctttttggtctcaggactcctttatattctcaataactactgagaatcccagagagtttttatttgtgtaaattatagctactcatgtttattgtattagaaatcaacttaattcattaaaaaaccgattgtggccaggtggtgtggctcacacctgtaatcccagcactttgagaggccgaggctggcagatcacaaggtcaggagatcgagaccatcctggctaacatggtaaaaccctgtctctactaaaaatacaaaaaaatttagccaggtgtggtggcaagcacctgtagtcccagctactcggaaggctgaggcaggagaatggcgtgaacctgggaggtggagcttgcagtgagccgagatagtgccactgcactccagcctgggtgacagagcgagactccgtctcaaaaaaaaaaacaaaaacaaaaacaaaaaaaactgattgcatgttaacataagcaatattgtttctgaaaaataatttttttgtaaaacaaaaaaacagaagagtgacattgctttacatttgtatagattagtgtctgacttactagaaaacagctgggttctcatatctgctctgtcattcagtgtgttatggtatcacatcatgtaggctctgggaaactctgctgtgtatttgtgagagcattacagtgaaaatgttagagttgttataaaaatagttctctcctcacagatacacgaaaaaggtctcagagatcctgctggggttccttgggacacactttgagaaacactggattaataagtcatgacaagtgtttagtataacaccttgcatatggtaatcactgagtaaaacattattacaaacagcactatttactaggagatatagcatcagaggtggttttctatacatatatgggccaagctctagaagggtccttgtgcaacacacacacacacacaacaggtgcttctgctgttgccaccagcagttccatgccatcccatctggctggggggagccctgaaagtgtctggatgtatctgaagctgctgtgctgggatgtgtgcagtactaatatgggaatgacagtgagtggacattgcatcacatagtagcctttcctcctaggaggcaaagcactcacctccccatcaccctgcagttatcctcatgggggagggagccagtccagtcccttgggaaggcagtgccagggccaggacctgaacctgcctttctgatctacagcagagtcaggctaaagagggcaggcagaggctcgccaaggggcacagtggagtgcttcaggactcacagttgctggggctgaatgctggaaacagcttgtcagttcaacccaggagatgctaagatgcaggctagagtcgatgacttggtcctcccatcaggggcttgcagaccatgtgacagtcagctggcactcccttgacctttctgttgagtccagaaaccatagtgcaagcagtgggctgaaagctgtggcaagctgctgtgttggcatgtaatttggaaagcctattcacttagccacctattaaacacctggtgtgttttgagtccccagtctgttttcttgttcatctcccaccaagggaaaagcaacattgaccaatcaaaaggcaggctcagtcttgtagtctcagtagtacagtcttccctgtggccaagacggtgtcttcagcatctgcagtggtgtgtgcagccataggttgacaatgaaatgcagggagccaggatcaggaatctgacctgcaccaagagctgtgggcagaacagaccagcatctgtgtgatgctgtggctggtggtgcaggaggccaggaggcatccaggagccagagggatgccttgcaggactggggtggggtggaggctgtgtctaaaatatgggatgaatgctaagaatcagaaagttagtgaccgcaggcagaagctcagaaacacacagcagatgtgaaaagtgctccttgcccctgctttttaaatgttatctgaatgcccacagtgggcagaagctactattcagtcaacaaataatggtcaagggctgggcattgttgtaggtgcatcactagttacctcagtgaataaaacagacaattcctacctgcaaggaggttgcacttttgtgggaagaagaaaataaaggaaaggagaacataaaggaaaaaatataaatacgatacataatattagacacagtggagggatgaatgcagggatggagatagggtgcttcagggtggggttatagcttttaatagaggggtcagggaaggtgttactgtgaagataacgtttgagcagaccagtgggaaatggcgaggtaagtgctgtggatctggggagagggcattcaagggagcaggagggccaggtgcagaggccctcaggtgggagtatgcccagcgtgtctgggagcaggagggccaggtgcggaggccctcaggtgggagtatgcccagcgtgtctgggagcaggagggccaggtgcggaggccctcaggtaggagcagggaggaggcaggtatggctggaacacagcaagtgctcagaggtgaggtcagtgaggaacagagggcacttagggtcttgtaagtcattgtgatgactgtggtgctaacttggggtgaagtgtgaagctagtggaggctttttagcaaaggagtgactgatctgttttgaaagagaatcattgctgggagcttctcggtgttggtagaagtgtgacggtcagtcaggaggctggatcagtaatccaagaggcagatgttagcagcttggaccagagtgataaaggtggaggtggagagaagttgctagatccttgatacattctagaagtacaccagaaatgatctgctaacagaccggacatgaggtatgaacaaaggaagagggaagatggactctatatcttggcttgagtgaatggaaggctggagagtcaccatgatccgagatgggcaggagctggttggggtgggggaggctcaagaattggggtttggacatgccaagtttgagatgcccaagtagagactgactgtagaggtctaggctggagcaggcagaaagacccaggatgtgcaaaggaaagagggaaacagcagcagtagcacttgttcagccaagtcctgcctcggagatcaaatgcataaaggaaaggaaatctcagagccagcctctaaccctgagcttaatcccaaagagcagcagagtagcctggggtatccacccctccaccccggtggtgctgcagagcccctgttgcactcacgggtggcaagaggcagggctcaaagcttacctcacaggtgtgactcccagggagtaggggtagggtgaggaccccgctggaactggaatggactctcctgtatagtgatgcctcctaagcctggggatgcctctgcaagggctccagggggctctcaaagaggagcaggctctgcctttctcagatcagccctctggctctgttgttcccttgggcctgtcttcagataaccacagtaatccagggagatgaaattggcagatcagaagcccttgattagacctgcagaatgtctgcactgacaagaactgcagaaagcatcccgttcaactccctcctcttacagatgggggaactgaggtccagggagatgatgggacttgtccaagttagaagcttcatgacctagggcaaatcacttaacccttgcaatcatgccaagttgagagcattttcctaaatgctgtggctcagagatggctgtgtgctcgtggttcctcctgtttctccctaaccctcttccacatgggttttttactgcccgatcagggtttggggaatgattggcagcccggaggccagccagcccttttggcaatccagtcaaatctgcccactggctgatgaaacatggactcccttggcagcgagtacttcctcaagagatatcttgcttaaaattgatggcccccctttggctttgctattccccatgcccttggtggggcagagagttagttccatcccaagttcttctccatttgccagagtccacctccaccccagcccagagctgtttgctctggcttgccctatcctgcgttggctcctttcactctctgcaaacccttctgtccttcccgttgtctgagctgcctttttcttgactacttcttaagcctctggatttctccttaaatatcagctctaggacgcctgcctgatgagctgaggtcattcctaccctcaagtgacctggtgaattaagcaacaataccagggattccaggacagtgagtttgaagatcagcatctttgctggcctgagggaggcccttggcctgctgggggtggatagagtgatgctgaccttctgcacaggctttgggagggaacagttagttaccgcaaatgtctggctatctaggtgaagcactcccgaccctctgctcctcaactgtagttgtgaattacagagctggaaacagcacacgggagcatttgttccactcctgtttcagggacaaaacttaggcctgggtctctaaaaccagaggtgcttgatgcttcatcccaaggctaaaggggcagatgccctctctatctggcgttgtggtttcctctacttccaccttactgcagagtggggggctggaacgttggcaaggatccaggactcctgtaccctatctcattctcctcccacacccctgtcccttcattacagatagtccaacctctttgttctgtggttgctgaatagcatcccccaggggaccatcttccctgcaaatgcagggtgacgctgtgcagtggtttctctgccatcatcttttctctgctggggatgccagagcataaacccatggtgcaatggaatgtgcctggtagcaaggatgaagacgcgggggctccagtgtgctccaccccttcctttctgtcagcctgagtgctcccgccccctttgggcctcagtctcccacagagagggagagctgggtggcccagcaatctctggagccccttttggctcagacctcctgcagttctctgtagcctcctggttcccagtgtatttttaaaggatcctgtgttatttatctcagcatctctgcccccctgcgctccacgctcctatccatgcagtaatgacatccaaacacccacactgtatcttaacaatctgatgagataaatgcctcatcgttgggctccgtggacacagagtagcaattctattctgctatcaaagagctcagaaactcaggcaaccaaggcaggatgagcaggcatgtggcttgccatgtgcccatcattgggcaaaaacacattctccctgccccaaagcccctgtttttccccaaagcagcctcactttttcccttcctccacctccagaacaatgccttcgagcctgctggcatttgagaatgggccgggcgggcagtactgggggcatatggccttgttattttgatggagctcctagtgggatgcaccagccactggccaggtcctggaaataattaagctgagcatattgacctgggggttgcagggccttgggcatgctgcaacctccaacacctgttctcatgctccttctgcagtgaccctctcgtgctctaggcacacctgttagatggaacctgggactttcaaggttgtcactgccagggctggcatgatgtgcttgcactcctgctccctttatggacctgggagttgggaaggtgcattgggttccaagagaagcaggaactgatttggtcttgtagtgaaaatagacctggctctggtttggtaagtgagtgaccttggacttagtttccctagaagcagaaataggataacagtaagtcttcccacttcaaggaatgttataaggatcaagtgagatcatgtgaaattcttaggaaagctgcaagggagtctacctatgaaacacagaggccatgggacacagagggaggagtaagggctcgagctgggcaggcctgggtgtgaattccagtgtttctcttcaggctgtgctgcctagggaaatgtacttacctcttctgagcttttctttgctcttctgtcaaccaagggataatgaagctacactgactggttactcacagtgataacaggagtatctgttatttattaaacgcttatgttgagccaggacctttcttcctttcctttttaaaacctccataaaatgtagccggatttgtaatcacacattacttcacgtggactttggctggtttgtgtagtgtctctgtgagagcaggggttctacgggtattgcccggcgctgtgtttccaaagcccagcatgtgcctggcccacggtgggcgcttaagaaatgttcatgcagtcaagggggtgcagctgcctggcaaggagaacccgggaaattcatttacccttcttattattcagttccttcacctgaactctctcaggctggagctgagctttgggttcataatatataattattctccccagttaaaaatgactaaactgaggtcaggagaggttaagtgctgtgccctagatcactcaactaggaactagggaacaaagccttcttgtacagtacttgtcagagcctccttggaagcttgggaaaagggtgtgggcaggactgggcagggaggaaacagctgagcacctgccggattcaccatctgcccccatgaagatacatggaatcctatctctcataacggcctccagccatgcccattttacagatgagaaactgaggctgagagggagaaagaacccgaagctcagctccagccagagagagttcaggtaaaagaacagaataataagaagggcaaatgaatttccagagttccttcatcccagagtaggatgctcagccttgccaggcagctgcactcagcttcccgccctctctgagcaggggggttggaatgtgtctgcggagggcagcgaggaaggagcctgctggaattccttccctgtggcacatctgggaggggtattccccctggtgatacttgggaaatcatgctggcctcgccagtccttttttccactgttcttttggtctcggagcacccgccaaacatctgacactgttcaggatcgattgcacataaaatgaagaatgggtatttaaaaaacaggtttttttgtgtgtttttccccctgttgtcatctaagaagcaggtttttaggttctttgattctctcccagaataacaaccatatggggcctccacttacactgagcagcctgtgccttgtgccagggactggtttgtttccattgtcagcaaaccttgactggctccaaacattttcacttcaggtggtttctgaaagagggaaagactgaggggaaagtgatgatgtggtccctctgaagagggtttagctttcaagggtatggcaggggtggggtcgacagccagaggggtgtgactttgagaagccaactcaccggcaggatccagcgagatccaggctcggtggctggaacaaagaatgttttgaaccacacggggctctggcatgtttgttgatcgacttatccaaggcctgggccagctgctcttgttccagaagatttcatggattaactccctgggctttggaaaattgtgtcttttttaagaaagggaagttttgaaaagcaaatgctcctgggcaggctgggggtgtggggagtgttggctggagtgggaggtcacattcgccccatggtgggatggccaagggctcccagcgagggaacagttggacctgtggtgtcctggggggagggttcctctgagggaccctaatggacagaggagtgtggacccctgagcctgggagcatcgtgggcatttagaccaaaccacgggaagggctccccaatgctgaaggttgctaggcgctgggggaggttccccgggagactgtggctagaaacaccatctgccaaagatgatttagttccggaagaggcaagggatagaacgagatggtcctttctgtcccagttaatcttggtgctgttcattccgggctgagcattcccttcctgaagtggaatggaagacagactcggccttgggcagactctgagcatcttgtgaaagggagagtcttacctccttggctttgtccccaccccctgcccagggtcggatgtcttgggtgcttgccggctctctgcccactgtcctgccctggcagcaggtaccagcaagcctgtgtgccgtgtgggttacagggagtagcgggcacatgattaaatactcatgctttgtcaaaacactgacagttacaaaatgcctccgcgtctactcagggaagggtgagcaatgaggaaaatgacttcaatatgcaaaagacattccaaggagtccgggagggaatgctcattctagagccaggagggagtcatgggaattagttcttgatttatagaccggctgaaagaaatcacctaggttaaacctgcctaaattctgctatctgtgtatgtgcttaaggggatgggctcaatgaactttgagactgtctcttctctactgatgggagtgacagtgaagttcctgatgaaggaaggtttagggtggaggaattctgagcccctgggttctggattcaaaatcatacacagccctctagataacatagatgtacagtcgtacagtctttgtggagaatttgaaaaacgagaatggtgattatctacttaggacaggtttgggtacagccactcatggaagccaggaaccagcttctaaccatggaagctttgtgttttctgtataagctgtccttgactacggacaaagaatgggtaccgagtgttcagttggcatcataataggaaacagaattctacacagatggttcaacggaacagagtttcttgaggggcatatttatggaggggtaaggagaccagcaagggatattgaggcacccagggctaaacttagagggaagctgtcatcaccctagggcctgaggaggaaggggagaaaatactgtttggggggcctggtgggagctgtagctgggaggaggaccatgagggagaaaccatagtcatggaaggatgttgtcactgccaggaccaagacaccaaggtagggggacatggaaagaaaacaccctgccttctctgtcctcccatctccactctcttattgacactgctcattggccaaaccaacctgaagctggagggccagggagccgggcacctcaagcagtccccatgcaccaagcttccagggcacggggtcagggaacagagggtggaaggggtctaggggagccagcagggagctggagctcatttgtaatatttgtcttgtttagccaactctagaaggctcgtcctgagaaggcgagcttcgaaagctattactgactcttaaagtattccatcgtcaagactagtgtgtttaccttgcaaactaccttgagccagctgtaatgaaattctgaaatgtctcccatacaccctccttctctgtgaaatgtcagctttttgagggcagggcctgattcttttatgagcagttgtcttgaatcacttcaaccctccacacctggagtgccttacactttccagaatgccgtactcagtgacccctcatgtcaatgttttgaggcttttgaattggtcaaggcaaccgtcttgctgagtggcctgagttctccagtgagagaacacgagtagtctctttgagtgggggccacagcactccagacgtggtgatggaaccctctacggtatagagagcccacggccatgccacccagccagacaggaactcaggaggccaggatggaggaagcaggagtggaaggtcattggactccctttctggtttaagcttggccatgggatgtcttaagtagggctcgtggtcctcaaatgtcacctccatcctgatgccacaatgtctgtattgccactattccaattcttcttttgggtgaagtcttactccacctgcggggagagcacatgaaatcattagcaagtgctggcacagacagccattcccctctctggccaggctggaggggctggatggtggtggggggtgtgggtgaagtaagcatgaaaggggagatgaagggtgtctagacactccctttgccgagggctggtggcctgttgcttgctctctaggacaacgtggatctgtttggggtaatggcagacacttttctttcgcatccagctgtctcttcctcttctgagtcccacagggtcctgggcccgataggctctgtcacctccagccagtattgggtagccacctgccactactcaggccgggttggaagggcctgtgaggggtggggtgtgggatccagttcatggcttccagggccaatttgggtgaaattcagttgttcttcgactcctgtgtttctacttcccagtttcattctaaatggaaaacatttctgtaggtttaagtccaaggtgcagccccagagcgggtattttcccttttgagaagtggaggctaccctgagccttgggaaaagtactcagagagaatctcccccatgaggcagtgtagcttaaggagttaggtattctgagtacctccaaaggctgttcgctctttccattccagctcagactgcctgagttcaagtcctggtgttgccacttactagctgggtataagttgtttaacattttagttcctcgataccctaatctataaaatggggatgaaaatagtgtctatggtagggaattagtatgaagattaaacagtttaaattgtgtcaaggccaggcatggtggctcactcttgtaatgccagcatttagggaggccgaggcaggagaattgcttgagcccaggagtttgacaccagcctgggaaacatagtgaaccccatctctacaaaaaaaaaaattagcagagcatggtggtgcatgcctgtagtcccagctacttgggaggctaaggcaggaggattgcctgggcccaggagtttgaggctgcagtgagctgtgatcacaccactgtactccagcctgggtgagagagtgagactgtctaaaaaaaaatgtttaagtgtgtcaagtgcagaaaacagtgcttaatgcatgccatgtgccatgcaaatgtttgctcttatttatttcaagaagcatactcttctgggcagagcatcctcctaggactctggagagatggagcatccgcaaggccaccaacgggactagtatcccccagtgttccccaagcatctcttccatcgagctattgccttgctcacaacccctcagtgagttgcttgtctggagatgcaggccaaatcaatcctgtctacaatctgctgtctggctgtgcccattcctggccacaaaccctctgcttcaccaggaaaatctgtttatgggccccattctcctacttgttttcacctctgccttaccctgcctgaaaagctctccttcctcacctttccctccaaagcctatccattcttcgattccagctccagttctgccctgaaggcttgtccatgcctgtggatcaccatcctctgcctcctgcctcctcctgcttccccggctggtgtctgcctcgtatcatcagtcacctcctcccaagcagcctattgctttctctactgatgccttgagccggaagccagacagcagatattccaaaactgaaaacctgtggatttgcctgtaaatttgctataatttcttaagaacacaagaaaggctgaacttcctggaagttattcctagggccagcatcatgggagtttgacggttggctgtgtagagcagtcactccaaggcagttgatttgctttgttgttcttctcaccccatcagtattataatgtggagcttcctctgcattgtgccgtgagatgacagcaaaagggctgtggccactgcctgggacttgatccttcgctgaaacagggacactttctatgactagtgctacgttacatttatccgttctattggacacatgttcgtaggcccaggatcagaataaaatagctccacagctagaagaaatcagtttataggcaaacaagactctgatgttggcccttaaaaagaaactgctcatattacatattacagtttaattttgtccgcgttagaaggtcccagtgatatctttgcttcttgactgtagtctagtgtttaaaggttatttgcccaggtgacttttttatcttttccaatctaaatacagttgtcccttggtatccacaggtgattggttccaggactccccaaccccttggataccaaaatccttaggtactcaagtcccttgcataaaatgcatagtgttttcatataacctatgcacatcctcttgtgtaccttaaatcatctccaggttacttatactacctaatacggtgtaagtgctatataaatagttcttatgatgtactgttttcatttactggtatgatttttattgtcatattatttttattaaaaattttcttttcaaatattttctatctgtggctggttgaatcaccaagaatgcaaagggccaactgtatcaacagctcaaagtggagagcccagggcccaggcacggatcattaggggaagtacagggctggcagagaagaaactggactcccagagccggctctttctgtgggctgggagctcctccaggctgctgggttaggaccagcaggacggccagaaccatggagacatgctgctggttttggagatggggagaggcatgtgaccttttctgggaatcaaatcagagtgaaaccagaagaagaatctagacttcttggggtaacttggcaaacaaagctcagatagacggaggggtgttcaaggaactttgcacgatttcctatgggctaagagaagacgcttgcaaatctgaaagggcaacatagggaaagttcctacagggaagggagacggtcaaccccctctccctgaccccgggcttggttagggggcagagaacgggagggggtcaaggaggctgtctgtttccctcagtgcaaatgcctggacagcacgtgtgtgcaggctgtgcccctgacctgatgagcacctgatgggtggctgttgaccgactgtccatgcaaggggtgtgggctgtgcttggcagcctccagcaggcagggcttgttcacctgcgtcctgtccagcacgcggcaggagctatcctggcctcagtgttaaaaggtggccctgggtcgaaggagtggcataaggtcccacttgggtgcttgataatgatctagagcctcgtgcccttatcttcacggcctcctcgtttatggcagcaagtcctcgtcctgtgggccccatttctaagctggacgtccagcagttccctcagaaagtgctgtggggcccaggcgtcctctcagaggatatgagcactcccgagtcgttctcactgcgtgtgttcatttcactcactgcctgcttccttcgttcagctccaagtacctgctgatgtttctgagctaggagggcttccttcaggtaataggggaagcatgatctggaaaagggaaggtttccttttgccccatggagagacgtcctgagacacttcatcaaccaggaaggctcccaggcagccactgggttgcagtgaaagttttcagccgctggtgactgctctggtgagacttgtgagagagaacagtgacggtgagcacagcagcccctcagaaagcaaaccagggagtggcttcccgacgtgcacggtttctaattcacacggtccctgcataagctaggcattcctgtatcctgttttcacatgaggaaactgaggcccctggaactcacgtagtttgcccaaggccatctaactaggaggccgtaattagtgaagctgggatttacacctagggctgtctgattccgaagctgggctctttccacggtatggtctgagggtgcagtctagagcggggactgatggggtttgtctgaaggaacatgagatggtggagttccaggctggctggtgtggggccccggctgggatgagacagtgtcttcaagtgtcagggatggacgaatgtccctgtcaggagatgttggtccctggcagccaggcatggtggcagcactcccagcctggcctgccctgcacaaaccttcaggcacacaggcctcttgacagagtgatgattgggattccatgcctgcaccagtggtgggagagatgcaggtgaaacaaggcggaaaggaccgtaattacctcctaacaggtttccacatttctctgctgtcagaatggttttgttttctgatttattttgatctgcttgaaaattagttgtggcagtgtgtttggtgtgtaatcattgtcctgctagctagcagtcatcatcagcaatgttagcccggcaaacgtgatctttctttcctttgcccaatacatgtcaggctctgtgtggcaagggcgagggagaggcatgactatgtgtctctgcctgtctgtggaccccgactcctcaccatcacccaacaggggacagtcctgctggctgtgtcttcccggaaggctcgtgcccgcacagattgtctggtgagcccgccagctgtaccgcatcgctctgtgcatgtgacctagctctctcctggccccctgttccatcccacatgcagcctccgtccactgtcccccagctcgcaacccccacgcagccccacccttgacctgccacctccatctgcacctgcttgtggagcctgtgtcatggaagagaggtggcctgaccactctaagcccacagcaccactggatctttcccctctctctgtgagaagacggccagtctcagattggatttgaccttttcgcttgtggtcgggccaggttgagcaggaaaccatcgttagggcacggaagcataggtgggagaagacagccagcactgtagagtggggagggctcagtgcttccacgggtggatgttcagcagcaggccccctctgttctttggtgaagcttgtctgcagcgagccctcaaaaaacatgggttttgagccagacggaaagtcatcaagcccagttacagtcatcccttggtgtctgtggggagactgattcctggacccctctcagatacaaaacccaaggatgcccatgtccttttatgtatgtagattatatgcacatactacaccattttatgtattttacatatggtatattttattttttaatttgtataattttttaatgatttttttttcctaatattttttacccaaagctggttggatccgcgggtacagagggccaactgtatttcattattcagagcagaaaactgagacctaacacataggcaaggatatgcttaagaactactgttggttggctccaggtctgggatatgaacccgaatctctgttgcagtctgtccaaaagtgggctgagctggtttcaggattggagcagacagctgtccatgtgctggaatttgagggatctgccatttcctccctagaatttctacctttagcattacctttgaagtaagtcagggattaccaaacatcttattaccaaagaactctttcttcccacatgacccaacacagaacagaaaagagcagagatgcttttgttcaagtgcatgggaaagaatggatgattcagagctgacctgttcagcttctcctgattctccagcgaggtcccttatgcttcttgctagaacctttagagctccatggagtatagtgagaaatgtttatggcctctattaccagggcagatgaataggtgcagacgttaacagcttctacaccttaattagcatgggtgtgtttagcagagtaattgagatcagagactaggttgataaaagaatagggttcccaacaggatagtttttgattaaggaaatatttggagcactatggaaatgcttgaaacataggaagggcaagttcagctggagtgcattgggatgacggagggtggggtagcggggtagggtgagaatcagggcagcctggaagctggggcctgaatcactggggcagggaccagggagaccagagagaccagagaaggtctcagacataaactctagctactccataaaactacctggagcatgaaaatcccagcgcctctgccacggcctagactgctcatcacaggggttgcaaagtcacaaaaaagatgatggcattgagctttcctatcaggaactatgtcctcaactaatattaatagctgacatttgcatagcacttcacagttaatataacactctcatatgttaggtgcttctcttaataccccttgaggtagctattgttattgttattattatccttcttttaaaggtgtggaaacacagggtcaggggccccgtgagccattacttggaaacactgtcattaacaattacttcttatagttgtttctagcaactcatgtcctggaaatgtctggtttaattcatctctctctccttctagtagacagacagacagacagacagacagacagacacacacacacacacacacacacacacacacacacacacacacacacacacacacacacacacactgagggctgatagggaagaggacttctcttcttgattctccatagctgtttcccaactgttgctctctaacaaaaaaaccccttcagaaccctcagccctgctcagaaatctaaggaggcttcaggcagcaacagtggggtccaccccaccctgaagggctgctgcaaagatctccaggaggaggcccccaacaccattcctcttgaaggtcccagttcagtgcggcttgagtccttcacctctgagtctcagccaggcaacatccgaaggagctgaggaagccttctctctcctgccttctctacctcacaggagatggctcctgtcctccccatctccctcccaccataaccgctcaccaaaaattgacttgttttctctgatgctgctttattgcatgttaatacttcattactggacctgattctgttacactcgcacagagcaagcagagcagagggtcctgagcatgcggcattagatggagaaactgcctccagtctcactcatcgtgctgagatgggttgcatggcacaccactcttagcacagactgaggctggccaggccacccatgctgggtgctgacaggcctcaagcctgcagtgagggccaatctcagtcctcatgatctgcactggggacagaagccatctgattttaaattccataggaataaaccaatgggtggagtcaccaaatatccagatgttttctcccagctttcatatctgccatttatttttaaagatgttttaatggactaggtacaattttcatacataagattcacccactcagtctattgttctatgaatttttaaaaacagcttatctgaggtataattggcatataacaaactgcacatatttcaactgtatactttggaaagtttcaacattgaccatcagtgcaatcaagagggtgagcatatccatcactcccaaaagtttccttttgcccctttgtaatcccagtagctcagccctcctccccacccctgctatctcttttctgtcatcatagattagtttatattttctattgttttatatcaatgaagtcatacagcatggactctcttgactgccttccttcattcagcataattattttgaggtttacacatgtctctggatgtactgatagcttattcctttttattgcttagttgtgttccattgtatggatatagcacagtttatccatccatgttgagctgtttccagttttgagctatttaaataaagcagctatgaacatttgtgtataaggcttcgtacggatgtatgctttccttttctcttgggtagatacctgggagtggaatggttacatcatgtggtagtgtacgtttagtgttttaagaagttgccaaactcttttccaaagtggttgtgccattttgtgctgccatcagcagtgtatgagagttttggttcttctacatcctcaccaacacctggtgtggtcagtatttttaattttaattttagtcattataatgtgtatgcagtggtatctcattgtgttttaaatttgcattttcctgaagactaacaatattgaacatctttcctgtggttattggccactcgtatattttttggtgaagtatctgttcatatattttgcatacattatatttgggtcattttcatattattgcattatgaggtttctttatatattctggctggctataagttttttttaaaatcagatatgtgctttgcaaatattttatctcagtctgtgtcatcttttctctctcatctttgttggaagtcattttccatatatgtgttggtctatttctagaccatctgttcagttccattgatccatttgtctatttttacaccaataccacactgctttgattactatagctttataataataaggcttaaaatcagatagtgctagttaccccttcatctttgtgatttttcatagttgtttggttattctagaccttctgcatttccatatgaattttaaaatcagtttgcctatttctacaaagaaaagtgtttgcttcatgtatttatttgaaagctctgttaataggtgcatgaacatttaggattgttatgcacccttgaagacttgacctctttgctgttttgaaaagccctttctaatccctagtgatagcctttgcgctgaaatttattttgcctgatattaatatagacagtccagtgtccttttgactgtgttagtatcgtatagttggtcctttgtattctcaggttctgcacatgcaaattgaaaatattggaaaataaaaataaaaaatataacaaaaataatgcaaatgaaaaatacagtatcaactatttacatagcatttatattgtattggtttttataagtaatctagagatgatttaaagcatatggagggatgtggataggttatatgcaaatatcataccattttatataagggacatgagcatctgaggatttgggtatctgtggggcaggaggaggtgtgtcctagaatcaatcccctacagttactgagggacagctgcatatctttttctgttcctttactcttaacctatttgtgtctttatatttacagtggatttctcataagcagcagatagatgggtcttgctcttttattcagcctgacttaattggcatattcaaccaatttgctgttgatgccttgctgtgcttcggtttaacctcttgatactttgctgtgcttcggtttaacctcttgatactttgctgtgcttcggtttaacctcttgagaccttgctgtgcttcggtttaacctcttgagaccttgctgtgcttcggtttaacctcttgataccttgctgtgcttcggtttaacctcttgataccttgctgtgcttcggtttgacctcttgataccttgctgtgcttcggtttgacctcttgataccttgctgtgcttcggtttgacctcttgataccttgctgtgcttcggtttgacctcttgataccttgctgtgcttcggtttaacctcttgataccttgctgtgcttcggtttaacctcttgataccttgctgtgcttcggtttaacctcttgatactttgctgtgcttcggtttaacctcttgagaccttgctgtgcttcggtttaacctcttgataccttgctgtgcttcggtttaacctcttgataccttgctgtgcttcggtttaacctcttgataccttgctgtgcttcggtttaacctcttgataccttgctgtgcttcggtttaacctcttgataccttgctgtgcttcggtttaacctcttgataccttgctgtgcttcggtttaacctcttgataccttgctgtgcttcggtttaacctcttgttgttttctgttagtcccatgtagctttgttcccttttccctctttttctgcctccttttggattaactgagtatttttaaggattcagtttcatctcttctgttgacttattagctaaaatccattgttttgttattttaacagttgctgtagggctcatagtatacatcctttttttattatactttaagttttagggtacatgtgcacaacgtgcaggttagttacatatgtatacatgtgccatgttggtgtgctgcacccagtaactcgtcatttaacatgaggtatatctccaaatgctctccctccccccgcccccaccccacaacaggccttaatcatcgcagtttgtcttcagttgttactaaaccccttcacatatagtacgggaacttcacaatagcacacttagatcactcccttcctggcctttatgccgttgctgccatacatgctaattgtgcatttgttctaaacctcacaatacattgttactatttttgtttaggcagtcaatgatcttttcaatgaaaatcatatatacttaaccatgtcagtaccatttctggtacccttgattcctttatgtagatccacacttctatctcatattattttccttctgcctaaaggacttcctttaacatgtcttgcagtgcaagtctgctaggattaaaatcttttagcttttctatgtctgaagagaagtctttatttttcacttttatttccgaaggatatttttacttagtatagaattctcaggtgatagtttttccttccatgactgtaaagctatgattccactgtcttcttgcttgtgttgtttctaataagaaacctgctgtccctcttgtctgttccactgtacctaaatgtgtctttatgccctggctacttctaacattttctcttgatcactgctttgaggaatttgattatgatgtgccttggtataattcttttttcatgtttctagtgcttggcattccttgagcttctggaacctgtgggtttatatttttaaaattaaaattgataaatttctggctattatttataattttttttttgcttctccccccattcctgtgagaactctaattacacatgtattaggctgcttgacattgtcgaacagatcactggcactttcattttatttaattcttttttttctatgtccttcattttggatagttcctatactatgtgtttatgaatcttctctttttttgccatacataatttgcctgccttcttccctccctcattccttatcttccttcctttagaagaacctagggggatttacctaattttataatgattattatttcagaaccaatccagagcttctgttcccaaagccaaactaccgattggagattctggagggagggaacacagggggtgacattcctggaatttgggggacttcgcaggacttgacattttagaggctggattagggtacatccaatttctcctgcttcctccctcttcttctttcctatccccaaagtaaggagagtcctgtgagcccaaaggcactagacagccctagcacactcttggcagacagggctgaacgcccggatttccctctcaatagggaagacttagggagcctctcacaggagtgagacaggaacagcagctttatggaaactgagttccaagtcaacacccggaagaaaactcaggctcccctgtaggcctggaaagctttgtctgagacaatgaccttaggaggaggtcaccaaaaccactccttccctcacagctcatgggatcagagtcagctgtgcctgctgaatgagtggtcaggtacagcgcacccgcctcctgccagagaaaaggagacctgcagtctggctgcggcaggtctcagcagaatctttagctttcttcaggcttgatcagccacctcaagacctgtgctcatttaaagaacagagagtacatgtaagttaggaatgttctcgacttcaagtaacaggatacttaaggactctgaattggttcagcagctcaagatgccactgagaaccaaggctctttctctctttccacttccttatactaagtctgttggcttttcatattcaagctgatttccttatggttgcaagatggttgtcaatggggctccaggcatcacacccccattcaaggcaggtggaaccaggaaggagtggagccaataacactctggcccttttttttttttttacataaaacagaggctttcccagaagtccctagcatagtacttcttgaatttaatctacacaaggatcccctgggaatcttgttaaaatataggtttggatgtagtagatcttgggtagagcctgaaattccacattttgatcaagctgccagagtgtgtcagtgtggctggaaactgcattttgagtagcaaggtgcaaggctacttctccttactcttagtgacacaatccaattaactagctacaactggctgcaagggaggctgacaaagtatcttacctttttcaggggagactttgggtagcaaaccaatatcagtcacagaattctactgaaaatgcagggtatggaagcatctgaagtcacaaggttgggctggacaaattagagccttcacctccatgagggaagaccatggaccccttactctatatccacactcagcctgcagggacagggcattattgccacgagccagtctgtcctgtatactcactggattagggattccactttcagaattttatcaccttagcacccagcacagtgcccggtacacagcaggtacccaatacgtgtctattacactgaaatgtttattggcacatggtctaaagacagtgccagggaatcctgtgaaaatgcagtgctgattcgggagatccaggatggggatccaagatgatgcatttggaacaagctcccagaggatgctgccgtctggtccgaatcctgggccccactttcaatagaaagggcctaggacatgcagagtaaagtccttcctcctgagttagcagcagctacttgtgcttcattcatgcaggcatgaagctgcttgcaaggatgttagcagatattagatatggctggtggggaggagtaaggagggccttggctatgcctttttccaagatccgggagctggatgctcagagatctcatccctggcttccttgtccactgaaaacaaaacagcagtatacccgggtgaggagagagaccagccaagcacgtctttcaacaactcttaacttgcttggctccagccacgaaacaggaacccgccatccccctagctcgtccctggccctcaggaagtgctgaggctctgccgggctgcatgagtgaggggccgatgtctttcagatgttggggcttcagcgggggagtggggtaagctggggagagggagcatttttttgtgaatattttacccacggaaaaagctgaattctctagaacagacctctagatttttttttttttttttggtagtgggaagtgagttactggaatttcttctgaattcgaagccaaacaaagtttcttgcggttttagttacacaagcggctgctgccaagatggaatgaatgagaagagccactgaaaggaagagacagtgaggggctgggggaggagggtgcagaacaggacccaggcgcagcacagaacagccctccaggcgggcatactgcccgcttctatgctgtcaactctttagggagagagctcactgttctgtctgcctcccaggatcagaattaaaaagaaaaaaggtctgtgaaagtgaggcatacactggcagacacgcacacatgtaaatgattatcattgctttgtaatttaccataattccggcctgtgcactctatggggtcctgctttgttcagtttcctgactgagtggcagttggacgagacacttctgcccctaagctgcaggcaggcggctctcatttcagccttgttccagtgtgagtctgcagggaagggatgcccgctgctccaaggggaagcaaggataattaacttctaccagtgatccccaaacttcattttccttagagcctgaagcctcctccttgttaccttcctggtagccacagaatgggccagggccatgtgtctcctttcatttctccagcctgccctctggtgggcgatgcccttcagtgagcggggcctggggtagggccgttctgcagatcctgggttggcttccagtggtgcctggcatctctcctgctctctgggaggagggacgggccgctaagtgctgacggcagcctgtcactcacaccttgctccctctgtagaaacactctgtttctctccattccatccctgcgtgttacctagcaggaatttcctcttccttgggtcaagcgggtgggaagggctcatgattgctgactgaactcaaccctttacactgggcattcaatgtcatcacattgataacttgaaatgggcagtagtgggaacatttacaccacaaaaactggcatatgctacacccagagctttccttccccctctcctaaaagccagttgctaaaacatttaacaacataccactggctggaaccacttgtgaaggtgacgtagggctgcagggagagcccaggtagtggaggaaatggcagccttccttccttgcccatagcctgtgccggctacaactcaggagcttttggaacttaggagctctgttcttaaactctccttaaacacctcctcatcccagacgggttgactttcaatgagaggactctgctgtgccgcagagctggaatcactcaaagcagagtgatggacgagacttactttcgacgttcctaggctcccttccaccgttccctggtctccaaaccccatgttcttatctgacggtatttctactctttttctcaacctgttgctaacgtgctcattcgagagaggctggtgcgcacctacccagcggctttttgggcggcagtggaagggagtgttttattaggaatttacgttatatgtgcaaggaataccacatggatggtaaagttcagccgttttccactgaagatagggattcttcaaactgcacagcttttcaggccatttcgtttaggcgagccctcatgttatagtcagggagtttgaggcccagggacatttcccaggggatgaactctaactaaaaatgaaggtctcctagtcctgtcgcctgttttcttcactcagctgtttaaagggatgttgcctcgtgtgaattatggatgactgccagagttattagaatgaacagagttaccaagagctaaatactcgtcatttatacctggccggttctgttttcagttgtcctttttctttgcaaagagctttgaaacaagactggcctgcttgaccttccatttagagttaatgtcaaagcttgctgaggcctgggaaacaggtttggttgtttgcattaaaagggagtaggaagcaagaaccttaattatcctaggctctggcctatttaataaggaatttgagaagatgtcttagtggctagtattcctagaacataatacttgaaagtggagcgagcgggtgaaaatatgccttaggcaggaagccagataggaagggccagtgtctacaggctctgcacagtaaggaccctgtgggaagatgtcacaggtaacagggcctgatggcccagcacccagctgctttgcagtagttctggcttcggggcttctctgggtggctgaagaacaggtctgtgaggttcattcgggggctcttgttgatcaagtgtggatggtgtgccggacacagggctggggctgcagagtggaggaggcgcagtccctcccccgagagcactgtggccagtggaaggagacaaacaagaaacaatgacaggacccaggctcaggctgtcatgagcagccctcctctggagagtgggaaatgtgcgttgggaactcatgcttacaacttttatgttttttcttactgagcaatgctcataacaggagaaaggatttcttcactgtcccaaaagaatgtgcctcaggactgaaattggtagtggccctcccttactcatgtgccccaagcacattggaacgccagaggaattttaagcagatttttattcttgttttctggaggcaaaatctaaagtgaagggtgtgtgtggagaggtcatgcaagaaatttggaagctgtgtgccttgtctggctgactgtcccaattaccccgggcccagaggtgggaggtcccacaggggcctgcccccagttgacagagggctctttaccgttaggaccccttctgggtttctcaaattatggcttttcctccttcatggtctcctggtacttttaaccccttctctccatttttcccaaggaatattctagaggaagggtttctgggaatgaccttcccaaggggagggatcgggcaagtattgagtcattcctgctcgtctggattgtgattgcgacccgtgcctcatggagtgtcgctggatacgcgatcagtgtcccttgaggcagtgctgcacatggtgcagttccagagaaatgagggaatgagaatgaacgtggctgctcgtgtgttccgtggctgtttaggaaggttgggtcagtggagatcagggcccgaagagcagtttcagcctgcgtggtcttgatgtggtcttggctgatgagaagctccctccaattctgtgattctgggtaaagcagaccatgtgccatcgggagtgctcctgtgattctttaagttagtaattctcatccctggccacacataagaatcatctgggatcatttaacaaaaaacaatgccaggatcctacagtctactccacgcccttcattttcaaacttgagtgggcaccagaatcacctggaggatttgtgtaaacacagattcctgggctccagcttccgagtttcagtggctccaggatggagcttgagaatttgcatttctaacaagctcccaggtgactcgctgctgctggcctgggaccacactttggaaatcacgattatgaacaggaatcagaatttctgaagatgtggcctgggcatctgaattttttcacattctccaggtgattttaacatatagctctggctgaaaacgatttctgatcattgatttttttttttttttgcatcatccaataactattcattggtcagactgtgtgctaggcactgagttagagttgaagaccctcaagaattccactgacaactgaatcatcaaagggaaccgagccctgcccaaggacatacagttgttttcctcttccttgtcctttggagaagcacagctgaagcttcctgcccacaccccagcccctcctccttgagcatgaatgtgcagtaagtatgagagcctgtcatttaccctccctggcctccctctccagccagcttctctctgaggagtgaggatttcttgctaagtacatgatgatggcctgtttactttgctctggagtttgaggctcttgcgcagattctgccttcctggacagttcaggaaccaatcaaccagctggccttggcaacctagaaagcatggtcagttgccctgaaataggttgattgcaccccagaagtgcttttccgcctctccccatcaaaggtgtttgcaaccccattttccctctgagtcagcttgtccattaatgggtttgtgttccttgatggggtctgtttttccagggtcttgaggagtggccctttccacccagtttggctgcggggctgagaaggtgcccttgcattttgtattgtgtgtccgtggtgggtctgtgcctcccttctgtctgttttccctcaggaccacccaccgccccatgcttgtatctacaacagctatgaggaagaacatacagattaatcaccctgctgcgggatgccagctacccagtggctctggcagccccagtcaatggatcctgcagtgtagccttcatcagtagagctgccactgccagcacccaaaaggtagcactaatatgcatgtgtgacctgaaaattacaatgtaaatggtggggcaacacatgtataggaaggtaaattttaattaaaagtctgttctccaactcagcctgcctttaaagatacagaaatgccaagctgtcaggctgccggtcgggttaagagggttctctcgtgcactgtggaccaagctgggagaactagggcttcattgaaatcggatgcctttgactaattatgcaccaaatgcatcccatatggggaagatatgccctcaggtggttagcagagccagcaggagccaagcttcctgaaaaatgctgggtcttctctcctgcagtgtcagggggtgcagacagtacagagggagggtatgagagtcgaggcacatgccaaaaaggagcaggtgggaaaaaagagcccatggcccagcagcaaattgtgtgtctttgagtggatgtggcttttgaggcactatgcccaatagtcatcctgaatttccttcactgcctggggagggggtggatggaggagggaaactagccacctccagaggcaaccctgctggacaaaactcacttttagaaccatcagaagcccattttcctgtggaaatctacggggaagagatagagaagagctgcagagtctattaaatgtgtgcttgctgcctggtctccggtatagtcaggaaatcagatttgtacagtggaaattcattcatgccacaaatatttattgagtgcctacactgtgctggtggtactagggactggggatacagcggtgggtgagataaaggcacgacgccctcaccgagacttgtgtgccactggagaacatggattaaaccaggcgttacgtgatcagtgtatcagtgccatatgggcaatgatccaagctgccgatgggtacacaccggggacacctagttcttaagtgactttttaggatcccaagtggtcagaacagcttccctattttgccatttacatgttcacattcacttagctcaagttacccttctgataagaggaaattcgcgtcaagtcacatagaatcactgaatatttgcacttggaggatcacctggcctaattcttctgctttacacatgcagatgctgaaggagagaagttaaagaacctgtccaaaatcgcacagctagttagtaataaagcttgggtggaattctgcttttctgactcccagattagtatttctttgactttacctcccctttggaaaaatgaagcgattcaggggaagttcctgggcatttatggccaaactgccctcgctctgaagattcaatgttttaattggcccggcagagctggagtccacaggtggtaagcatggacaggtggagagccagcatcagagagagcctcctggccagcgcctgccttgcttcacagatgtcaaggcaattggggattgggggcagggtatgataaagggcatcaggaaagtggcagtgctggggcactgtcctctgggcctccctgggctcagctgggcaggggcgtgttttcagagacaatggtgttgactccctctgggcagccctgcagggtggcagtcccacaacagaaatcttggagcagatatgttggaggatatgtataagaatgagggattagtgctggttgggggcagaaaaaatgccctcttggggagaaagaaatgatctgtgacaaaggacttcctttcctaaccaggcagactctggaagatgaccacgaggctgggtgggaaggtggcagtggaaacgtgattaattgtactgtccatggacagtgagccgaggagcttgtacctggctttattagagacatacactcggggctgctctacccagaatccctcctgctgcctccagggctgctccactctgtgtcttagagatgagaaaaggagtcaaggactcctaccagcgtggaatggtaacctctggaggggaggtaggtctcccagggatctgagacgtgttccaggaatggaattcccagtatccttggcagtcatttcaggatcttggggacctagggatgctgtctggactgctctaaaatagcccttctgtggcttcctcaaatgtattgtctgaatcagcagcttcaaagtgatatcagggggtttacagcatggatgttggagctatgtagactggattcaaatccccagttctaccaattccagctctgtgtgcagggcactagaacttgctgagtcctagctcctttgtaatatgaggtgatggtgaatatgtcgtagggttgttgcctggattgaaagtaggtaaagcacctactagcgtgtctggcacctgggaggtacttaaatggtaacccttattacaacaaaacaataaaaggtccttccttttaagccagaaaagttatttggaaatggaacagtcttttaatgacggggacttaaaatcccaaaccaccagccaaaacaatcaaaatggaacccagacggatatttgctcaagggcccctggcttctcaagggcctactccgccgcagaatttgcctgcaccacctactggtggtttcttagaactacacactctctttctcgactgctctttggtgagcaggacaccaggagaggcagggaggaaaggaaggtaactagtagttttgcaactgttttaattacttcaaattgagatgtttgtaaataagatgttagagtctggagcttttgttcggtcttgtgtttagcgtaaatatagttttattgaaactcgtcacagaagtaccctgcagtggagggcgcaggatttggctgtgacggagcagagctagaggccacttgcaaatggcagcgtttggaagtgcctgttctgggtagagcatccaggctgcttttgattggctgtttgtccctcccacgaagcaagaaaggtgaatgtaaccagcccactggaatcggtccttttgccattaacgtcacctctgtttactacgtgggaagagtgattcacatgcaggaagaagaccttttccagaaatcctccatcagctagaagaagagagagatcctaattagggagccatgccacatttcattctgagattttgtttggaagcatttttccaactgagaaggtaggaaagggtcgtttaagtttcccactgttctgttgggcttaatgacctgcccaggtctcaggctgctctgagctgagctgtcagtgagaccagcaggaggacatcactaggactggaaatagcgtggagtcaattgacagacagccatgaagcactactaagtgccaggccttgtgctggctcccggggaggcaaagaaacatagaacatgaccttggtccttaagaggttgagagtttagtagacaagagaagcctgtgctaaatctgtgtacaatagtgagtgaagcaagtgctgagtcctagtggacaggtccatcctcttgtggaatattggagaaggaagcatgcatgtgttcagttagacacagtttctgacctccaaggtgaaggttcaattccatgcacgtttattgtgtcccattttgtataaacagagcacgtttgttgatattctgaggtatttggagaaggacacagttgagtaccatttttcagccctttcacattgtgcagtacagaggtcaggagcactgtttcaggaatcagacagcccacgtttgaaacctccaggacttaccacctgtatgtccttggtcaagttatcaaacctctctacagcttcatgtatccaatcaacagacgtttactaaatactgtaccggcactggcaggcaggctagagggactgaagggatgtgcagaggttggtggagagggtgagcagggcagagactgagtgtgtctaaggaaagctgccagctttaggcggcctggggagcttctagttctcagccaatctcttccctgaatgggcagcctatgggtgaaggtccaagtggggatgtggctgtagtgtctcttcctgcctttctcccatgccctgcggcaccaggcccacactggagtgctggtgggagcctgcatgcctggttaaaggggcatgccagagagctttccgtaattgcgtcctttctttttttttttttctggtgtatttatgagttttaaaagccccttggcaacccaggaaattccatttccctctgcagctcatttataccttccttgatatatgcccaggcacaaacacttgtgtgtattatttggttgttcacggggaatcttgtaaaatctgaggccttagtgggtgcacttcaggcttgagggcaggagagggaaaggagcagaaggtgagaaggtaacctctggcaaggaaacggtaacacttttaaatctcctctgaagaccaaaagcaaaagaaatgggctcaacctgtagcataagtgtgctagaatagacacaagcaagtttttcctgatagatgtcaaatgcctttttgcctgttcacaataagcttttatacatatggccaattctcatctgactgggacaagatgcagggagtggaataaactaaatgtccagtgtgcgtaattggtgttgctataattaatatttttcagccctgtgactccatgaatgcctctaacacctagagcaggcttgtccatcccatgggccactggccacacgtggtccaggatggctttgaatgtggcccaacacaaatgcataaactttcataaaacagtatgagatttttcttgcatttatttttagctcaccagctatcactagtgttagtgtattttatgtatggcccaagacaattcttctccttccaatgtggcccagggaagccaaaagattgggcatccctggtctagagccttccacagtttgacctttagagtatcttgctttggcttattctttttcatatgtatgtacttcattttccaaaccatattatactcttatcatttttatttgtatccctaccacggcctaaaatagtgcctgaatatagtagacaataagtgtttgatgagtgactaatagataacagcagcttccagtgtctgccagtgcttacactataatttatcatttttttcttaaggtgacagagaactcttgtaataactctaatagcaagtcttcttttgtgctaatatattaattgaatcatttattaactttctaataatatgcaccagccactgtcaggcactagttattcaaaggaagacgagacacaaccctgaccagacatgaggggtgtttaccatccacctgggagatgggcatataatttaaaatgaaatatcgattggtaatatattaatgaagagtatatattcataatttaggacagaggaagtgctttttgcctggccttaaaggggagagtttcggggaggatgtatttgagcttcatcttaaagacgagcaggagtcagcgagaagacatggcagcggtggtgggtcctggcagaaggaagagcgtggcccatagcatgaggcacgggtacggttgtgcttggggagccctgaagaggcggctgctgaggaaggtggagctggaaacgtagattggagtcaaagcacgaaggccttgaataccctgggcagaagctgagcaggcagtcagaaaggccctgaggagactcggaagggtcacctggggcagtggagagtgaggggcgggggaggctggccaggaaccatcgcggtaggcctgatgtggtgggggaaagattcctcttgtgcgtgctgtcgggatacatcatggagcctgaagcatgccaagaaaccaagcaagggagcgtggcctcaggcttgccatccgagccatccaagccagaggaacccaagtacagctgcgggtgaaatggctttgttagttaatatgtaacatgtcgcctcaatattgagcatctctggcagccgctgggactgcgggcgcgttgttggtcacactgacccagacaagtagtcaaggcagctttcaccacagatcaagcaagagagttggcagtaggtggggcagggtggtctccgtctgtgtgcacatggtgctcagtgagtcacatctgctccagttgtgtaatctccgtggtcagtgaagcaatgctgtgcgcacagttctgtgttgtgcctctcccggggaaggggtgtatttggcctgtgccccaccctagccctccttcgtcttccctctttcaccacgtcttccggggctggcttgagtgtgggagtctttctgccagctccctgcctacagccgcccactcaccagcccttcatgtgtgcctctgagagtcttcttcctaaaccaccccgtgcccttcagtccccttgtgaagcctgggcagtgaacatccttaagcccttagcagcttccctgaatccactcctcgttatccttcaggagtcctcccatatggtcaagcagatgaattccttgtttcttattcatgtcatgccgcttctcacctctggcaaccccaactaacatgcccctccctcttttgtctttcaaggtttcattcaaaccaaacttccttcttgaagccttctgcaaccccatgcctctcagtgaaacgtccttccttactgtgcacatgagccctgtggcacgtgacaactgtgcctggataccccaatttctctttctaaggcagggaattttcttgtacttcctttagtcccagtacctagcagaattctaaaaaacagccattcagtgaatgtgtattgatatcaatgattctggcacagctgacggggccaaataaatgctaagtagtattaagagtgataatggtttttaagtaataacaatacctaccatttattcattgcaatgggttggtcacagtgctagacccgttacaaccatcatatgattgaatacagcgtaaccaacctgtgtcttggcattacttccattttgcaggtaagaagtgacataccttgaccaaggtcatgtggctagtaagtggcaaatgtggaagtgggccagtgttctgcttcttggcccacactcccaacctctcaacatgtgtcctctgccatagctgcatctcccagatcgcatgggattttttcattgttttgtttttgtgaccacgttgcttccttatccctgtgattgggttttgcccatgtctctcctatgagagcagccttggtaagaagcagggagaatggaagggatatcacatgccagaatggtcagaaaaatgaggttgctcagcaggtgtcataagaacggatgattcatgcactgtgccttagagtaaagatggagaaatgcaaagggagtggggagcagagagacgctgacagatgatgagtgagcacaaatgtttatccatgctaatggagtggggacgtgatagtcactctgttctaatgcttatgaggagcagtctgtgggctgcaaatgcaggagcacaaggaatcttcaccctagtggcaggggaacctaaaactccaggctgcaaacagtggctggagcatctctgtaacagtctggccttgcagatccaaaagacaggtcatagacaacaaagacatctgatatttcctgacactgccatcctctgggctctgggggagtccaagatcatttgcagcactgccctgggagtggtgacaggctggaggaaaattactggggtctgaaggagtgcaggcccagctttcctcttgcttctaaggccaacccaaacaaataattggtgctgctttcagaatatcctcacatgggaccaccaccacctccactaggctctctgtccccagccttctgccttaggcttttccacctcacactacactatctaaattctctaccgtagagccaaggagtgaggataagggaaagggaagccaggggttctaagggaaccaaagtagtaccaaattcccccgttggtctgtggtctaacagtacggaaatggatagccatctgcatggggtggaaatgtctcttctttgtaaatgttccactgcctgagatttcaccattctagctttactttgcttccattattccacagtttccaggggaagagaaaactttacctggctaacaccttgatcagaatcacttcatcacagatcatatacatccacagagatgactgaggaaacagagaagagcttagaaagccaactctgtcttcatcaccttttggtcttggtcctcctgccttgggggtataaccctctcttagtttgtgggagaaaaatatccatggtaagaagaaagatgtcaggtccaggacagcaaagaaaccgctcagtaatagaagcaactccgattgcatgagcaggcttctcgagtgctgtcctgtcagcctaccgtccacattcctggtgtcatcaactctctagggacaggagcacagaacacgtgggagccgtcactgcaggagctgtgttagtgacagcagcattcaccagaggcatttaaaggctgattgttttatccatagcattgtctgggctttgagagagaaatcctgcctgcaacaggagaagactgaaaaatagaaaaccattggcagtatcaaagggttgtcattagtggacaagtacactggcttgattcactagtgctgttattatggttgttattttaatttgtcaagagacaatgggttgttggagaacatgggcagtggcccttgcttccaaggaggaaaggcaaagggaagagagatgctagggggtcgtttctgtagaaagcagacgcccaggtgtgtattttccccaccactgctgagccccacagcatggcttgtgaattttacaagtgatactgtgacatcgaaagcattccattgcgtctttgtgagaatctagggtcctcttttatgcttagtctaagtatctacagataaacatgcatctatattatatatgtgtgtgtttctccatactctgtgcatatacttaagtctgtaatgtgcatatacgtgtatctgtctgaacagttggatatatatagatgtgttgcagctctccaacctttaccaaagaaacaaaaaaaaacctaaaaccacacacacacacacgtgtgcacatgcaaataaataaatagagaaggagaaggaagaaaagaaaacagccagaggaggttgctttttctgtttcagaggacctcagcagttcttcccaaaatagacttctgtccttgctgggtaacatctaaaggagacgacatcacagagggtccaggcaagggctgtggagtccgacagtggggttcaaatactcacatgtgctgttgtgcttggtgcggcaactcaacttctcaaagcctcagtttccccatctgaggaagagggacagtccttcctgggaagagcaccctgccctccccatgacaagtgctcagcaatagtctcagccttctttcacaaggaacacaattgctcatcctatagttacagctcaagtttacaacgcaagcatctctcaggtgacagggtctttttttttagacagagtctcgctctgttgccaggctggagtgcagtggcacaatctcggctcaccgcaacctctgcctccaggattcaagcgattcttgtgccttagcctcccaagtagctgggattacaggcacgcaccaccacactcagctaatttttgtatttttagtagagacaggattttaccatgttggccaagatggtctccatctcctgaccttgtgatctgcccgcctcggcctcccagagtgctgggattacaggcatgagccaccgtgcctggccaggtgacagggtcttaacatggaggctttcaggacagatttggtttatgtctgccctggcattcagaaggtgacaagtggagcccggaaggctttcggactaacttctgtaggcccgtgccctctatggccgcagaattggcttcttgttccatgttgctgctagtgctttttgtggccccagccaagtcggttcctatctttggaccacagtggacccatcgaggggctctctggagtcctcccagcccacccttctgtgcctggccactccaatcttgcaggacactgtgctggaaactgacttcaagagtaacactgttgtggctcccacctccggggacttcataggtttgagtatgtgtgtgggaatgtggtctgttttatttactcttgctaatgaggctgaacggagctagtgagggcattaaaacattttagtgttattagttttaaaattagcccgagctgttaaggagagtccctgctcactttgcttatgtgagaaaggggcttctgaatgccaaggttgaatgcccagtgtctttcatcctaaaaaagacaactttatgcgctatgcgttagaatgaacagggaaactttaaatataatgatatggggtgcctgggccccacctcctcctttgcttcactggccctccctggacatcagggggtgtggtttttgcttttttgttttttaagttttccaagtggttctcgtgcagccaaggttgaggcccaccgggctaaactaaaaacgttttccggtgtatgtgggaggcaggtaggagggagggctggcgtgctgcccagctgtgtaccatttcctgcttggtggatgctcagggagtgtttgccagagagctctcatcggatgcttggcatggctagttcagatgctatggacagaggggttcctgtgggaccagtgcttctcagtcctgaaatcatgatcagaatccccccatgatctttgagaaaatacagattcctaggcctcatccacattggccggaacagaacctctgagggtaggaatgaagaatctgttattcctgttattcttaggaatagtgaagcttcccagaagatgcttttgattcagaaaccaccgaaaggggaaaacttgatcctcaattcctaggagtgaagattttacattttccttttggtcatctgatggccctagggttcactagataggccacttactcaccatgtgacccggacaaggcattcagcctctctaagcctcaatgtcatcatttgtaaaatgagagccataatggtttctgcttcctaagagtgtttcgaggattaaatgaggtaatatgcgtgtttggcacattgtagatactcagtgtgttcactgccatcatcatcatcagcactatcattttgtaactcagatagaagctacacactgtaagagcaatttctaagatttaaagagaatgaagtaaaaaattctggctgtgaagtctgaggcaaatctagaggctagtgggggtaaattggttttaaacttgtatctgaaccagaagcttctctggagagagttggagtaagatcacacaggtaatcctcaagacctgtttgttaagagtacaaagccataattgggaaaacagtgaggtcccgattgtcatccagaatgaattaatttacatgcacttatggagtgcctcctgtttgctcagctttgtgcttggtggcatcacatataaaaaggaccaggccgggcacggcgggcggctcatgcctgtaatcccagcactttggaaggctgattgcaggtggatcacttgaatctaggagtttgagaccagcctgggcaacatggtgaaatcctgtctctactaaaaataaaaaaaaaaaattagctgggcgtggtggcatgcacctgttgttctagctacttgggaggctgaggtgggagaatgacctgagcctggaaagtggaggctgcaatgagctgtgatcgcaccactgcactccagcctggtgacagagtgagaccttctctaaaaaaataataataatacatgaaaaggactggattcctttctttcagggaattggccgtctggtctgggaagtacaattagctccctttgaagaacaggagcaggacgagaggatgtgtaattaagtgctaaattgtgtcactaggactctccagggctagatgattcaaggatggcaacacaatgagccatggaggtggctgggggagcctgttgggagagtagggagggatctggagcaggaaactacaagcaaatccaaagagatatccaaggagggtcctgggacaagagtgacggctgagatggggatgacgagcagctgccctacctggatggaaggtgagggtccctgttgtcctggagctgcacagccacttataactggggtcatctgggtctgtggccccctgacagctggtggtagtctgcaggcatacactccgtgtcctgtcgtgagccggtcctcagggcggcatctgcccaggaagccacaggcacacttagcacggcccaagagcactatctgcaggaggcgcttggccccagggctgagctgatggtggttgggtggggtgtaggcgacaggagagcaggtggcctccttcctctgtgccatcgcttagagggtatcggtagaaccctctgtcccagaagtcagctccgtatctgtgggtcttaaaaaccttctgatcctgtaaaatgacatttacaagaatgattagaccttaaattctgtgatcaggcaaggtcttaatttggggccagcagtttagcacagaggcagggcagaatttcgcacagaaggtacctgatccgtgatttgccccggaggtgaaaatgagcaaggttctgttagttaaatgagcataagaaatgcagcagcctcatccgccccccgccaccccaccagagagtcacaaagacgctcattggcattttaaaggctcagagaagtcctgcagaagaagtcctctttagagccctatgtggcctgcaaactgtcttgaccacagtacccttctcacatagtccctgtgaatgttctgggcgacctgtgacccagcctgatctcctttggaaaaaactggagtgatgaggtcctgccagactgagcctgaaggagccttccatctgcctgttcattttccaagccccagactctgaaaggagattcccaagttccccagcctggccctgcagtggtggggagcctcagatcccaggtctggtttaatgttccttagttgttaaccagctggaattaaggctgagaggagactcgtgggcaggctttgcaattgaatgaactatcagtgtggttgcgaggctattttgaagacattttagattgtttctggttcagtaatcttacaaaaagtatgatccaactgatttattaggaaacaatttgtaaactttggttcacttacaagaaagaagtgtttgggtttttgaaaaagatactgcttttgaggctggctgattttcgtgactgactagtgtttatgaactgaaatctggctgcctctgccactcagtgagcctcgcacagtgaattcctagcctgaggcctcattcttgctattaacccattcgccattctctcccactgctgggactttcggatggaggatgcctggcctgtgtgttggcaggagcagaggctgacgtcaggaacataaggtcatgccataattgctgtgccccctgccacccccgccgcctctgcttgctagtgccaggctgcccaagtgctgagaatgccaaggtcactcttccaaaggaggcaggaggcagccgtagcgtcagtcccttgcctcgtccatactgcccatcttcttccaaaggcaccaattattggaagttcctccccttgtggctctggcctctgggacgcctggggacatttccactttgctgggaggggagtgtcctccgggcccctcggatgctccaccagtgagccagggcttgggatgggtagcgtgccaacagggagtggccacttacctttgctcctgtatgtgccctgtccttagaggggtttaaatacatcaatagcttattcgccaaaatgtatccagaactatttttagtgctttgaacatgttgactcttacataacattcattcagtatatataaactattcagtaaatattccctcatgagaagaatggtattttggtctattttgtctctctgccctctgtgttctaatttgggaccagggagcctctcggctccatcctggggttggccgctcccagacctcactcctgctttggctgggcttgctgccttggccatggtgaggggctcttgcggccccgggaggggggcctggtaaatgcagagcctgcatcacagcaacaagtggggagcccaagagcagggtgcagagctcctccttctcccaggacggaggcgggaaaccggccgtgggagcttccctggtcgggaccatgttcccagtccagagggatgtggttgcatgctggagccgctagtatggactcgtgaatgtggcttccggtcacaaaagtgccttccaggtgggaaaatgagtgaggaaacctggattcatttgctgaggtgctgtggcagagcactgcagactgggtggcttgcacaagagaaacaggtttcttctcaggcgggaggctggaggctggagatctgagatcaaggtggtgcagggttgccttctccctggcttctccatgggtcctcacatggtatccctctgtgcgtccgtgttcacacttcccctttctacaaagacgccattcatgttggataggatccgccctcatgccctcattttaacttaacctcttttaataccctacccctaggccagtgcagtggctcacacccgtaaccccagcacttttggaggctgagatgggaggatcacttgagaccaggagttcgcgaccagcccgggtaacacagggagaccctgtctgtacaaaaaaaaacaaacaaaatagtatgctacctctaaataccatcacacattctgaggtgctaggggtgagggctttcgcacatgagctttggtggggacacattcagcccatagctgaatgtccatgcttctgtctaacgggcaaggctgctctgcaaggctgtgcggagtgggcgccgggtggaactccaggggaggcacctcagtctgatgtccaaggaggccccctgtggacgggcctggcccagaaaacctgtgtgtttcccacaggtttggggagatgagttgttctggggtagagacaggtcttgtttgactttgcaccccagttcgtatctgcacatggtgagcgctggcttggcgtctggtgtggagtggtggagagagattgtggaggcacttcttgcagatggcccctgcctctttcctggtgagatgtgggcttttcttaagaaagctgcaacatgtgccccaggagatacttgggctcccttgcccggggtgcacaggacggagcagggaccatttgctgtgtcttctgtcagatctctgagggatgtccctcaggggctgtgaactctggtggaaagtgaaaaagtcccagggtggattccagtgggctgccagccgggcgtgtgtgtgaggcgaggtggagggcttgaggaggtgcacggccccagaagaaagctggagggcggtccagcctaggacacgctttgggcttgcagttcctttccttccttcagggtcaggcttcaccaagcaagccaagggtccctctcacagcagcgacagcagcaacataaatagcactgatatccaacccggcaccgaggcagatcccctaccaccagcttgttctgagagcgtgaaatcacctccatcctgacacgtttgtccccctgtgcttttgctgtgccacctcccgagcagggctggattaactggataaagctggaagagtaagtgccagctccatgacctggccccagggcaggcagcccctgcctcctcctctctgtaaaggcacagagagcgggttgctccaccggccacaaagcacattcccaggaggctctgggcacatccaggcctccttgagggccagccctctgcaccacacaggtagatcccttcctgctaggacagccagttgtttctaaatttaaaaaatgctccttgcatccaaatgcaagagctaaggtgaggtttgctgggcatcaacacctgggcacaaagaacaggtctcaggcagggcaggcagggtgagcagagggtttgggtgagaaaagccgccatgcccgggggctttatgtttttacagagctttcatttctaatgtgacgttaaattcttccctagttgaacacttctcttggtggctggctggcagctgtgtgcgggtgtttgcaggatgataactgcctcagcatccatgccatcctgagctgctgggaggactgctgggcagagactccttggcaggggctctgggaggcatctgaatatccatcttccctgatctcctgtcctgcacacagatgcacacactgcagggctatttctttattcagtttggttttgcttttgccccctagccctccctgtgcccagtacctgggtctaggaacatagaatttaaaagctggggcagattctgagagctcttatttcagtctcatcactttacttgggaggaagctgaggaccagagatgttgagacatgttcttaggacaaagcaaagtttatggtgcagcctcaggtggagcccaggtcccctggctcccagcctggtgctccttcccctggatgacagcatatctgtccttctgttgatttgtcctacctggggtgttttccccatcctcatgtccttcttcagctggacatatttgtggaggtccagacacaactcagtctgggtcatttcttccccacccctcaaaaaacaggttgctcaaggcagatgcagagggtatgcctgtagtcccagctctttgggaggctgaggtgggaggatcacttgagaacaggaattagagaccagcctaggcaacatagtgagaccccattgcttaaaaaatttaaaaattagctggccatggtggtgcatgcctataatcccagctactcagaaggctgaggccagaggatcacttgaacctagaaagtggaggctgcagtgagctgtgattgcaccactgcatgccaccctgggtgacatagcaagactttgtctcttaaaaacaaaacccagattactagtgaggccaaattgtgatataaggtttgtaatagagacacttttttaaggctgaccatgtgccaggccctatttaaatatattactcatattagctcatgtaatcctcatatcgaccttctccactttacagttgaagaaacgaaggcaccaagaggtaaggaacttgccagaagttatgcagctgagggtagtggagccaggatttgagcccaggcagcctcactgcagtccttgagttcctaacctcagatgcctctcctctgaggggagccctgctgtgctgctcatcctgttgagtgacagcctgctaggatgtgaaggggacattggatacttccggaagctgtggtttgactgtgcagatggttgtttctcaggctctggtccatggtgggaagcagtgagtgagcagatcagcccaccttcagcctgtgcgctctgccgtctgacaccttccaccctcagggcctgatcacaggccagcaggcagctgggggccctcttgggtcctctgtcttctcctgagatctctcagagacagcagagaaacgagagaccctggaaatgcctcatagctagtttgaatcctagcacttacacagtcataaagttaagtccttgtggtcttttatcctgtagaatagaaaattaaagggaaaaggtcctaaaaagaattcctcctctgcctgtcccgtcttgcccaaatcctcagaatgtcaatctttccccaaactctgcacactcttcaagcacttcagaaactaatactttggtatatcccaaattgactttcaaagaacgctggataaaattttcttgtaaaaagggtatgttagtcaaaaaaagtttgagacacactggcttaaagtcacgctaaacaagttgatgtgccacaggatttctcaggatctttgatatgcaaatgtccttgggaggcagagctaatccgcagtttggtagaagctgagccccttcccctccatctcacatacaaatgaggaagtgttttcaaggcctgtttgcactgccagtggctgtcatagcaaactagtagcgtccattggctgtcaggaattatgctgttggcacttccccagccccgtgactagccttagaggaaatcaggacccccctcaccaaaaccagagcccactcttagccacctgccatggtctcagctgaagccatgaggcacccctgccagccagttcttcacacctcttcttgggcctgctgttgacttccctcctgtcagctcctgggttgtacccttgggatgtgcaaagctgcaaatctgacctggacgttaggtcattggcccagaggactcagagttgtgttctttggtcctctgggatccagtagggcttcctgcttcactttcatctgctttctctacccagggtctgagaaaagtttctttggcaaaagcatttcattgccaaaaagaaaatctgaaagctgctgatgtagtttaacctcctttatttaacagttgaggcaaattaaggctccaagatgctgagacctgtacaggatcacacagctccttggaagcagctgagccaggactagcacccagctccctgcttcccagtactcatggtctttcggctgcatagctctacttctctgcaaagggtgctggggccgagattcatggcctttaactatggttcttaaatgttactgtgccgcagacccacccagggcactttgtaaaaattacagaatcatccatcttgaagggccagggtcttgggaaagttgcttcatcttttgaggctctagatggagtgttctttctgcgctgctgaacctggagcactgagaagcttttcctgctctcaggtgcatttgaatttgcatggtctgttttacagggcaggaggtgcaaattcctattgcttaagcccacttacataacaaactggccacaccttcaattccaaaaggcaatgcggctgcccactattgcagactatgaaaagtaaggtagaaacaaactctgggagccacagaggctactcttcatggacttatttaaaaggaagacctctggctctttccccagagattatgatttaggaggtctggggtggaagacaagaatctgcattttaaccagcacaccctcttcccacctccacccatgtggttttgatgcagttcatccttggactacacttggagaaatactgacttacatagtaaagaaccaaaactgtgtaattataggaatcactcaaacacccacatgctaggatatgaggctagaaattcaggtttatgattgtccaagtgggttagagaaagaagcaaggcatcttgatttttaatgtggataacatgtagcacaatgatatcatcctgataatctttttaaaattttttttgttattgagatgtatgaatatattatatattttggatattaaccccttatcagatatatggcttgcaaatattttcttacatttaaatctttaatccattttgagttgatttttgtttatggtgtgagataagggttcaacagccagttttctcagcaccatttattgatgagactatcctttctccattgtgtattcttagcacccttgtcaaagattagttaaccatatatgcatgggtttatttctatggtctctattctgtcattggtctatgtgtcttgtttttgtgccagtaccataccattttgattactatagctttgtagtacagtctgaaatcaggaagtgtgatgcctccagcttcgttcttctttctcaagagtgctttggctattcaggcaaataacctgatggaaaaatgggcaaaggacctgaaaagacatttttctaaagaagacatgcaaatgcccaacaggcatattgaaggtactcaaccttactgatcaccagggaaatgcaaatcaaaaccccacacctgtcagaatggctatcaaaaagacaagcaatgacaagtattgatgaggatatgaaaacaagggaatcctgcagggtacactgccagtgggaatgaaaattggtacagccattatggaaaacaacatggaggctcctcaaaaaaatgaaaatagaactaaccataggatccagaaagtccacttctgggtgtatatctaaaggaaatgaaatctgtgtttctaagagatatttgcacccccatgttcattgcagcattattcacaatagccaagatattgaaacaacctgagtgttagctggcagatgaataaagaaaatgtgattttctatatataatggaatattattcagtcttaaaaaagaaggaaatcctgccctttgcaacagtgtggatgaacccagaggacactatgctaagtgaaataaaccagacacagagggataaacactgtgtgatctcaattgtatgtggaatctaaaagagcccaactcatagaagcagagagtagaacatgtgttgccagggctaaaggggcttgggggaagaggtaatgggagatggggaagggttataaacttggcaatctaatgtacagcatggtgactgtaattaaaaatactatgctgtatatttgaaatttgctaagaaagtagatcttaaggcctatgacaccacacacacacacatacacacacacacacacacacacagagggaactgtgttattcagctctattgtggtaatcatttcacagtgtacacataaatcatcatgttgtacaccttaaatatatacaattttttaatttgtcagttatacctcaataaagctgggtaaaactgtaaactatagctatatttaaactacaaaactgtaaaaatataaataaaagtaaataagaagaaagtattaagcatcgccttgcagggggcattgtgagtactgtactgcatatgcctgcagcaatctgcacagatatggcccctgccttctggcgacttacagtccaggagggaagaaatgaggaagtggagcagcgaaacaccaagtagcaaatgctgtggaggagacagctggatcctagtcagccggggaactgcatgagtttccgaggtttcttaaaggtctgtatggtatctctcaccctctagcattttcagcagggagcagtctggtaacaccctagtactacctgtagtcagagacctggtggcctggaagtctataagatctatgtttaaatctttctgtctggtccgcagagctgctcagctcactggttggctacgaagcggaacacttgccatacaaagccctctgcgatgattagctcatttaaccctttaacaaccccatcagataagtagtattattacacacaaggaaactgaggtgctcggagaggctacataactgaacccaagtcagggaccccaactcaggtttgtttgactccagggcctacattctattcccttcagttccctcaacaggaaagatggggcaacatcctgtcctgtcctctgcctcccagttaaaaaaaaaaatatatatatatatatatatgtatgggaataaagacttcttgatgtgtatcaccaacatatctaatttggttttgaatgtgggggaggcaaaatgacattgacagataataggacttacatgaaattctggtttgtttagagatgctataaagagcttggcattgtcgactcatttggaaattcgacttccaaaggagcaaatgcaaagtatttctcaagccccagccctccatttttagatctgaagagggaaacaacaaggtaggtaactgaaagtctggagttgtttctatttagttgttcctaaaggcagggggatggactagaggaaacctgcaagggctttcgactcacagggttctttcattctgtgggcaccagttctctgggcatgagagatgccaaggagctggtgtgttttggagagctcatgctctgaagcacatcagaagaaccaatggttgccgcaagacccccttcctaatgcagatggagttttctgtgaatcccggaaggtgcacttgggtgggagggagttgaggggtagaaaaaggaagacagcccctacgttcagcagaacccagggctgatgtctgcaacagcataaagtgccttctagagtctaatcctggtcatccgtgtagcatctcttcttctctaaaccctcatcctaggctttctttcacgcttatggccacacacagtgaggctttcctctctgcccggaatccacagggcatcacccttcctctggagccagcttggggctttcctgacgtcagtagttttgggggaagccagtgtcacctcatctctgtcttgaagcatatttaactttcccaaatagcaaactctggttctttgagcaaatgacttccagatgctggaagcagcggctagtggaattttattgcccccaaactgtggttctgggctgcatacttctgacatgaaggtaatttggaatgtaaacattgcaagacgtgtgctggaattaattaaagcagccctgtattctctaaggcctgcaagcctgcaattaactgtttacattaacaccaagccaagcagatcaaccagaggatgcagggacccttgattttcactttctccctttaccttcagaaaacagtgaaacgggaaccaagctgacccatttccacagtcccaacctgagaagaggctgcttaagccatcctctctcgcacagcaaacaggcgacagcgtgagaagcctaactgggcatcacggggaaccaagggcaggcaggaacctcttccgcgatatgtcagacgtcagaggcttctttagccagaaatacaagtgtgcccttaaacacgaatggccacattcatggtgggcctgcagagaaaaaccgtggcatctcatacttgcctgataaaactagaaacagcttttgagaataattttgtaacttcatcatggcatttaaaagtagcatgaaagttttggagcaggatggtgatgatgattgcataataacgtgaatatacttaatgccaccgaactgtaaacttaaaaatggttaacatagtaaattttgtgttatgtatattttatcccccaaataaaagagcagggtgttcagactataaaggctctttgggattatgtaaactaggagaacccctggaatagtcctcatttatttcccccacgtaatacaagagggtgaagttctggcttcctgggaacaggcccacacaatgtcaggatatttcagggcatttatgtaaaacaccagaaacccatgcccctggagctgaccaatccttcacacccgctccgagtttgttagaggggtgactcttttggcagggagcactgagaaatgctgatatgtggttgccttcactattggctgtaactatgaaaagagttgctggaggctacctacttaccctctctcccccaaaggagaaagacttcagtatcctgcagcgtggcagtggggcaggcgtgcgggtgtgcacatgcgagctgttctgttgttgagactctagttgttgccggttcctccctctttatatgaagcaaggcaacacccacaacaaagcactgtaatctctccattgaccatccttctgccctcagatcaacacaagggccaattccattccaacagcattatacgactttgaaaatactctttgtgtcccgccagaacctcctcctcttctcttcagtttcttcctcatatgacacagcttccagaccctaaccaccctgggtgtctgctttgggtgtacagtagtttttcaggataatgcccagaactaaacccaatactaatagtggtctgctcagagaggggtatgggaattttatcatctgttctgttttgacttccatatgtccaacattatcccccaatgttgcatttcaaccgtcataccatcctttccttaaaaaagcttgtgatcatctgaagcctcagggattttttttttacatgaatgactgttgagcaagggctccccagtcctgaaattaggtaaatttatttaacttaaactcagaaatttactagaaatcttattcattatgttaaaatcagggcctttgatatccagatactgagtcctgactccctcacccactgtccttccctagctttgggtgtgtctatgtcttcatctgagttagaattctatatagcagaacttgattgaaatgctgtacagaattggcctgggagtacagagaccaccttttcagtttatatcaatcagagtcatgtgggtgtggtaaggccgccctgagtccacccagccaccaccatccagcttgggcttctccactttgctcccaaggattgatggagagtgtgcgaggactggttaaagagatgtatgctgtgatagacagggcaggctagcagggggatgtggtgcctggcatgtggcaggcatccactacattctgcgggctgagatggtcaaggtcatccctagcctccttgcaggtgatcattcagacttaacttcctccccacccaaaaagttgcctcaaaactgctcacaaagtgggggctttgagtttaatttctcctggagccctctggtaggacacgaatcagcaggaaactggcttgcaggtctttggaaagagaagtagcctaagattaagggcctagaaaatcccccagaaaaaaagagcattcctataatcagtgaggataaactaaatgacagtttgggacaacatttggtttccttggttcatttaaaacattgattcagagattggggactggcttttcctgacttaaaagcagtggagccctttccctctaatgtggacacatgctggttccctccctgccttagggaaggagtcggtcaggttggagctaagagggcccgggagggtctttcttggtgaagcagcattagccattggttgagactgaggcagacagggttttagctgaaaaggcttttatcgctttttatctattgacactttttcaattaaggagtctcccctgagatgatctatcgcctccctgtctgagcaggaaataattaccagcaaagcagctccatcacctgccgcatgttttcccatggccagggaggctcaggaaaatatcaacagcctgcctgctgctggcggtgcctatgtgggcacagggcacacggcctttccagatggcccagccctttcctctgtcttatcctcccccccacttcttattccctttgaccaaggtttttatattataccctgtcaccatcagggaatctagccacgtcaccttctctcctgggcacctgctcttctgaggagcttgcagccttctaggctgggtccatgcctcctcttgttccagggccccctatactgctcatatattcagatgcccagggacatgttccagcggaggctacccaggataacatttctatctcactgaggtttttttggagccttcaaaattccatgatctgatattttaaagtaaaagctttaaatataaatgtcattgaggtacagcacacagacggcaaaatgcaaacattgtgagtgcacagcatgaattctcacctcgtgcacacggctgtgtcgccagcacccgggtcaagacacagaacgttactcacacctctcgtgccccaactagtcactgcctcccttccccaggaaccactgccctgactcctaaatggcatagatccatttcccctcttgttgtacttgatataaactcatgaagtctatatttttgtctagatttcttgactcagaatcatgttcatgagattcatccatgcctgtagttttaaagttgttcatgttcatcggtgtatagtattccattgttcatgttcatcagtgtatagtgttccattgtacaagtgtgccacggtgtttctacccattctgtcattgatggatattttctgtctttttttaatggagaacatatgcatgtactttaattacctgtaatgcctaggagtagaattgctgggttgtagggtgtgtgcctatgtttagctcaattattgccagttttacaaagtggttttgcaactgagaagttttttcaatgtagaaaatgtgagaacatttatctcctcagcccctgccgacttgcctttatgaaagaaaacacagaggtggggacttgtgcaaggtgaggactgctatttcttgattcctggcctagttgcctttctattagcctgcaaggaacctctcttttgacggacatgagagaaaaggacacgtcctcctctctcccgggtcacactttcccccaacccattctatagctcatataattttccacaaagtgccttatttgaacttcaaatcttcaaggccagatgagcaccacagacgtggccttttcttgtttatccagagggtttggggaagcacagctccctgacattcattgatggatatcatctgcaaccgtctgctttccttttgtgccaacaatctgggcacgagagagagatgagtgtttgcttgagattgaatttatgacaacacggaaccagcctccatcagctagactgatgaatgcctgggtgaacatgccacagtttgtgttttttccccttctagtcgccacctttcttgattaggaagctgtgttgtcagtgtgctgacttattagggagaagaatgggctctagcaggcctttaaccatcacagttctcattcaggaaagaaacgaaggcaggtgttgtacgccccgtgcctcccacagagtcccgcaagctgtgagtgtcctcaaaccatccatccatcctcccttgaagggcttgggggaaggggtgtaaaagggaagaaaaaaccctattaattgtacgcacattaagttctaggcactattttaggtgcgtgtgtacaatttccggagcaaatgagtgaatgaatgattagttttaaaatacaattaagagttttgctggcttccccagaacagaaattttctgagacttttcctagatcacttttagcagtaagagtgccctaagaataatggctttttggtcaaagtctcttaatgtcactgaagcttgggaacatgttctcatcgggcaagagaacaacaacagaaaggaactgcattccagttccttgtgtataaaggtgctcctgacctctttggccccaactctaagggtaagaataaccataagttattgccagagggcagcaccttcatggacagagagcaggtgtttgagggtcccatgctccacccaggaagctgctggctccactaagagaatgggctttgggcctgttcagtttctaccaatgtggggcaggcccccaaagctgaacatagatggagacacagaagggcagaacagttaaaaatttaattccacctttgccatctcttatctgtatggtcttgagaaagtgcctgtgtttctgtgagaccttggtttccacatctgtaaaatggggagaatcatacctcccttattgggttgttatgaggattaaatcagtcagtgtatgtaatgtgcagggcatgtggtaaacgttcaagagtgtaggctttttgttattggagaaaacatttgtcaggtatctactgtatgcagacagaggccagacatgccttcaggtacctgcttcatgcacagctgaagctgacacatagtgctcagttagttacttgagactttgctttagctgacaaggaaagcccttggtcatcctgtataccgtgccaggcttggtctcatgaataggtggaatagcatgtatatggtcactgagtttcagtggagaccccaatggccaaaaagagaaatcccacctttcttgttgatgcccaaacaccatgaactcattagttcaccaacagaaaactcccaagtatctgctgaagttagggcttgtgctggcagcctgcgtgactgtgcgggtgtgtcctatgaagagctgatttgcagtggagacccatgtgcacaggcacaaaaagatggccagggacctcggggagaatgcggacactaccggctgactgctggtgagacttggactgaatgagaatactcatgccaagcacccagcatagtgcctgaaacataaaaggaaattatctcagacctactaggattttcttattaaacaaaacaaaacagaaagcagaaaacaagtggtggcatggatgtggacagattggaaccgttgggcattgctagtgggaatataaaattgtatcatttagaaaaatggtgtggtgtttccttaaaaaattacaaatataattctcataccatctaacaattccacttttgggtatgcaccctaaagaattgaaagcagggcctcaaagagatattcgcacacccatgttcgtggtagcatcactcacaaaagccaaaacgtgagagaaacccaagtgtccttggacagatgaatggataagcaaaatgtgaaatgtgattgcaagctttaaaaaggaatgaaattctgatccatgctgcaacatggatgaacctcgaggacatgacgcgaagagaaattagccagtcacaaaagacaaattctgcatgactctatttgtatgaagtgcctagagtaatggaatttatagagatgggaagcaggatgacggttttcaggggctgaagggagtggggaatggggagctattgaaggagtacagagtttcagttttgcaagatgaaaagccttctggagatcagttgcagagcaatttgagtgtatataacactcctgaaccacatacttatacatggttaagatggcaaattttaatgtattttcccacaatttttaaaaataattaaaaatttaaaaacacaaaaggaactcaaatgaatacttgctgtatctgaatccagatgaacagaagaaatccctccaagcactgtggccctgcgcaggccagaggctctggtggcgattggatgtgggaacacagtctgggtggagaggagatttcaggagagaagaggaaacggcgccatctccttcatttcataatcacactgaaagcagccctgggagaggtgaggatgcagtggcttgatctcatcctaaggaataaataactggcatcacattttaattagtggagaagctccgggagccaggcctgaggaagtgcgccttctgccggtgctcagaggcagacggggagagcagggggcgagccgagggtccaggacatttgaagggtggtgggtaggagtggtgctgcggatggcttggtctgaccggcccagggtttggaatagacagagtttttctcactcagttgacctagttgaccttcccctctgagaaaaattcgtgaggcatttaaagaatgatctttgcgccccttggcctgggcgctctccttctggggcgggaactcacaggatgagggagattttgttggagctgtggagtgtaattacaggcctgacaggtggcaagtcagagggaacatcttactctgcagccgctgaaacaatgattttaagcaaggcgacagcggagaattctccctattgtgcagggcaaccctgttgagccataagccagcaccacatccccagtaaaatcaatcccagtggtggaaggaggcctccatccgttggacctggcacccagcccacattgctcaagagctgtctctgggcctggtatatgctacgccctgtgctacgcttctgtaagcatatggctcctgccctcaaggggcgcagagtctagagaaggctctgctaagggtcccagaaatcagaggagtcaggctgagtgctgattcccagcttggaggagtttacagatcaccagacaggcaggcgccacacggcacctagaatagtgttgggcacggactaggtaccaaagaaagagaatggagggagagagggaaggagggagatggcatggggatggaggatgggaaatagggcagggagacagaaggtgggggacagggagtgcggggctagaggagcgggcagagagacagggaaggagggagggaggtggatggggagggttggatagaagagaatggagagagagaaggagagggaggagagcagggaaggaaggaaggcaggcagggagggaggcctactcctctaaatcctcaggaaaaggactgggaagctcagagttgagctccttttctgacaatagtggtgtttccaaggaccaatctttactctccagagtggggcttgtgagtctctcaccccagctgtttcctggggctgtgaagttcatcggctccttttcctaccccatcacctacctgtcacctgtcctgggcaggcaggggtccccacatatcactgcaccctcgtgggctcccctgccctgtcctggcagtgtacatgatgagcagcttacatgatgtgtagtgtacatgggggcggcgtgcatggtgggtggcctgtgggggcagcgtgcatgaaggcggcatgcatgggggtgccgtgcatggtgggcaacatacatgggggcagtgtgcttggtaggcagcgtacctgatgggtggcgtacatgggcagcgtacatgatggccagtgtacacgatgagcagccaccatgcatcaggaggaagagacctcgctcccacgccacagccccaggccccaggcccctgacaccctggctccgaacccccagcagccagcgggtgggttggattccagggtctccactcaggggcattgccgggtgagcctgagataagggtgtagctctgctcatttctggaggtctccacacaccctccgggcagacctcatcttcttcagacatttcttttactctttggcttgctcttgctgtgtattaaatttgatctggggtgtctgcaaatgttggtgctcacgggggtgtgctgggccgggagaggatgagcattcctcaagaagggagacagcagagcactagatgggaaggggctggaccctgaaagagcctgccaggtatccccttctagcaggaggggcccccagacatttcacttcattccttaggtgtgagtcatgttcacatttcagggaaaatgcacatccttcccagagctgaggaagccccatgagctattctggtcctgacaccggctcccaccctttaaagctcctgtccctgggggttttgctgcaggatggtctctgaagtctgcagccaagtatttcccttcccttcttagagggccacgtccctggcctcttctccagccccggggattcaggccattgggtgtgtcccctgcctgaggataagccacagtgttactgacctgggcccctgactccaaattgagcattagattgggtttccagtggttggtcagtgccatgaaaatcttggacttcaggtcctgtgggatccagctaccctcatcctaactccctcctttgactttattccaggctgacagagcagcctgcagttccaccctctatagctgcctcttggccttgcttttgtttaattcccatgtatttgttgaatatgtatgcatattttagcaaaaataaaaagtaagcagaacccaaataccaacacgtcctagtccatcaggtggcagtgtatgtgctctcagtctgagaaatatacacaagtcattaaatagcaattattgtaattagcagaatgtacacgtgattaatcaccctctgcccccgctcctccatttaccttgcctgtggcattagtggataccgtaaggggctgggagccagcttgtggtatagaggaaggagaaggggagggctggtttctctggggtttcttttctctctgggggtggatggttctttctgtgttactctggaccccctccaaggccacctcttctctcctccctttctctgtgacccatcccaaaacacggcttccctcaagaaaagctctctattaaatcagcagcttggaggtgtgcagtctcagccaggcattcaggccaaggcagctaggggtaggagcaggagacaaaaaggatgaggttcctgggtgcttggaaaccctcattccctgcacctatggctcggggatagtcacaggtcctgggtgacctgccagacaagctagaccatctacaaccctggggggcccagaggaggggcttccatcaccacacggatgctgcagcagcagctgtgtaaggcaatggatggctgaggctgcagcctataatcacgtatttacagttgctgcattatggaaaattaaaggtgtgtgaggcacagcctcttcagccaacagaggctgtctgcttgggctcagctcaggcagccagtgtcacctgcagctggaactgcttcaaatcctcctacctgtccaggggaggggctttttctggcttccaaggtggtcgttgggggggtgggggaagagcaggtgcctgtactcaccttggctcctcctttgttcctgggtgggatggatttgttctgttttctgtccacctgttagggcaacatagcttttggagtcccattttgagcaaggtgcattagcctggctcagttccttatctgtaaaatgggcacttgtacccatctcgtagggctgatgggatgattgaatgcaatactgcttagccttgtgtttacattaattagtttattaattctggtggtttgataaatattgagcacctacagtgtgtcaggatgaatgactctaggctctggggataaagcagtggctgagatacagcttgcatttagtggcatgtgtgagcatgtgtgtggggagaacaaacaactaagcaggtaaacaagtgaataaacaaggtaatttcatatagcactaggtgccatgaagaaggtaaagtcatatgggctgggaggtgcgggctctgagaaggtgacatttgagccgagacttgaatgaggatgaagtcctagccatgtgaagatctggaggagaagttgccaggcagagggaacagctcgtgcaaagtccttggggcaggaatgaatgaagtctgtgattatgttgtgatggcaactggttccttcctcgaaggtaaagtctggatcaagtttgcattaaatcccaaggtgacctggtggtatacatcagagaatcttccacctgggagtgaagggctgagttcttgggaggtgtcccagattagcctgatctatcagaactagacgcagctgctgaggctcattattgtgttcaatagccaaaactaatttatttatagggcattattaagaaatcgatttaatttgcactttgggtcaattgagttgcttcacacttgtgtgtgcacattgtttatctttacaagttattttccgtgcacatgtgcctgtgtgggtgatgaacaaggagaagtgcttgagagcccgggaaaggcacatctgcctacaaggtgaatcgggctgaatcacaggggcactggagccacccccagatgaagacatctattttcaatgaatgtagtaaagcttttcctaacttcagaagccagcaggtggactaagggctgggagggcccgagggcctgcccagcacattgactctggagactacgcattgtatattcctgccaccgtgggagactcccaatggccaccagtggtcatgatgcccgggcatgtgtggcgctgtacagtcatgaatcacttccatctgcacgatctgcaggctcagaacagccctatgagaaggcaagagagaaatcatcttctccattttacagatgaaaaatgaggctctgaaaccttagtggactgtccaggctagaaacgggaccctcccaaagtcaggtgttcctcccccttgcctccctctctcccttccttctgctcaccccaaatgctttgttgagccccttcttaccatgccgcgttgcacggcagttatgctgtggcattgccacctgccagcttgcctgggctcgaatttcagctctatcccatagcctgttgcatgagcatctgtctcacgaggttaccttggaagttaagtgggtgaatacatggcaggtacttagagcagcgcttggtccatagcaagcactccacaaacgtgagtggttgggtgatgaagtggccctccgcctgcctgctgcaccacgctgtcccgacgctgtctgttctgaaggtcctcaccactccccatagctgtggtccagccctggtctctgaagttcttctttcttgtcctctccatttacctgcctgttctctgtgacgatcctcaagccctatgctctttccccatcttctccctccccgccttcctccttccttccctgtttctcctctcttctttgcacacacgggagacagccagacacggctgtagctctttttcagccgaccttgcttcctctatctcaatctggtaattcacaaccctaaggaaatttgaagttctgaagatgttctttaagctcacaatccagaaaataataattttttaaaaagtatttcagcagccttcactggccacaatgttgaggggctctgctccccctggagaggtctctctagcctagatatgctggggttcactgcctgcagctgcaccttggcaaagaccaagggaggaagttgggcctgtttgtggaataggaaaatagtggcagaatctgagaggacggtgagtgtcgccatcagaataggattagagtagacccacataggaggcgggatcttcagctggccccaccacacctacccctcaccaccctgtcctcccctgcagtgcccacacactgagcttgctgccctggacctgtcccctgcgaccctcaaaaaaccagacctgaggcagcttccatccctgcccagtgacagctcatcccacagtttatcttctgcgagctcatgcttcctgttcctgggttgtagcccagcacatgaccaggagatttggggaaatggtgcattaacttcagggtgggtctaatggaggctgcgtagggcattgtgggagtccgtgcagggaggagcttttggtgggggagggggttggggcagggacctctgtctctgtctggaatcagaacctccccctggttcccagcagagcctagacggatgggggcgtacagtggggtagtggtggtgagtgaagggcatggagaagatgaaatctgagtccttccattccagttctccatcgcaggagccgggtctgtttatctggtgagtctggctcatgtagtcagtctggacatttccatttgagaacaagccagttggctctatatataacccaaatgtccagagaattgtcaatccttcccttcaagtctaaaaataggagagcaagtcccagttctgatgcttaaagatgactcactctagccactctagcctcagtttccctcaaaagcccgggggatggggctgacacctcagggcttccatgggcctggcacaaaacgtgaaaccacctcacagggccacagacacttagaggggcctgacaagtgttcatttctcgattcattttgctttggggagattttggattttttgtcatctcatttctctggaccaagaagggacaagccgcgcccttgctgcccgaatctccacctggtggcacctgagtttgtgcccagatgacacgctggagttgtcctgtttttgtccaagaccattgcacacatgcctgaggaacacacagcagccctgggtcccgcgcttgcactcggagctgcccgggccccgcctccccaggagaaaaggctccctgagctgcacctgctggagcaggcatgctgccaggaccctgatgtttcagctgcttctctgctctgtgattctgtctgaagtaggaaatagggcaggcttgctggtagactccagaggtcattaaaaatatgcaaaggaaataaacaggcctccatcaatcacttccttggcgggcttgcttggaagggtggctggggaagggcatgctgggtctggggcacagagctgggcctctcggggggtttgctgtctgtcttgctctccatgtgatgaactctgtcaggaaaatgccatggagtacctactacgtgccagggactgcgctggatagctttctgtaagctatttagtcgttactgttgcctggcgaggagtgaattactgtccatttccacagatgagaacactgaggctcagagaggttaaatgactgacaaaagaggttaaatcacacaggtttagacccagctctggtttcaaagctctgcctggacctgggctctctttcccaaggtctgtgccagccgagagccctctgcagtcctgtaaagcggatgagtgtgccgccctaccctggctcccatctcctatgctctgtgtgtcacctgctgtccggaggcacccaccctcactacagcccctcctgggcaacctctgcccaccatccatactatctggtctcgagacccatttcctctgagctgctctcacattggaaaattatccaagaaactctctgatacagtgagaatacctggtcgggaaatagtagattagtttactaggggagcaccttgttttcacagaggcaacgtgttttaacagaggactcctggaaccaatcctaagaagtaaatgtctaatagttgaaatttgttctttttgggtacatggtatatggtttattggaaggaatatcggctgtagagttacatatcaaatcccaaccctcacttactcgttgtgtgaacttggacaaattatgcaaactctctgagctcccactgtaccatttgtaatacggggataagtgaagttacgcacacaaagtgcacagcacagagcctggcattcagcaggaccatcaataaatatgagtttccttcctttccctttgagggcaaacaggttttgctgctttccttcaagtcatgtaatagccaccaacttcacttatgcatcagcccagccctggccatgtagacaaggtggtggtgttctgtacctttcgtgaagggacactcaggccacgagctctgcggacagcaggaagttttccctaggccagggaggaagagggggactgaaataggacttccttcagacatcgccaccagccgctactgtgtgtgcgagctcaactggcttttcccaaggggcccttcattccactcacggcaaacatcagcctggccagccccctgaggacggctgtgaggaagggcacacaagggcctgcagaaactctgggggcagcagggggaggcaggactcacccacatttcagggggagcgtttttgttcttcatcatcaatttttttcagaagggcttttgaggggtggactaaaggaggcagggagagaaaaaggaggatgacgagggaggagagagagagcagagaaatggtgcataaagggggcagatagttaggaggataaaggtggacggtataagctgcccttcattcagagggaacgcgctgatctcatgttcattaaccatcagctgggaatcttgttaaaactgcacattttgaaaacttaatgcaaatctttgaactttgattcaataagtctaaactagggccctaggaatatgcattttaaccagctcttctagcaatttggatgtagatatttggagaccacactttgagaagtacagaaccttcagctgggccctggaatggagattctcgaaagtcccaggctcctttccctggtaaaagcagattctttatctcattagaggggctgccactgcccttggactacaggagctattttccaggaatgtaatcaggcttgacccctgcctcctagctctcgccatgctgtgtctcctagtaaatacctgcctgcaactcttggcattgtttttggccttgagggcccagcctgtatttcaccctgttctcaaggcctggctgcattgatcagcccactggatttactgcctgaaacaaagcttagcgtgatacttgatcgatctctcctcatttcatgtcactcagaatggctcctgctggaaggtacctgagagacgatctggttcaattgtccttaaccagggtaggcatcaacaactgcttgtgaagctttgtaaaaataggcagggccaaactccaggaggctcctgatttggtgaacattctctctatagtgccatggcagatatatcagttaccctctagtattcattcttgcctccttcttcctctgctgggaatgtggatgtgatggctgcagctttagttgccatcttggaccatgagtaggagatgatcagctagtgagctggaagcatctggtgtccacagactgagtggagtagactgttcacctcggagttttacataagagagaagaaatgaacttctatgttgtttaattaacaaaaaaaaaggaagcccagacctgctccttgagattgaggtcctggatgctgaattcctgttcttctcaattttccgctagctttgtaagttatttgcaggtaactgctgtacgtatacttcctttgcagatcttacgaaatgaaacacactgccaggcatctacagtcaaacaacaaacacttagctgactgagcaagtggttgattaggttgcctatcctcccctttctactcaaagaaaatggggttcattggtagcgtcaggaattctgggctttcttcctgattctgattctgatttcgttctgtgccttggcattcactgtggtccacggtagaatgacagtctttaaccagacgacctccacactccatccatttctaacattctgacctaacggtagttctgagaggtgttcgtgtggtgtgagcaggaactcggaatacgtgaacctgattggctaagcttaccttgtggttggttgacaaatgactaggaaatggatggagttgagggttgatgcaacagcgtaattacaaggaagatggtgaacttggaaggttgccttgccaaaagcaaaacgaaaattcagttacctcattataggtactcatgaaggaagatggtgtcagaggaaaaatcggcatgactggacctgctgaggtgaaatcactgggaggtgaggttgtacctgaaaactggacctcagtggaaaaccctcagatggttcctcaccttacttcctccttcacctatggcctgttctcctgaatatccagttcaaaagatgagatcatttaattactctgtaggagaacatatcttccagatgccctagataggggggcagttctttgcagaggaagattttgatagaacttcagccaaaagagtagtttcattagatctgtcaaagcggcaaggctgctggctccttttctccccgtgcactgagagtagagagggtgctggctgtaatatctcttgccccccaaatgatccttgagctttcaaggttcacagaaatttcctggatgccccagttctttcttcttagtacctgggtagcagaacctccctggggatactcagctccctttattagagagcttctgcccagtgaggctttgtgcccaggtttaacataagttcctggggtgctgtgatagcagtgaagtcactaggattctagcatttttgcccccttcttttattttaatttgtccaaaggtgtgacttagtactgaccccagaatgggtgttagaatgagctgaagcgatgggtggattagtcaagtttagctccaaatgcagccctgattgtctgcttttgttcattctccctaggaaaggcattaagaaccccaaaagtgaacattagtgaattatcactcttcagaccaactggagcagcttcagtatggaaaacataggtgggcatgggcttgatagatgagttttatggaagctgagaactgaatcaatgaatgccacttggtctgttcttgggccatttattcgccatcttggtgcaattagacaaggatgtctagatgggggcttttactgtgtcagcttcaattagcaagtcatttttagttgttgctaatgcatcttctttattgtgccattgatcaattgcaacattcactttgacagtgtgggtagacaaggccactcaaggcagcctccacagaatgactaaggagcaatgcggtgtctcatctgggaccaagtggaatttgtctgtgtaataatcaggtgaaattgagtactgcttgttgtcacccttgttctatttttacctctcggattgattttttcaggatcaatgacagtatgggcattaacaaaatttgctgtggatgcctcctggttttgtgatagataactaaagatagcaccctgaatagcaatgttggtatacaatggcttcctggtcctgttggccacctactgagtctacaaacaccgcagatcgatgctgctggtctaatgactgcatttcagtctccacccattttctctaccagtatcatgttcttttcctgtatgtaactttggaatggttttgattagtggaataacagcatcaacagtttctaccgttattacaatttttcaaacacatggaactctgtaatgcattagccagaattaggtgctctgtcttgacattacctagctgtttgccctactcaagcccaagtgtggaaacttgctcatgaggaagagtcccttcacctgcagtgtcagtgcaccaccagccaatgcagtgagggccgatgcctgtccccatcaatgaacatcattcctttgtgcctcttgtcaagcaagtgcatcctattctgcacatgccacatgctctatcccgacttgtcactttaggctcttccagtctaccccccaaaaataataataattcttgattttagcattttggcaaaaggaaccgtttttgctgctatagatgttgtgtggttgtgtgattatggggacatggtgaagagtccagtgtgcactttatgaagttcacattagaggagaataaagtaggaaaaggggaatgacctaagacaaaaaacaagtggcagctgggcggctgtgacttcactctcatagtccttgtagtgaataaactcccctaggaaagggccgtgctgcagaatggcagccacttcttgtgaaggccatgacagctggattttgctccaggaggattagaggtctgttgctggaacagttgagccccagatggaataacgttagttggtttacatttaggggccgtgttgtttgaaaatacatatctttaaacactggaaacccactcagtgtggtgaagaaggccacaggaactaagaaagacaagctgaacagctgtcggggtctccccactcacatggggtggacatatgctgagagaagggtggatggtaccacacatcctgtttgaattgcatcctcccgccctctcaccttccctccctctccttatctcatagaggaatttgcctacgtaggtcaatgccatggggcttgacctgagcatgagatgccggggaagacctgcgttctcgtaggaaatgtatcggtgtgggaggcctggggtacgtgagcttggaggatcacctcatattgctaagcctcattttcccatctgagaaataaacaagttaacattaaaaacaagataatttgaaaaagaataataactaagatttattgagttcctccatgtgctaagcactattttaagcatttaagtgttttgactcctttaatactcatgatatcctgcaaggtaggtgcactgattagccccattttacaggtgggaaagctggcgacttgatttgaatccaggcagcctggcttcagtccagaggccaagtgcttagccaggatgctatttttccaatgtcctaaattatgtgggactaggagagaaaaacagttttaccctgcaacctttataaagcccacttggccagatggagatacaaaaagcaatttctaaaaacaacaatgataaatcagtgatgaagggaaggattatataataaatggtgctaggacaattggttagctgcttggaaaaaatatcaaagcgatttggatcctcatctcatacagtttgccacaatatattccaagttgattaaatagattaatggaaaaagaagaagaaaatagagtatcaaatgtctgactgggggaggactttaatagctcaaaacagtgaaagaaattacaaaaattggggatagttacaactttaaaaaactggaagtctctgcatcaggaataaaagagcaaacaataaatttgggaaagtacttaccacgaatgtagtatttttccttaatatccatatttaaatatgtatctaaagaaatgcgaagactctgatagacaggtgtgcaaaggagccgtatgataccctaataacatttggaagtgttcaacctcagcaataatttaaaaaattctaatttaaaaagaaataccatgttaatatgattatatttattcatctatatcatatgtacatgtatggatgtatatataatatggattatgtacatacacacatatgtacatatcccaactcgagagctgctgaaaggacttagaaataatgacacccctagagcaatatgtgagtctagcatctagattttggtttctaatattgtgctttactgaaaggaatcaaaggcaaagtcagcacaagagagcttcttgctacatctggtgccagaaagtcatgctctcagaaggacgaggtcgtgtcaaaggacacagaagtcccatccaagagcttcctactgcctaaatcccggataattagagcatcaaaagagaggagacattaacagcttaaataagaatccatgagtctataccgacatacggaagttagtgaataaacggggcagaatgaggaaaacttttccttaggacataatgccaactaacaaatgtggacacgccacccaatgtgatatcccaagatggacccaacatcacttccgtggtgctcctgcccaaaatgcgtgattctgagctaatcaggaggaaatattagacaaacccaaattgagggacatgctacaaatatcctggcttgttctttttaaaaaggtcatggtcatggaagacagagggatggagagaactgttttagattaaaggaactaaagattaaaggaactaaagaaatatgacaattaagtgtaatgcatgacttaggttgaatcctgaactcccttttattaaattttttttggtataaagggcatggggtgaaatttaaggcctacagattagttacagtactgtgtccatgttaaatttcttattttgctcatcacagtatatgaaaatgtctttgtttctataaaatacatgctgaagtatttaggcataaaggacatcctgtttggaacttagtctcagatgattccaaaaaaatatatgtgtgtttatgtatgtgtatgtatgttacatatgtatatttctgcctacatacctatctattgaggaataataaagcaaatatgacaaaaatgttagcaattggaccatctaggggaagcatctatgtgagtgtctttctctgttcttgcaacttttctctaagtttgaaattatttcaaaataaaaagataaaaagaaaaaggcaagtgccctattttgcttgttgatgaataaggacaagccattgaaggagaggatgtgagtgtgtagcaggaactcctaaaccctagccacaggaaagacttggccagacttttctggaatgtaacttggcaatttgtattaagaatcttaaaaatatccataacttttagccccatttctgctcaaataaaataaacaaaaatgcaaagacgtatgcacaagtatcttatgacagtgtgacttccaacagtaaaatattggagacaatttaaatatttaacaatgggggcctggtgtagccctaccatggaataggatgtgcccatttaatgatgtctctgaagagtttttaacagcatgacagcatgcttaccttatcatgtcctgtgaaataccagaataaaatgtacatgcagtagaatctcaattacatccaaaatacgcattataaatctggaagaaagtaagccaaaatgtggagtatacttggtagcatttctccctactttttaatatttttttagtaatatcacattttttatcataaggaagtatcctaaaggcagaaaacaacaaataaagtagcaatgaagttctgagtctttctgtgactgtgtgacgacagtgtctgaacagttatccctccggcagtgacgagcagccccttggacatgttccagtcccagttcttcagacttcagaaagtggggaagactccgtgggggaagaggaggggttgctgatgtcatggtgacaacgtggagtgtggcacacctacaggtcttgatgggctgtgtgctgggcactccggaatctcatttaatccccctagtggataaggaacactaagtattggagagacagaatgatttacccaaggccagtgtgtagtaagaggtgcggctggaattccaggtgagattgggagactccaaaacctgtgctcttaattccagccctgcctggcctcctggatcatgcccatggtgggtgaactgggggcgctggcccccacgctgccatcctgacttgtcagcctgtttgcttcctcctctctgttgtgatttcctcaagcttgttattaaataacaagcatccttcctgcgttttctcctggaattctcatcccacagtggcctaaggggaaggcaaactgtatgcctgtgcataggaagcatgaccgcgccatccagcctccttccagtagcagtggatgcagccttgttagggtgattctgaccccttgttctccgtcacctcacaaggcgtaacgacaggggacagctgcagagagagatggaggttggcattcagaagcctttctgacagcaagagtgaatcaacacaaaatgaatcacacaaagacaccattcactgtctccccagagagcctggagaagaaatgcctgccatttgtgtagctctttttgatgttcaaagctctgtggcacacagccctccttagggtctcacaagaactccctaagaaagacaagacaggaattacttcccttaggaaaggaaactgaggctcagggaaatcaagttacttgcctcccgtcattggtgactaggtcagtcttctaacttcctctttatcccttcttactccttctgcaaacagtacgatgctgggcagagtggaagatcccttattgtctcaccctggggcaaggagatgggctagatcattcctaatgctgcttcctgcctcagaagatgaatttgcctacaagaggtgggccctccatgcttataaatccttctccttcaggttacccccacctagtgaaaaagatttacacaaggcagaaagtgggtggaagccatttggccactcatgatgtcttattctagaggaggccccctgaagtgaaggtgccacagcattactgcagttcagcagacatttaccagcatatgccagtcactctactggaactgaggagagagaaagccagggaaaaggttgccatgggttgagtcaaaagaactcattctaggctcaaaaggacaggagcgctggttcattaggatgctcaacttccaactagcagactgggcacatgtcctagagaggaattgtgctgtagtgaggcgaagtgggcttggatgtctggcaagtcatggttcagatactgactccagccaggcacggtggttcacgcccatagtcccagtgactcaggatgccaagacagtaggatttcttgaggccaggactttgagaccggcctggactacatagtgaggccccgtttctacaaaataatatttttttcaatgttgactttatttcttagctgtgtgacttccagcaaattctttaacttcattgaaactcagttttttcagctataaaattaagagaataaataaactgtcccattgtatgatgcaaggattaaatgagatgacagcaactaaaggcctgccaccatcaactcttggcaatttatttccctcctaaattagatagaaatgtcatggtttggggtttccattgtgtgttcaagaaagataagaccgtaacgcctttcttaaatgtctaagcttcattatcagagcttcttgcacgttctctttaagcttttcccccatagacctatccaatggccccaggctgaggcacccattccagggactcccacgcctgcttccaagctagcagtggcctctcatgagcctcaaccctattctgagatgctctgggtttggaggttctagtatctcagccacacatagtgccattttaccttgtcccagctggccaaagtgtgactgtgatcccctgtcttccccctcactcacccggcagcctcatcttggctgctggcgattttaggctgggttccacaagtggccccagtgatttatgatccataactcagtggtctcttccgccatgcctgcaggctcccaccttccggaagtcactggaatttaaaacaccatgaaaacaaacatctgtgatttacgatgtcaagagccatttccttcctcttgagacaatctccagggtgattttctttaggtcatctgctctgtagagcatattagttaaaaaaaaaaaaccttaaacataatgtagaaagatgtgcaggtatggaagacagaatggcagcacctttccacgggtggcagccatcagacagagcaggacatgcacagcgtggctccctcctgtccctggaaggcaggtctgctctgttctcttctttcacatgtgtctactcccagcctttccaggtgcaggacagggcaagcatcagaaacactgggtgagggaccggccctccctttgagtgcttcctccctgcacatctgagtcccatctgtagacccagagtgaggacatctgcccaacctccctgcaggctgttgtgaggtcagcagaggcccagaagccatggtaacttctataggagagacgcaggatgaagaaagttgttgtgacttttgcccagaattgtcaagaatacttcaagtggtatagatgtttttcccaaaaaaaagtaaggctgaaaaaaatcaaggctgatcctaaggctgttcaagtacaaacagtttgcaagtaatggaaaaagctataaaattttaatatagggagacctcaaagccttgaaaggaaatataaaacaactccaaaaaaaaaaaaaaaaaacaaaccctaagcatcctctttgttcctcagtgaaaatttccttactattttaagccacattgattcccaagagagaaactggcaaagcatggatggagaagcttcatttccctaccactgctgtgaaaataccctatgctaatttaaggatatagaattttctaataaaaacaaccagagtgcactaggcacgattattccaacctatctttctattgtattggtccatctactttgccgatttccaaaggaattagagacggctttattacatttaagataatatgaaagaagacaagtatagcccctctttgatttttatgttacacattgggcagtaggtttttaaagagccgtgtttgactctgtcctattttggggcccaggtacatgattcctatttttagcaactctctggtattgtgaatctgagatttcaaccaccagtgagtcagaaggtctggctgcccagagatatgtgactcagacaggcaggaatagtctgttcaccatgagatgagggcttaaaggggagcttttgtgcttagtgaaacacgcaaatgaaaacaaccgtttaaataggaacctattgcccttccggaaggctctttgcctgtccccgaaaattctcagctcacacccagggaagagctggtgctgctagctgggaaatgaggccaaccccctggctacttcctcctctttaggggccctctaaggcatctgggcggaggtttctgggtggcttcagccttcagaattaacacaacagcctcctgatgggcagcagtggtgggagaaaggagcgagtggagtgccatgtcgggcagggttgggacacaggatgagatactactcttttaagagtaagacaccgcaagaaaaggtggcttcccctggaaaggtgggaagcaacagattggtgttttcttgattagaaatgctatggaattcattcatccattcaccatccatccatccatccaaacaaccaatgcatatgggaagctggctacgtcctcggtcctttgctaggtactaggggactggtttccatcctcgagaagcccacaggcttgtgggaggaagataagcaggtagagaggcagcctggctgcaatgcccttccaagaccaaggttttgggattccaagtttctgaggtgttctgcatggtcagtagtccctgagaggcccttcccctgtagaactgagtgagcattcagggtaaacctggctaaacacagactagccaggaccattgtttctggccgtatgaacaccctccttttcctttcctccagacttagactccttttggagccaagcaccccaagactgtaggccttctctgggcgtgagcctgagggtcacagtgctcaccagccctccagcctcgccacagtgaagatgcttatcatggaggctgggatagttgtgtttttcgctggtgtttagatgttccagtgttccatgaaagctcctgaatctcttccctaaataacaaagtcctgtttggtatttggtgaaatgtttggagtgccgtgttcaaccaagctgaactaagctgctgacaaaatactgtctcagccctttaataataatagctaacatttgtatagcactctacagtttaacaaagcactttaaatgcacccagcccctttgagatgcgagggcagagttatcatgtgcgtttcactcaggaaaagtgggctgcccagaggaactgagtaacaccctccaggacccaccactggggaggccagaagctggccctcctgaaccaggcactttgcccttggccaccttctctgaagcctgtggtgaccacgcctcctcctctgacttcaggtttggtctttgcctctggtctcagccccctgtagtatcccacaggcagcccccaggcagatctccttaattgtcccctttctctgcttcagcacctggaatgactgtcccaggattaagtccacacttccagcctggaatcccctctctgcacagcctggtcctatcccaggaccctacactccccctcactacccccagcatgcctttcctacagccaggcaggacttggcaggagcatgccacgccaactttagaccccagtgctggctacatggggggaggagagggcaactcgttttttaactattgacccctccttgatgtctggcaaggggctaattagcagcaaacgtcttctgaatcagtaagtcagagaatcggtaaatgaagaaaacggacatctgtataggcataatagcatccccatgcagtccatagcaagaagagaccccagggtgggcgccttgtgcacaagggtctgtctgagatagatgccaaggccaatggacacatgccgtccacaggtcctggctgtgtggctcaggatgcactggagccaaaagtggctgcataccagaaatgtccccccacccccacccccatgaagctgatacagctggaaccatggtccccctccctccagtcagtgacactgaccaccggtggctcatctcagctgttcttttggcagatgccattcttttgctccccagagactgggtgatgtctgagagatagggttagggttggcaaggttggtgtgaagtgggtaactttggagcagcgagcgacccggtatgcctgtgcatccaggacacagggcccaggaagcatgagaatagcaggagccttggaggaggtgcccttgggggtggaatagggctcttgagggcttatcctaggcccaaggaaatgaagggaacttctttccttcttgtccctttcccccaacacacccccaagttgagctagcatacccatcatgctaaacaggtttaacaggttttatgatccaatctgattatcttattatgagttacagattgttttataggaaaaatgcttccccccatatcaataatagcttctcttttaatttagagaataatttcaaaattataattacacaagtacagtcacgaattgcttaacaatggggatacattctaagaaatgcgttgttaggtgatttcatcatatgtgaacatcatagagtgaatatacacaaacctggatggttgagcctgctgcacacctaggctatatggcgtagcccatcgttccttggattccgtacagcatgccactgtacttcagtactgtaagcaattgtaatacaatgctaaacatatctaaacatagaaaaggtacaaagtacagtataaaagattaagaaagtggtttgcctgtgtaggtcatttaccatgaatggagcttgcaggactggaagttgctctgtgtgagtcatgagtgagtggacatgactgcacactactgtggactttattaacagtggacttaggctacactaaatttataaaaaatatgtttcttcctgcaataatacgttaaccttagcttgctataacttttttgctttataaactttaatttttaacttgatgactcttataataacatgtagcttaaaacacaaacacacagctgtacaaaaatactctctttatatccttttttctatgtgatgtattctattaaaaattattttattttattttttgctttgtaaattttttgttaagaagtaagacacgcgcacatagtaacctagacctacgcaggtcatcaagatgtcatgaggtgataggaatttttcagcctcattataaccttatgagaccaccattgtgtatgtggcctgttgttgactgcagtgttatgcagcacgtgactgtcgtacatagtcattatcaaaaaattaagggcagatttttaaagagcaaagaagttcattcaaaatctcagaccaaagggatactactctcttttatgtgtatatccttccagtctttaccatgcaaatatggaaatatatttttttaaaaaagaatcctactacacatattactatgtactttggtttttaaaaactatatgtaatgactgtccttttgtggcattaaatatgaatctgcagtataatgtggaatcctgtgaaggtgtcctggtgttcataattcatctgctgtttggtgagcacgaagctgttttcacagtttcagcagcacagtgaagaataactttattcttctatatacaactttataatgtacataataacatatatatgtaaaataaataactgtattctatatatacccctttttgcagatgtattctaacagaaggatttataggtgaaaagttatgttttttgctttattttgccaaaaggcacttaagaaagcctgtccaaatctggattctcagcagcagaatatgaaagtttctgactcctcacacccatgccaacaggctgagcattatctttattaatctgaaaggaagaaaacaagtgaatgggacatagcattgggaaaatgctttctgaacccacaattactcttctaaaacacaacccaagtgccacctgtacaacctctaacaaaacatggctgaacccaagctggggcattcttatttctacctgtagttaagataaaattctgatcaacagagggatccggagggtccctggaaatgtattgagaggagattgatttgatccatagctgaagtttccttgaaaaaagacactggctgggtgtggtggctcacgcctgtaatcccagcactttgggaggccgaggctggcagatcacgaggtcaggagatcgagaccatcctggttaacacggtgaaaccccatctctctaaaaatacaaaaaaattagccgggcgtggtggcgggcgcctgtagtcccagctactcaggagactgaggcaggagaatggcgtgaagctgggaggcagagcttgcagtgagccgagattgtgccactgcaccccagcctgggcgacagagtgagactccgtctcaaaaaagaaaaaaaaaagacttggccttttaatgaaatacagcgatacggcagtaggcaccttcaacactccctagggggagtggacatgaacgtttttgcatgtaagacttggtcgaaagccctggtccaggcctggatgtgccacttgttacccttgtcacctggacaggcctcttcctgttttcacctgcggtggcttggggcagtgaggggagtgctggggcactggtcacacagatcctggttcctccctgcatcctggctgtgtgactggcaggcgatctgcagaaagattgtgtctctgacccctgggatagcgtgaggattagagcacatggtgcgagcttggcacttggtcattgttttcctttggctctttccctttttcatctgttccagcgagggattaaactatctgatgtctaagaaccccatgagatccaatttcctgaggattccaaggcagcccaggtgaggccctgctcttctaagtatgaagttcagagtcgctgtggaatccccactctgggaggcagtgctgtgcgggccctgcgtttcacacaggtagccacaggcccctgtgcacacctgagaggcagcctcccgcggagccctgctggactgtgacgttatccacatgccttagcagatgtctgtcattgtcttcttgcctttgtgggtttgtcctctgtttagaaaaatgaatttcctgagggcaagaccaggttcatcatctcctctgacttttgcctgccctcaaataagtctggaactagtacgagcacgtgtgacggaccctcattcaggggtaactgactggttgataaggagtttgactggcaaggaagtgatttcaatgggtcagcctctctggccctggctgtgatgatctgtttaccgcagcttaaccttagtggatttcagcccatcggcacaacccacatagccccattcagctcatggctgcatttaaggcccactgatagcctcggatttggggagtgttaaccccatgctgcttgggtatgcttcgacccaacctcacgggttaaaatcatgatggtgaggtattacagggcccagtcatttgttaggaaataaaaccagactgtttccaaagagtagagaaataggatgactcatgaagtattaaccacttaaaaaccctccttaggcatgtcttcccttggctcccttgagcggtgtcacccgacagattgcagtatgattgtcattgctgtgttgaagttacccaccctgaactcatgctgggtatcctcagtcagggcatcgttctgtttgtttctactttgtgcacataactggtaccttttcttttccctgccctgtctcgtcacttataatataaagggagttaatccagccacttgtatatcctgagtcctttttgtgtatccagcactttgtaaatttactataggcattcattcatcctcttcctcattcaatccacaaatattgaatatccacaactggcaggataacagccagttgctttgaacaaagagtttctttctaagcccatgaatgtgactatgcctagcacagtgcctggcacactgaggtgcccagtgcatttataaaaagcaactctcagggttcttgacggagctgtgtcatactgaagccccctggcctagatagattcgcctggatgaaacacttccctgccttcttaaacagaatgcattgaatttactttcatcttttcctgatgcctccaagccatcattttgaacatcagtgctgcagtaggatgatgtgttgcttctgttttattgaggtataccagttctttgcccttaacgttaaatcagcctgagtgttgtctttgtgagcccttgtgtttgatttctgtagtttgcctccttcccagcagtgaaactgaggatgcttattttttattccatcagtgaatctttgtgataacaagcatcttacatttatttagcagttttcatgtgcattattttatttaagccttatatcagctctgcaaggcagataggatcatttccaatttgctgattaaaagagaaaaaacaaacaagcaagcaacagactgaagctttcaagagctcagcaacctgccaaagatacatggctagaaggaagacactgggattcaggactgggtgtcctgattctaggctgggactctttctgtgccaacatccttcttccctttagcaactcccaaccttctttctagtttggtactggtaatctgccacaaagcttgttaaaattgggcgcaaaatgaccaggtgaaggtttaagagtctctcctttggagacagtgtttgagatttagtgcctgggttttgtggcctctctctatttggctgttcacaacctttttcttctctctgtctgaagtgtaagcaaggaggaagggtaacagatcgaattgccagatttaacaaaaaacaaaacaaagaaacaacagaacaaaaccaaacacaagatgcccagctggatttgaatttcagatagacaacaaataattttttgtaagtatatcctaactgttacatggagcatacttatactgaaaaaaaaattatttgttgtttatctgaaattcaaatctagctgggtgtcctgtattttatctgtagccctaataccaggactgtggctgggtgggcagtgtctgatctgtaatgacagcagagtcttcagtaagagtgggggctgggaaaataaattaatgggttgcagaatgtatagtgttaattagataatgcttcctggaaaagacggatcttgagctattatttacagggcagtagggaaatgatgtggccgctagctgcagaaagagcaactcatatgaaaaagaatggcagaccggagaggccaaggctcagagacacatgcacacaccaaataagggtctgtttactttgactgtaaaagtgtattactttttgactgcaacaatgtttcatctcctgcctaacataatgaccagtttggttcctgtcctggaaatagagaaaacggtgccaccttccccacacacttgagttgatctgacattgatagtttgaaaactttggttcccccaggcagtaaatttaaggagcaaccctgtcttgaaaacggaattaggttaccaaagacttccggcagttgagaatttcttgaaatccagaatatcatattttcccaataatgccttcttgcgatctcacacatcatgcttttaaggccgattgctactactgttaggaaatttacctgtgatggtctcaggtaatagaagttgtggataagttgaaaattgccagcctgttaaatggaatgatgtagcaaagaaagggcattctttttgaacacttcctccaggtgtgtgagcgtttcacactctgcattttcacagtatctttgtgaaggtagctctgggttctcttgcaccctggagaggtaggaacatgcctagtgccctcctgtgagtctgtcccctctcttctcttattaggggcatttgcattacaaatccacagaccaagcaactctttttaaaacatttatgttcaactgcttttttgagtgcttatcattccagagaatgtgaagatacatggcccaaaacctcctccctcaatagtgtcttgagtgcggagtctgtgggctgtcctgggatgggccctcaccttgctttattcccacagcacacctcactcccagatgaggatgtgcgcctatgtgtgtccctgtgtgtgtggaggctgagactgcaggcacttgcccaatgccccatgtagcaccactgagattcaagctcatgtttttttatttgaatgtcatactttctacttgccaggttactccatcaaaacagtgataacaaaccaggacagggcagatggtgcatagtggtggcagaattggacagatttaactgtttctttaagaaatatttactttcttgagcatttactgctgccctaagagactagctttggggttttcctagcttcgcagaagtgtggacgttgattccagcttttcccaaacatttttggccttgaaatgaagctgggaaccatactagatcaagctctctggccgtgagccccatgtctgtgggtttgaatgatctagagaggaactgcatgctcaatcagaaccagcaggaagctgagcagggttagaaggctcagtccctctgagagtaggaagagggcatacctcaggagcttgccaagtgcgcagaggtgaaagggaatgtgagagagtctatggggcaggggtgacatttgaacagggaaggatgctgtggcatagatatcaaggctcgaacaggcagctccccctgtacgccaggcattaactggattggtagctggattgcgaagaggtccaggagccctggaaggagggccacaaggtggaagattctcggtgagcatagggcagtggccactaaccaactggttccaaagtgttttaatgatgtaagtgcttagttaaatattaaatgctttattacacatactaactcagtaacttttacaaataacccggaagttagattttgttaatatctccatttcacaaatgttgaaactgaggcactgagtgattaagaaacttctctaaaattgtagctagaaagtggcacggctggactggaaccatctgtttaactttgaaggctgtgctcttaattacaaggtgacttttgtctccttatgcaaatcgcctgttactgtctctgcaggttgatctaggctggccactagaaatagttcacttcaaaatgatgacatggaggtgactgaatggggtgggtcatatggtacagccgtgatcatctgtccctgaggtcctaaaatggagtatggtgagatgtttatgcttttgaaccttcatgaacttttccgctcttccttgggccaaattccaaggtccaggacttggaggaagggaagtagaaacccactcgcctcctcaggaccctgcctggctacatgaaacccccattaatcacctctgacgcccgggcttggtctgtgaaggaacgtgggccgtatggcagtgatgggaggaggctgagatagtgctgaagatgcacagcctctgtgttccatttagaaccgctgaagctccccaggtgcaccaggagccttcccaagacctggatccgctgcaaggtgatagccgtggcttggttgtctgtgggtggagccgaggaaggcagaggtgtgcgtgtgtgtctctgtgtgtgtcatctctgtgtgtgtctgtgtgtgtctctgtctgtgcatctctcgtatgtgcctgtgtctctatgtaatgtgtttgtgtgtacatttctgtgtgtctgtgtgtctttgtaatgtgtgtgtgtgcctatgtatgtctctgtgtttgtgtgtttgtgtgtctatgtctgtgtttgggcaagactgtgttccacccccttccccaggcttgggacaagctcacattccacaggtcctagaggaaatgtttttgctgtccagggctttgggacaatgggcttgctatgttttaaattttgggccccaggaagagagttgcccctgtgttaggatggctgtggctcagtcacatactcccccatttctcttagccggccccagtgtgtgtcctgggggcgtagtcactgcccttccaagcctggagaatgactgcatcgtccaccgtgatgaagtacaggctttgccagggcttagcagggggaattggaaggccttaaaaggaacatttagaaatcaggagtcaaacgtgacttggacattaaaacttgattttgcatccagctcatgataagcatatagcagcatatacacaaatacatacaaagcagtgtgtatgtggcaatcatttggtgcctcactcacctccaaggcttgttaggggtgccatgatttgaaccatctcacctctgcatttttgctggtgtctccctcttctcagaatgctagtcctttgtataaccctttccactggctggggccacagaccttacaggactaagaggccatctgaccccctttcaatgagtagggtgctcctctttgtgtaggatcacaccgcagttttagcctgtctgaactcttgttataattctttgctcccctatgttcctggagggcagagaccaagccttgctccttgtactacctccaagggtatgtgagcctgccatgtgtatgcagctagcatctgaatggatgaatgaatgaacaaatgcaccctttctcacctccccacgaacactgcactttccccacatctgtcagtgaggaatgaactaagtgagatgtaccagcacccatggttgcctgtcttcccgatcatacggtttacatttgcagttcagcatccagtgctgtgtgctaggtacatccacagcatcacagtttcatttcatgctgctgacaactgtttaaacttatcctttctggagggagatggggaaaggaaattaggctccacatttgtaccagtaaaaagcttcaagagagatcctgagtgcagcgggctgaggatcacagaagttggcaggctctaggcctgatgctcatagggtggtatcccagggcttcctctgacccagtcagtaggaacaccgctccaggaccagagaatcctagaggacaggagcccaggacccgtgggggccagtctcatagctcctgcctttgggatttgtgggagggtttgccttatgggattccattctctgagctccatccatgtggccaggccctatgccctttttgcctgactcatgcctgagcttggacactaaaccagacctgcccagtgatgtccctggccagcttctacaggaggacacatccccacattgggagcaggtcccagactcaggtcttgccctttctctgtccccaccagctccaaggggctgtgcacttggtaggctgttggagtatcacaccagattccagaagaggggccaggagcgggaggattatgccctggggccattctcaccggactgttggaaacagtctttggtacctgctgagagagccagtgccagctgggaaatctgtgaggtctccctgaggaagcttgtcctagaaactgcagtgaggtgactgtgcggcaggcccactctcaactcgaggggagcccctcctgcctgctgcaggagtgggagcgtggggctagctgccagtgggatggccccagccggaggagctgggcagtgcagcgaggcgccagctgtgcctgactcctgaggccttctgctcaccggaaggggggcaggtctgcagcccctcccccactgcagggccaggacaggccgtcctgagtgctggccctgaggatctagaccctttggatcctatgtgcgggggacttcccaagagctcccggcccacgactgagtcacgcggcttcttagcaacttagtcaatccaaacgtggaggtgattggcatatgtaagaaccccctttcccgttggcgtgtatggtgtcttctcgctgagccacagcacctggtttagggctacaaatagtctccccgagggaatgggctcatacgccgggtgggcaaggatttcaagtcgtcggcacaagaagagacactatattaaggcctggttatgtttagaagccgtccagagaatgtttggcatgctgaatataaactcatgcttccgtctgctgccacactttaagatttctcccagagggacccagagtgtggggcgccctggagaaggagctgggaatgtctcgggggaaaggttccttcctcgggaactgggtggcatgggagagtagcttcaagcttgctcatggctggacttcccagacacagggtggggctgttggatgttacccgtcatgtcagcattcagagcccggcaggaaaaagcctccttcaaagtgaacccaattcctaaagtcctccttaatggaattcctcttagaggcaggcatcgactggctaactggtatgatactttggagttcagttagcccagaatggtgaagaaaatggctgtcacccaaaacacactgaattgaaggacggtggtgccagaaaagactgtgggttatcttatccagccccttcatctataacatggggaaactgaggcctaatagaggatggtgacctgctctactgatggcattcagcactacaccaaggtcacgggaggggtctgctctaatagcatgttcccatggactggaaaacgtcagaagggtagaatacaatacaaacaccgttaggactgagatgtggccagcatgaagtcccatggtcctgtgtgagtggaaccttggtgtggaaagtggcccctggcagcgttgggacatagagcagtttgggtggggttctaactgggtatggaatttcaacagactcgcagggagattctctagtactgtctcaattggaatcatcgttttttttaaagttaagaagaaaaatggaagggctcaggtgaaataaacattttacaagcagatgcttgcctctgccagcctgggggcattttgagtaggggcgcagcatgcaaagcagagaagagctcccacgtctgccccctgccctcctcccctctggaattttagcccctgcttggcattgccatgggtgtgaaaggtggtgtctggactcaggaggaaggtactgcagagggtaggaagagctctgcagtggtcccacggatctggctttaaaccaggagctcttgcgagtctggagctacgtgagttctctgagcctctgtttcttcatctgcagaatggggataggatggttgtatgggaggaacgcaccttgcacagtgtctggcacacagcaccctccgaaaggggctctccatgtactaggtgctcaggaaagattgcaatctgactaggagttttgaaatttgtgatttacttagtcttggggaggaaagaagagtcgttttccatggatcagtatgtgtagatgtggttgcagagacagtcagagaaagaaatggagccaggacaaaggggtggccccagcattcacgaaaggtttcagaattcctttttgggtttttggctatgacacccctcttaggagtcatgtttgttcactgtctagtgagaaggtgatcttctagtaacctccttttggggggcctataaggaattccttcttgctgttcgtgccttctctcacaacactagtgtgagaccagagaccccacctcacctccatcaggtgaagatccaaagcagagaggagtccctgactggaccttccccaggggtgggttgtgatgagatgagtgattatcaacactgagtgaggggtggtcatgggccagatgctgctgaagcctttacttcctagcagccttgttaggtaggagactgtgactctcccattttacagatgaggaagttgaggtagtaaacagtcatataacttgcccaagcacacacaaatagtgatgttgctttgatttcagccagacagtctggctccagaatctgtctctttcatctctaagccttttaagtagcagaaagagaaagatcaagggggcaatggggcctgaatgtgtccacaatgatggcaaacagaagaggaagtgtgctgggctgcggggccattgatgcccatgaactgaagagcccgaatgcctggatgatgaatggctggtcaccccctcatatgggcagcagaggctgtcttcaggctcggcggctcagctgccattggcctgaatggagtcctcttttttccaagccctttcccctggacaattgctgagctctgccccctttcgcaggcacctccccatgtcgcaggacaccagagtcttcaggttggaaggaccctggaggtcaccctgtttattcttccacctgactcaggagtcctttgtagccttcttggcaggacctgtcgaatcaagcaaggatgatggagaagcccttggatgtccatctagttgatagaaagttcttgttcataaactcaagccgaaggctgccctggagcagctccagccactggccctagccaggccctctggtctgttccctcgggccccttctgaaggcaatttctgagtgaactgtttcagatactctaatggaagtttcttggccttggccctattgacatttggggatggataattctttcttgtctggggctggcctgtgcatggtaggatgtttagcagtatccctggcctctacccactgggtaccagtagcagtcacgccgtacccccagctgtgatgaccaaaaatgtctccagatactgccaaatgtcccctggggcgaaggtggccgaaatcgcctgggttgatctgctgttctaattctgccttgcccagtgctcagagagcagcccccaccccagcctccgatggccattggctgaagcaaaaccatctcccttcacctggcctctgctgaagcggcctggaataaacaaggcagcggtccccaaggccacttcctggccctggaggtggtctggtttcctcagttgccctgtcagcaatgggtggcatagggcctgccccacccttctgtccttcctctcctcaagggtggctgatgcaggagttgagggaccttagggtccagggcgtggctggcagtggagggatgggttatttctaaggtctttcccacttgtccttccccagggtgtgtctgcagtgatcttctcatttggttggtgtctgccatgctgcagaagggaaaacagcattgcacgcctgtgtcctggcttagggtcatgagagcgtgtttcctcccatgtgggttctgcaggtgcttccttgggctgcccctttccctacccctacccctaaatacatgcccaccacctcttctgcacaccgtgggtctggaaattacccaacaaggagacgggagcaaggaagagacatccccaggctctggaaagtcctgaggacaaagccaggattccggtcttgtcaggttttctgtctgcccagtgcagaagaccttagtaacctgccctgttatctgtgtcctgactcagaaatgtgttggttgaaacgtcaggctttcacccaaaatgcagcacaatcaccctgtccctagagccacaaaaattccctttctctgtttccagtttgttctgtagcagcttggtgtgaagacagacagtctagagcatcatcaggtgagatgctcacctaatgtcccagacctgcactgtgggccttggcagaggcaccgacttgaagacattactttcttctcccactctcctgctcatttgacgaggtctcctaggctgcctaaggttgtcagaaggtctgtatggtgagacctcaattgacaggccctctgaaaatacagttaccctgtaattaaattcttatgctaaaaaaagtcttcatcaatcatacaaaataagctgcctgcatttgatgtgtgtgggttgcaggaagatttggggaaacgtggtcgggtttgaagaccttcacaagacatgccaggtgaattctgtgtcgctgctgtcatcccgccttttccagtaatggcctcctttctttatcttggtggggagatgctggttacccccaaggatgctgaaattagcactgcattatttgttgggggaaatagactctgtggaccgttgagtgtctggcaaagaaaaatgagttcaggactaaccctgacatacctcttggtggggagatgctggttacccccaaggatgctgaattagcactgcattacttgttgggggaaatagactctgtggaccgttgagtgtctggcaaagaaaaatgagttcaggactaaccctgacctacctctttgttgtgatataggatctgaaaaggcccctttgacctccagtgttgccaatctgtaagactggataatgatgtcacactgactttctcagagcagtggcgaggaccaaatcagactctgcaagacaaatgcagtttcaacttatgaagcatacacacaagggactgatggattgttattgtggaagaaaaggggggattgttattttaaggaatcttgtccttaaagtaatcttggttgagcgctccacgtgcaaggcagtgttctgggtgctggggcgaggtcacctgtggaattggcaccgaagcaggtcaggtgggagggagtttagaggaaggccacgtcactctggttgggatgctgggggctgttgtcctggagaaagtggcctcaggctgagtctggcaggtgggtagaatttccacagggagagatgctggcctatgcagaagttctcacccaccctgcaagtctccaaggcctgactcacacagcagagtgagccccccctggtgctgggaaattctgaagcccatggggacaaccttgtccccctggccgtgctcttatcctccctacctgtcccatgccaggagcgcttctatgctgctgccttggaagactgtcctaacaggcggcgctgccgcgctcagcacctgggctgggaagaagagcacttagtttgcctcttggagccctggggctccctgcagcaggaggtggagagggagacgtggagggtctgcttccatcaagtcaaggtccgaagggccccatggaggagacgggtcagcagcctctgcccttggatttgccaagtgccccccattgtgttggggctcagggagaatactccagtttggagggcttcctggaggaagtggagcatgacccgtgcctcaatctagaggagatttgaaggggaggctgtctgggggtgggagagacagtgcaggcccagggctgagatggccagagcctgtttgtgggattctgatgagatggcttggctgaggcagagctgtgtggggagaggcaggggaaggagatcagggcggctgggagcacaccttctggtcccgaatgctgggctgtggtgctgcactgtcctgccatcagcagtgggccttctgtgtgtggcaggatgagacgctagtcatgtttgggtgtgattaatctggccactgtgttcacacaggttagaggaaggagaatctggagacaaatgcctgcccagcgaccactgcagggtcccgggagctgggtgaaagtggcagagctgggaggttgctctgaaatgctgatggggatggagtgggggctgtcgggaaggactggatggagtctgtttttccagaaccccttaacccagtggaagccccgcctttcatgtgggccccgcacagttaggctgcccgagtccctctgtcctcgcaccctcacctggctctcttgcctaagcctgtcacagaagccctgcagagcaggaaacacagagcagaaagccacgcacacagcttgtgtttcctctggcgcctctaggtcgctctgcagccacctgcttggagtggtgataagccaaatctttctttagaggagcgaaaacacagctagccagggctgcagctatgactgcagcctgtagggaaacgccgggaggaacaggagactgttgagaaggggacggagaacctcaccagcagctgaattgaattccatctttgagacccaagagagggaaaatgcctttccgcatgcatgctctcctagctatgcttgtaagaagtgcgtgcttctggttgggagagcccaggaacggagtccatcctttctcctggcctccagggagagcccagacactcctgaccacagactggcttgtaatttggcttttctgagcatggcaagagaatcctgcatgtcacttgggcctgacacctgcttttgccttctccagacacggcaagactggccttgacttctggttccattctcgtttccctgggctgctctccaccttccaggcttagctggagtaaccatttcagagctggtcgtttccccgcagctttagattccattttggtgaggaaatttacattacccaggtgtgcacttgggcaggctgagcgacctgagtgaaatgaagccaaatcctggaggtgcaggtgtgaggatgggtctgggtgtggggtggggtggagggctgaagaaggaggcgtaacattgtgtaaggttggatattaaacctactgcagcaaaaccaactctgcccgcttccccgggtatttatcatgcttaccttctaccgcacacaccgtcagtgtgaactattgcatagaaaagggttttccaacattgccaggtcagagctgattaagctttcacttaagaccaagagtggattaaactttgggatctgccctcctccggagggggagaagctggctgatgttcactgacatgtggctgcatggccacatcagttgttaaatattgagaaacttcagctgtcctgtgtccctgagtgcccatcccccatccaggacctcccacccccccacatttcctcagtggaaggctgctccctggactcatttcggttggtgggtgccaccgtggttcagtattttcagaagttcactgtagcctgcaggttatgccaagtcccttgacactgggtcctcatatttcctgctgctgtattttttccttatgagatagaaatgagacttgtcaaaaccctactgactctgttaggcccagcccaaatgtcactttgtctactaagactgccctggtcacctgtttcttggcccacctgacacttggtttatacctcttttatggaaaattatatttaacttcctattacagctatggcttgcaatgggggcgattttaccacctggggacatttggcagtgtgtggagacagatttggttttcacaactgaaaggggagctactggcatctagcgggtagaggccggggatgctgctgaagagcctacagtagatgggacagccccaccccagagaatgatccagcccaataagtcagcagtgctgagctgagagatctacaagcctccgtgtctgttcagctccttcctgggagctcccagagggcaggacacagctgcttgcatcttgccccaaccctctcctccaggcccgcaacccccaggaaccagggtgagacattgcatttagttggacactcaataaatggggctgaattgaattcatttagttaaatggaatcaaatcgaattgaacctaagctgccctgcagatcgttaggcaaatgcaccaattacctggtgcagtagcttagtctttcctttgcttcacaatcaagaagtggcctccgtgacctagactggggacttagggatgagagtgaaaattgaaaatgcttgcaagctgtggccttgagtggtttcagacacttctcatttattgtgcatcttaatgacacaagtaactctctgaccttcttgtctcaaaagtgatggggccaaaaacagccactgccccaactgtctgttgaggaaggttggaaaagtgcaggactgtccagagtctatactgagaggcagtgtggtatggagctgagctcctcagtgttctcacattggaacccacagagaagatgctcccatctgaactgtatgcccaggaaagggggcaggcaggcggctggctcaggcgctgcccttggccccaaggctgtgggagcagagcctgtcacaccagcagtgcattaggggcacactgtttgtgtgagcactctggtgaggcagaaaaaacatgacctgaagaggcagatgacctctgtgtggccagccccttcaccagcgctagctgtctgaccctgacctgtgggcttgccctcctctgtaaaggggaatagaaattcttccctgcgtccaggcaggggctggacttggtcagcttacgtgcctctccccaaatatactaagtgctctatatgcattgctcccctcccctccacctgcattcccattccacagatgaggccgctggggcacagagagattgtgttgcttgcccagggtcacacagctagtatgcaataatgaccggtttcaaactcagagtccatgccttggccgttctagagtgctgcagcatcctttctgtccacttctcaaaaatgcagcctctgcccatccttccatcctccatggggtcttgaaactcaagcctgctttgcctgggtgtttttaagctatgcttgcaatatgcgcagtcatctctgggctttttatgtgtcactcattgatgagaaccaaaactggacaagattagaagtgaggctttccttctttccaagattggattttctgttccacccagaacaacctgctgttccccagctgcacgccctggtttcaagtaggtctaaaattacaagagaatcaccttgctccaaggaagctggcatctctgtttcctgatgaaagtaggtactagagagtggagctacccagaaaccagggggtggcatgttggccatgtggaggcaaacagagctgtgttttcttttcttggccttcttaaagatgtatctaatttggggcatgttttgtttggttcatcttgtatctggagaggttcttcttttctccctaagtgacatccctcttgagcccacaattccctcttctcaaggtgagtaatcctctctctagctgttcataattgctaattagtgaacaaagaggctaaccaacaaaattagctattgggccagggtttaggattgaaccaaagggtggagaagggctttagtctgcttgttttttatttgtttgggttttttttccttaaaaaaaaaaaaaaaaaaggaatcggccaggcacagtggttcacacctgtaatcccagcactttgggaggctgaggcgggtggatcatctcaggtcagcagttcgagaccagcctggccaacatgcggaaaccccgtctctactaaaaatacaaaaattagccaggcatggtggagggtgcctgtaatcccagctactcaggagcctgaggcaggagaatagcttgaacccaggaggtggaggttacagtgagctgagatcatgccattgctctccagctgggcaacaagagtgaaactcagtctcaaaaaaaaaaaaaaaaaaaaatcgcaacaaaacatacagcccttccccactggtaatttatcataatcgtatctaaagtgttcttacccaacatgttcaccatttgaggaaaagttactgatgattccttatctcatcagctatggaggcctcagaggggttttccaaaggaaatgcctgacctcagcataggatggaagaaggaggtgccgttctccgggagggtgtgtccaccccagcccatctgccaccaggctggcctaaaagaagcggcgtcctcctgtgtgtgtgtgtgtgtgtgtgtgtgtgtgtgtgtgtgtgtgtgtgtgtgtgtgtgtctctttgtcatcttcagcatatccagtgcagaaagagatagaggcattcatattcagcaaatgtttcttggcatgtaattacatcatctctttaaaatctcattacaaccctttccatttattggaccaagagattgaggctaagatttacagacttcctctgggccacacctagtaagtggcagtaacaggaattaactatactctctaaagtcagtggccgtagtgttaggaatttacgactaataaatgccaattctgttgggaagacaaaaattatcatataagaaaggacttgaaagaaaggagaagtgctaaatgacgagtttctaagtgcactaggctttctggaaactgcacaatccaggttaaccgcaagcggtgggcagtttgtgggtgagagaacagtgcgcacgcccacatggctgttctgtgagatcacctcttgggaaatatttagaaactggtgcccactttcccaagtttccagcaaagcctacagtcactgtcctcactggaggtgcagtcagtgttcttctgggcccccgagactgggaaggcagattcttactccatttctgtgcctcttccactgccctctcttccctctgctgccttctccctttccttctgctctttgtagaaaataggtctgcagcagccactgaactttgtctctctttgttctgctcttggtcttacttcccttctttctccttccacctctcctggctgatttttcatatcatccccatgagaaagctttttgccttccttaaaaatcttctcaaaagtgaatttctgcttatggtttaaacagataccattgtcagcaggggtcagtgatgacccacccatctcctacactccttccctttgctctctggttcccacattcgattctgtttcctcccacttgctcggtccttcgggtagtctcagcttgccctgatctctaccacgtgaatggagggaaagctaagccgtccttcctggctttccagtgagccagtgggtggaccttcagcccatagactcaccttcctgcctatgtgagcatccagaaaacttttggggtgtgttaccaaggagacaatggagtatttattgtactaccttccttagactttcttatgcaacctgccctctttcccggattgctgtgatgctgcagggaggtttcttaaattaatcttgtcaaaatagccttcgaatccttttggagcaggatttttttttttttttttaaatctcacaagacacaaactgttcaagggaagaattaggaacaaagacaacttggggactggagagaacttggagagcatttagagaaaagcggggaaatgattgatgggttggaaaataggagcatggatgaatggtgaggggaatggagatgatttaactgggacagagaggctgacaggtgacctagtaataggcttccagtttgtggagggttaggacatggagactggcttcccactaccagggaagaaaagacacttaaagtgggaggtaggggagcctgaggctacaggaagaactccttatcacagggtctgttaattatagcaaggcaggatggatcacaagctcttccaccaagcagtcttcccagacgagagcagcactgggacggtggtagggatttctgtaagtcatccagtgcacagcttcccgatcgcttgtcctcagatagtagcgagatggctgcctcagcatctccagggacacgtagtaaaaaatacaatttcgtgggccctatccagacctcctggtttagagtttctgggaggaaagtccaggtgtctgtattcttaaaacacacacaaacacaccccacccccccccacccccccaccccacacacacacacacacaccccaccccaccaggacaaatgcagaactaactcattgagaaccaagaggctggtgatgtgaggaaagaggaaatgcctcccccggattcctcaggttgctgcctgcagcatcccgctagatcttccactgcccgggagctgctcaggagcccaggccacacctgccctggtggctccgtccagcatccctgctgggtcacttggaatggacgctggggcatcaaagctgccctacagctctgaagaacccctgcgtctctccctaatgacaagggtgctgggaaaaatgctcattccatgtttttatctggacttcaccagcagtcactgaagtcttaggtcacagttctgtggagttttccaacgggtccctcagacaccaccgctgccccacaggggctagaatggaatgagcttgggagtcaagagatgtatctgccttgagcttgagcaggtcattttacctctccccgttgcagtttctttctctggaaaaggagacacccggactggacagtctctgaggtccatccagctctacctttctgtctctactggctgtttgaagaattgcaatgctcgaagagtataaagtagattcagtgtaatatttcgtagtgaagtattttaaattcaatgttttttttttctttgcataacttatcctagggaagttgggaaggatgaggaaaaatatacgaatccactcgtctccagctagctcagcttgtgtgtaggcctgccgttcaccacacacgaccatgcgcaagctctctggtcccttggtggcagcataccaaactacagattctgttctttggcctcagaacagtcttgtgtatgttttaaatgtgtagcttggaatcaacgagtatttttcatggggagactaggaaggttggggggctgggatcattatttcacacacttatttgcttgtttcttgctgaattccagattgcggtggtactttaaaaaaaaaaaaagctccaatatcaattttaattttgcttctaaccttttggaccagccacaccctgacacttaaaaaataataatgaaatgttagtataagaaaaattgctagctgactatcccagccttcctccttagtaactaaacctgatttggggcacattgctacctagactgtaatagactttccagtgtcctgcatggccaggtgagctctggacgatgatagagataaactaaattactgtaggctataatttaaggaagcctcctttaaaaaagtaaggaaaggatccttttttcctttctcccttcctcccttcatttctccttccctcccttctgcctccctccctccttcccagggtgcagttgtaatggctggagttctagcagccactttggaccataagatggaagccaagcattgaggatggcaaagcagaaagctgaaagcctgggacaggatgaccatggggctgccatcccatcccaggactgtctcccttcagacatcttttatgtgagagaaaaataaagccactattatcttttgttttatttatgcagctgcaccaaattctaatgaatccatataagttccaggtgagctggcttagatggtgagaaccaaggtcaaaggcaaagggtagccctgataagcaaatgccactgctgagttgctcagagcagtagacttttgctataacatagcacaggaaaggagagattttggagacagatggagtgtgacgtcgagctctgcctgagaccgactgtgatcttgatcaactgattgtcttgagtctggatttcctaatttgtaaattagagtaataatctccaccccgcaggccattcattggcattagacatcgtatgtattaggtgtcttgtttagtacctagcacacagctggtgcttaaaaatagtggctctgtgtgtacataggcacatggtatgtccccctggccacagacactgtgctatgcgctggggacatacagaggcatacggtgtagccccagctctgagggggcgtgaaggccactgggacatctccagtgttgtagcatggggcccaggtatgcagcctgtgtgtgccttcatgctgtgatgcaggcttgggaatgcatcccaagcctgtgtacagtgccagagattgaaggatcccatcttagactggcacttcttggccttcactcacgtgggcctgtggctcgggatacttcccttctcctttactccttctgaatcctacatgtttttgtggcacgcggaagtccttcctcccccatagacccacccaacctagtctagctaatcctcaacattgcactgagcttatttcaagaccacacagttcaagacaacacttgttctcctgctggggtgcatgtgtgtcctctccagctggaccataatcctcctgaaagcagagccccgttctgatcgttcctttagtgtggaaggcacagtaggcactcagtgttttgatggagaaagctgagttttacagttaagaatatttttttctgcgagggctcagatcaggcctacagccctctctctcctgtggctgcagactgtaatgagggagaatggaaagagagcagggagggatggctcagccccaggtgcacacatggcccagcccagattctaggcccagcgggcatcaggacagctgtgccaggcagacacaggagagccttcctctgacccaggtgtgaactggatgataaaagatggtttctcaccctaaggaaatctctacataaaagaagttccctcatcaaaatcctcccagtggccgtaacaggctgttagtcacatgcaataatggcctggggtgagtaggtatcaggcagctgggctgaactgcctccttccatcaggagtgagctcttgcactcccacatggtcacagtatggccctccagaggaacactcccctcacccaagagccagtcctgcatcctcttgtcccagttgtgccctttccctggctgaccatagcattgtctgctcttggaggttccccgtaaggagacaagctaccttggatggcttcctgatcaggggcctgcttctccctggaaacccaccttgtctcatctcataatatactgaggaggatcttggaaaccactaaaatgatcattcttcccctctccatatcatttctatattcctgcttttggaaactccacatcattttgacctggctcaaccaattaggtagtccactccaaataagttaccaacccgtactcacaaaaccactttcagctgtcggaggagaggtggctatctggcgctgtttgcagatgtctttctcttctgttcttgttgaatccttccccagtttgctggggttcccagtgggggagtgcttccacagtgcccaccccaccccagcctctgcctctccccacccttcctgcttcctgttttctagagcttttttctttctttcccctgaaggtgatctctgtataagaatagccacaatatgtgtgtgggaggtttagcaacataacctggaagatctcttacagcctctggagtcttgatttccttgagtgtcttggactggataatggtgtgtattaaggtttggggtagggggacggtaaagaatacctctgcttcttcttggacctgtcagtgaagcacagtttggaagggagaaggctggggatgttcaaatagtaggcagaccccctgaacaacagtagcaggtgtggtccaaacttactggccggcctgcaggccaggaggccagtgccatcatcccctcgtgcctggtgacgatcagcccttagagctttgagtgccagtttagcagagagggtggactgatccctggtcttctccaaggacagcctaactcatcagtcagcatcccagccccagaccagccccaaggtccactgcatctgatgtgagtcttcagacctaaacgagaggtgaggccggagtgaaggcccacactctccttttagttctcttttttttctccattattggcatgattttgacagtctctaggtgaatgcctataaggacaaaggaaataaatttaaaatgtgaatgcaatagggaaaatgcaatttttacaggcgtctctgagagttggttttcactttaagacctggcagtggcagtaaaagtgcacaccttgtttgaaaggtgcagtgccagtgggagaggctgggagtggaccagacatctatgaaatccacactgttgtagaaacctgtaaacccggtgtggcggcccagtgcagagacttaggatacaaagagagaggaacttaagttatgttgtggaaatgtgacttcttaataccgttcagaaaataggtacagaggcaacagtcccaatcttctgctagaaatttcactcggctaaaagcagaacgtttaaatacactcttgccatgggctgctgagaggtccagctctcaagaagtgggagcagctctagggatggccacgctgggctcacttccgagaaagaggaagagttagttggggtgaggaaatcatggaggagaaagaccagtcatttcggggctcctcgtcctgaaagcagagactgccgtacagaactcagcccacggaggtcagccacagacacctcaggaagcacaaagaagagaacgatcttgtgattccaggagagtctctgaaaagaaggtagttcaagaagagtagaacaagcaggggcttgcagagaatgagaataccacatgggcctctgcggtgaatttaaggcaagaaggagaatgaggaagcaacagcccctgcctgtgagtggcctacaggctagaaacagaacagcagacgctgccacaaaggaattgacccaatgcatttacaaagcattccagtctttcttgtccagctttatcccaagtagtggaagaacctcctgatactttcttaaagcttctgacagtgatctctgtgaaattatggagcgtgtgtaggggccagagaagcgaaacattttgattttctacagctaggaggctgtaggagagtaagctcgatgttaattcctggaagactcttagggtatattctttaaacaatagtgtgtgtgctttcaaaagaaatcggtaattttaggaacatggcaaattaactgaactttcttttattgtaggtctactaggtttagatcaaaagaataccgaagatagtgttgattttattaaggcactgaggggcatctatcatgatttcttttgaaaaatatggagaaatatgttaataattgttaggccaacactggcccaaaaatgcagattaacagattgatgtcagtttggagggaggacttcagttcattgtcatggggctcaggcctagtcagcatgtctaccactggccttcatgaaattgcaaaatagaaacttaacgaatttgttgaagacacaaagttgggagagatgactaatgccatataaataatgcatagaaaacaatatttttaaaatccatgctggtttttaatttaacatgacaggagaccaaatatgcttgatatacttcctaagaacatataaataaagtaccataaatatgccaacaagtttgaaacttccaatcacattgtaaatcaaggggcgctaaagagcaagtggaattcctaccagtgggaatgggtgaattgagaggcatttttctggcctgcactccacgtgtctatccactgacagacccaaagagctggattgttgaataagatgtgattcaggcagaaaaatatgaagacatatgaaaatatgcaaggtctcagaaaataaagcatacatgtcctcctccagagacaatgaatcaattaatttttaatgttccaagtgattgagatgaatgaaaatccaggaccccagcatagtataaaatggaccaatggtgaattgaaaccaattaaatagagctgaggcatcctgagcaagagcacaagctctgggagctgcaaatgagcctcacccctgccacttactaattgtgggactgtgcgagagttatttaacctttctgaacttcactgaacaggtgtgatttctgtgaggattaaatagaaaatgtaggtaaagtgcccaaaattacaactcttatcaactttattagtattatttataaaaataactatgttaactatagttacaaaataaaaattagaatttagttttaaaaataatattttgagaaataacaatataagaaattgcctatataatacaagactaaattggtaatgacaaggaaatattgggtgctggagggaagcaggtgttacatgtattttaaaacttacttgtgttaatgaagggaaccatgagttaaagttttgttttgaactttgtaaattatagaagtttaatttgcaaatgcttttaatacgtataaaggttaaaaatccgggtttcaactttcaaaaactcaagataaaacaaaagtatactctatgacagcagtccccaacctttttggcagcagggaccatttattagtctgttctcacactgttataaagaactacctgagacttagtaatttatgaagaaaagaggtttaattgactcacagttccacaggctgtacaggaagcatggcctggaagcctcaggaaatttacaatcatggcagaaggcaaaggggaagcaggcatgttttatcacagcaaagcaggggagacagagagagagcgcatgcacaaaggggaaagtgctacacactttcaaacaactagatcttgtgagaactcacttactgtcatgagaacagtaaggggaagtccgccccatgattcagtaatgtcccaccaggcccctccaccgacatgtggggattccaatttgagatgagatttgggtgggtacacagagccaaaccatatcacaccagtctcatggaagataatttttccactgactgaagggatgggggcagggttttgggatgaagctgttccacctcagatcatcaggcattagattctcataaagagcatgcaacctagatctctcacatgcgcagttcacaatagtgctcgagctcttatgagaatctaatgctgagaggaggcagaactcagggagtcatgcttgctcacctgtagctcacctgctgcacagccggttcctaacaggtcatggaccggtaccggtccgccattgtggggactggggactcctgctctatgaaacaaaaaatgagaaagtaaacacacagatatccagaagcataaaacaaaatgacagaagtagggttgaacgtttaactatgctaaaatatgtaagtgggttaaacactcttattattaaaagtataagacttacagatgttggttaaaacagaaaatgtatccatattctgtacaggagacactaaaacaaagtgttgcaaaaaggctaaaagtttaattaattaattaggaaacagtatcagaatagatttacaatataaagcagctggtgctataaaatacaaaatttaattaatttacctctggaaatttagaaataaaaaagagcaaaaattaataaggaaacataatagcataagagaatgaatgctattcatagtggtatgctaagaaatttgaaaatcttaattgtaactttctagaaaaatataaatttcaactttagataatttttttcaaaatacagaagaacattaaagttaaaaatttatttaataaaattagcattatcttgacaaagatgtcaccaaaaaagtcttagaataatcttatatatgtacacagatgaaaaaagaaaaatgaaataaaattgaatccattggattcacagttaggtaagacacagccaatgaattcaaggactattcaatgctgggaaatttaatactataatatatcacattggtaagtcaactaaaaaatgcagcatgcaataaaactcaatatccattttaaatacaactcttaaaatactaggaatagaatgacagctaatatgataaagaatgtatctcaaactaacagcaaacatttagtgatgatgtcctggaagcatttcctttaaaatcaagaacaagaaaggaacgtgcactagaaccattgccagtcagcgttgtgaaaggtcgaggggctacaacaaagcaggacgtggaaaggaagagagaaaattatcaatatttgcaaatggtgtgattatagtcctagaaaatctaactgaaaatagttagcattaataaaagggccccagaaacgtgactggatatgacataaatagtttaataatcagtagtttttatgtaccaaaaatgaccatctggaaaataaaatggaaaagaattcctatttacaacaattacaaaacttttaaaatgtgcttagggaaaatattctaaacacatgggactgtatgacaaaattaaatttaactaaaagatatagaagaacagttagaataaatgaaagcatgtcgtatttctataggaaagattgaatatctgaagatgccaaatctttccaaattaattcatgagtttaagaagaaccctaatcaacagcccagggtgtattttctttgtttatattttggtttgggcattgtttgttgttttggtggggagtggaaaggagagtgcttagaaaaataattctagaatttatctggaaaaataaccagaccaaatttaccaagaaagatatgtcatgagcacagtgaggaaaggataagagacggcattcctacagatgaacagaatggtgcgggtaaaggaatccacggacagagctgtgtgaaacaaacaaccaggaaacagcctctagtaatgatatttgttggggcataaaataaaatttttaaaaataaatgtgtccaaaataaccttgtattcaacagcaccattttaaaagtagaaggccagagccataaaataatgcatcagtcaaaggcagaagaaaatttgcatcctcctatgtgtctccaaagtagcatatactgtgtactagaaaacaaaatctgttttcccttacaaaaccagtttaaaattcccctcaatttatgtatggtaaaaataactttaaggtgcttctctaaaaaatgaaactaatatgcagtgcatctgtggctcatgagaacctactatatggtaaaggaagcaaagaagttttaaggaaggtgggcgagggcagggactggattggtaagtatttggaaataaaataactttacatacctttttttttttttgagacaaagtctcgctctgttgcccaggctggagtgcagtggcgcaatcttggctcactgcatcccccacctcccgggttcaagcgattctcctacctcagccttccgagttgctgggattacaggcacatgccactgcaaccagctaattttttttttgtatttttagtagagtcagggtttcaccatgttggccaggctggtcttgaactcctgacctcaggtgatcctcccgccttggcctcccaaagtgctgggattacaggtgtgagccaccacgcccagcctacatacctatcttatacatttagacaaagcaaattacaggtggattcaaatagttaaatgaaagaaaataaaccataagacttgggggaaaaagactatttaactgcctccagaattatggaagactttataaacatgaaagtaatggaggaaggcacaaaagaaaagactgagattcaactcataaaaatagaaaacttttacccacagaaaaattacagaaaattttggaaggcaaacacacactgggaaaatgtttattaaagtggtagacacggggtcaatattgctgctgtataaggagatcttagaaatcaattaaagaaacacatccccattagaaaatttggcaaaggacgtgaacagatttattcacaaaatataaactacaaactggtaaatacattttgatttttaaaatcagcctcactagtaaaatagaaacataaattaaaagaagatgctatttttcacttaataaagtaacacagattaaaaaaatacattagcaataggtgtggtaaaatgggctctcatatactatgatagaaatagaaaaaagttataacctttctggaaacaatttagcaatgcatatcaaggtctttgaaatgttcataccctattaccactaattttccatctaggaatttgggctgaaaaataattagacaaagttttatatttacgtataatgatgttcatttcagctcatgtataacagcaagaaaagaggagagaacctaacatcaaaggggaatgtttaaatgtgttataactcatatgatgagctaataaaacttatgtttttgaagccaacaagttgaaatgctcatttcacattaatagcaggatataaaatatatggacagcatatgaatttgaataaagtttaaaaggaaaataaatatgcatagtatcacatttttgtacagtataaaaataaattcaatagtatcttaataaaaattctgggccaaaactaatgagataaatttagtattagaaatgctaagttatgggctcagcctcaaaaaataggaatgaaagaggactaacttaactattgcatttatgaaaaggatcggggggatttcactgccccaggcttggtgttgtgattgtagtcgaagctgacctgggttgccttggtggcagtctgcggtgtccaggtggggagggggcagtccctatgctctgtacagtcaggctcgtctgctctccaagtttaaagagaagcaaggtgtgtcctcctctcatgttggtcacattcagtgagggaccccaggggaaccatctggaaactgttacataaggaactgcagaaggatctagggatgttttacctggaaacaaggatatttaggggcaatggaatagctgatttcacatacataaagggctacatgaggctgaaaaatcagactaattctgagtagcttcaggaagcagaactagattttgggtaggagtgaaagggagaggcaggttttagagccatgtaaggtgtagtcaggtgttcatcttgcaaaatggtgagctcaccaggacacaaagcatccttgaggagtgaagatgagaggcttcatcgggcagaagttggaatagaaggcatcaaaagacccagccgtaggatttctgcagtcccatcattgactgactggaggcccaggtgggcagaaagaaggcgttgaaggggcatagactcctttggccattggttttcaacctttgctttacaacacaagcacctgaggagcttgttaaaacagtgctggaccccacctccatagtttctgattccgcaggtctcaggtgaggacctgagaatttgcatttctgacaagctctcaagtgatgttgctgctgctaccactggtgctccaggaatcacactttgagaaccatctccttaggtcaagagcaagaaataaggagatattcttaagcccgatggtacagagacctagaaaaaaaatatggcacacaggaagcaagcacatactaaatgacatatggcttttttttttttttttttttttaatctcggactcttggacaatagtgttgaaacttgtggaattaaatcacagactggaggccgttctttccagatccacatttctacctggatgatgggctctgtcaccaggccaaagaaattgatgttgagtattaaaagcctctaaggggagcggatgctgcaattttcttccttcccctcttagatgttcctagatggtggggaagttcattgtcacttagaaattcatgaaggaaatagaatattgctcatggacttcagaatggcccataattagctcttttgggttttgttttgttggttggttgtttatcatttgttgttttactggaccttggaaggagtcttcctcagtgaaacccctcgttataagaacagatagtatatgatgtagacaaccacagatgggacccccaagtttgatgatgtcctcagtgtcctgcagttattccaacaaagatgcacaattcccgtcgtcatctccattcaaagtaaggctcatttatttgagctttcagctgattggtttaggaagagaactgtgtacagcctcccccacatctccccaccccttgctgctctcttcctgagctcactatgtcagtgtgagcagactgtgcgcctaacacaccggagtctgttgccatgacgctggggagaaatctggttcctatagcaacatcaggttgactcgttgcaccttatgacacaggcagatctccagcaggggcttctttgatctccagttaatccaggagagatggacacatgtagtactggaaaatattacattttcccacaacccacctaatcctgcctgcctgcctttcatcctccacattaccaaaataataataataaataaatccgcattccctttttttttttggcaacctgaaaaaataaagcaatggatcactttaatgttctcagcagattaaaacatagtttgagggtcaatccctatcgcctccctttccaaggcccatccatccgttagcctgccccctggcatgttccttgaggcctgtccatctggcctggctggctggtgagaagtcctgtcagcctcaggggtccggggacatgccagtagtgcaatggcagctccctgggcaggcctaagaggccaggggctcgttagcaatggtagcagatggatgcgggggcagccccaggagaggccagcaagtccggtgccgagaagctccttgactcaccatccaaaggaatgcacggtgttggcttctgtatgtcacaaagtgggcagccagcctggggcactcggcacattcctggtctggtctgtggcgggagaagtgacaaggaactggatcgttactgacaggaaagcatctcgttgttctttaaagagactttcagcgaaggaggatccatgattttccccaacccttcatttgagtgcctttcagccttccttggggaaaacatccatatgttttctacttatattacttacttgtcacccctcattcattcagcaaatgctcactgagcttctccatgtggcaggctccgttctagaccctgagcactgaataacacgaacggggtttctcctctcctggcacctacattctcatgggggagacagataataagtaaagaaaatgtcaggaacatgaatatacaatggggagttttgggggaggctgcaaagtgagtggtcggcagaggtctcctgaggtgacactgaggcccgactgccctgaggagcctgccctgggacaagctagagagagggtgtcccaggcagcatgcagaggccagcatggagcgctctgaactgggcagagcaatggggcaggagtttggcgtggattcaggggccgcagctgtagggcttgtgagccaggggagagattggattttaagtgatagatatgggaaccattgaaagtatttcagaagggaaacaacagaattatattcgtatttatgagtttgctccagctgccttaacaaaccctcttcaagcccattttccttttgcctttccattagtggcgattaaaaaaagatatttgccacccttcttaggcttgaaggtgatctgcaagtcaaacctcatgcttttctccagtatcagtaagctcagtcccatttttcctctcttgtgcatgacgaactttgttatgccagccttcaagggatattccgaattcctttttcttagaattctagagccagcgggggccttacagatcactgggtccagtccttattttacagatgaggaaacttggttgccacagtggtcaagggacctggcccacatcacaactccgctagccagggctgggcctctggtgctagaacccagcaccctcttccgccccacaactagtagacagtagactagtagtcttcccacgtgcacgtttacttaccagtgctcattatttcttctcttccttttctgattcatctctctgccttcctctggtcctgtcattcttccctggtatgctggaattttttagtaatggactgttgattgcagtatgtgggaaatttggccataagttttggttctatgtggttttttattgtggtggcaattgtttttgccattttctgctttggtgttatttgtggctcccattggggcctccctaagccctgcttattttcccatgactggggactgggtgttattgttcgtaactcaatattccagccatggcattcaaggccaccaaccctctgcctgtctcaatagcatatcacagcccacgccacattggccttccgtgggccaggcctcagggtgggaactcagccagggtggttttcctactctgaggcattggtagagcggtcagggctccctgctggcttacacccacatagcagctcctaactccacagtttgtcttcccctcttctgtccactccagctcagggccccttagccattcactcagcagacaaagaatactaatagtaggtgataaccactgctgcagggatgacacattagcattaggtgacaaataaaccatctccagtcaacattatccctgctgcatccaaccagcacagccgggaaagcaaacaatgaggcagaagcgcgtttcctcactctgaaaggcatgcatgcactggaagttgggttcattggagagcagggtggcttcacatcgggatctgtggcaggacagcctcagagcttggcagtgttgtctgggaactgggcaatatcaataataaggtgcttccagtgacagtctacgtcttcatctttacaaaagctttcagagataagattattgctccagttttcagatggggaacaaaatgagacaggattagtgattctttcaaggtcagcaggctggggaaagtcagggttggaacatgaacccagtgcagggcgcacttctcacacactgcccttctctctgggcagcagatgtgcatgtgctgagcggctgccaaggagacaggatggttgagactctgcagaagaagggctggcatcttccctgtgctgcctcagtgggacaggttgggctgagatctgcaaggtacaagcagggcttgcttggggttctgatgagaatgatgcccagtgaatgatgcccggtgtcgtggctcagcagaacaggcctggcatgaggctcaggagatgcgtttcctgggtctggcccaccttcggctcctgtggcactgggagtactcttaagtcttagctctctgaacaccaagtgaaggagttagcctggaggtccccaacgttacactcactgataccattctatgatttacaaagctcttccttgatgatcagatgtttcttttccgaggtatttcaacttcccatttatagttagtattgaagtgccacctgtgggttttccaggccgctgtctcttttctttatacatcataccctaaggatgcttattattgctgctgttgttaaatcaagtccttgtcttagtatatgtatcttaacatattgagttagagacagtgcctaacttgacaattctgacagtgttgatataatccatggagagtctttagcccactggttctgcccagagctcactggtaactcaggctctctgcatggcaaagtggaagacgttgaccacaccacttgattgggagctgtcttccttccctgggatgaaaccagtcaggaccttctcacatgggaggagtatcaaagactaaaccaacctagaaacagtccaagaagaaccaaacaacgaagcaagcaaatcaaaacaggggaagaggacaagcagggccccaggcagtttggctggtgcccagcacagggcctggcactaacaagtgtttgagaaacattgagtgaaatgacatggttgctcagtagaaggagcagccatgctcaaggccagagtcgccccttcagtctcagccattgcttggggaagtggtctgtttttgccattagagaacacactgccatggaggacactctagatcagaagtccaggtcggagtcatggctttgtgacctcctgtgtggctttgggcaagccactaaactctgagcctctgtatgtgaggacaagcgcccattcttcttcttattgcagagtcctcataaactacaactggatgatgccccctgagtacctgtgcttgaggaggggggcaaatagcaccgagatggtgtcttacccacctttgtatccccagcatgtggcacagagccctcactcattaggttctcagcaaagatgagtgggtgttcggatggatgcacagcttaggcggacaggtggacgaataaatgtgcaaggaaggttctgggagctgctggcggcaaactttgcttgcttcccaaggattgtcctacctttctgtaataggctagggggctgtgagctgcagtatatttctgctcacaggagccctttcccttggggagctatgtggagggcaagaccaccccaagaaccccaacatgaaaccttaactgggattctgctgctctaggctaagcaatcctacattcttgactagaagagtgtgtcttaggcatacattgctgcacagaaaaccccccacctcctccctgcttcacagagatggggtgaaagatggtggtgccctaagaatgcagaacccctgcgccacacaaagcatgctcgctacgcccactagctggccaggaatggtaggaatcgcagggaccatgatcaggccttttctgctggggccacctgctgctgctgttgtcacgttctgtgctctgccgccatcctctgcgggggtggagccagcatcttggcagccccagggtaataattaggggaggggcagctccccagctggcgtggtatttgaggaggggcctggaggagaaggaagggctgggacacggccaacaaaaggagaaattaaatgggctgtcctgggagcccatagttagcatttaaacaccagcatgagctgtgggtttcactgagcagggctgtgtgtggcctcaatgccctcctctcccggcccccgttctgtttgtgagcacaagctgggaggactctcagcagagccctaagaggtgatgttgtcatgccgaagcccaggattcaggggctttcatgcagtgcaaggacaaacatggcgaacaccacatgcacccagctgcaacagcgctgcacccctgacctactcacagccctcaaggaactcaccgaccagcctagccttacagcggctatcacaggtgtgctgggcccctgacgtcgagggatttagggttttgttttatttgctgtcagcatggttcgcgttgcaatttcgattgtgggaagacagccaggaaatactaaagaaacaccccatacctccttcaccacagccacaggtactgagcattgagcacacgttatatgttctttatctcctccagtctgcactgctcacttaaaaggtggggcgtattatccccgtttcacagctgagtaaagtgaggttcacaagaatgttgtggctggcccaagttcacacagctaatgaggaggggaaaggatgccaagtgagtccgcctggctcctggagctccttctgcttctccatgatttctgaagaacacacgaggcctccctgtgtcctgtgggagaattcactgtctctactacgtgggaaaatgtgaaagaaggtaggcctgagtgctcccgtaagctttggggaatgagagctgagtgaattggccttactaagtgatctggcagtaatctggtggtcttgagcctagaagagggttggggtgagtgtgaagagtatgatcccccgcagagccgagtcatgacttctcttctgccaggagctcactggactcccatacccttctttggactttagtttcttccagtaataatgattataaagtctagaaataatacgattaacaaccacaactgagtaaatacttgggaattagtgaagtgctaggtcttgtgagcagattctagaggtagaaacagccccagaaacacaagctagaaaaagaggaacagcttccaggagagttccaggcatcctaagggaagcacgggcctctgcatgtggatgggttcgaatgccagattccagcacccctctatggcctctgcaatctgcagtcttttaaaactgtttttacattagaacatcacagggttggactgtgccgccacaaaagcgcctgtcttcattacccatgattcctcaaatcatcaaacgtaagcacatagatgccaaccagtgtctacggggtgtaccaagcacaggcccatgggagccatctaccctgtgcgggcaagaggggagcagttgtctatgggaaatttaaaaacaatcataaaattcacagaaagatggtctactttgtattgtcatcatggcctggccattctaaataaggtcggggataaaatactccccgtgggggaagagtgttccctcaccacttcacaggctactaaatcttcattgctctcggccattgcttggttgtccttgttctttttgtttgtttatttgggtccttccttccttccttccttccttccttccttccttcctctctctctttccttctttttttctttccttttcttttctttcctttctttgccaataggccaccgtagtcagtttcatgtgtcttcctggtcaatcccatgtttactgcacaaatttaggtttcttttttgtggtcgcatttaggaaactacctagagaatagtgagaaaccacaggagggaaggagaacagcgagaaaaatactgttttctttttgttgtttactcataaatgtcacagaaatatttcagttcctttttggttttgataagtgcttttttaaaccaagtcctaaatcaagggcctctcttggcaatgtccctttgacagaaccgagggagggtggcagggcagggaggcacaagctgcagaggcacttgtactgtacaattttctgggtcctgactgataaattattgtgcatcttgtgcgtgctctgacatgcagtacaatttgtccatgtaacggtgatgataggctgtcccgggctaataatcatgaaccctttatttagctccttcagccttttagagaaatcttaagtaaccgttcatatccctttatcggttttctcttccacattttagcataagtggaaaaagcttttaaccctgagaattttactcaccctggggctggggacaaggaagaaggcacgttgttaaaagtgtacaggaattggaggatcttgacgctcccgatagaacagctttttcttggtctgcctcctaggagtgtgaggctgtctgggtggtagagattgtccagtccatctctcattttactggtgaggaagggatgcaagccctgagacgtaagtaactggcccatggtcacatggcacagtcatctggaagtgacattgagcttccttcacccattacagagagcctgccatgatgcgggacataataatataaataaagacatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagacataatattaccagctctcctttggcacaggtcccctggttcccatccccacccacgtgatggtcaagtcagcttaagcacgtgttcaacactctgcccaagtggctgggtgtcccttgtatccttttctgtgtccaagttattgatggtagattgtgttctctggaagacagatgtcgtcctggtgtgaattgtttcctgtagcatctgtgtagtctaaccctaacttgcatggtgcttgcatggctatttttggacttggctttgcaagctttaacacgtgacgctgcctgtttctttacaggcacaatcttgcaattgaggtgactaaaaagcagtacctggacaatggtattaggattcaaatatagcttctaaaagattggaacgatagcaagagggcatgcaggcattccatctgtgtgtttaggtggtagcaaggagcattcagttgctctctgtctgcagctgatgtttttcacccctctgggagcccggtactgacctcttctgataaactgggctcttaataggttggttagattcccagtgttcccccatccctctttcatcacatacacaaggggtttgtccaagtgagtatcacaaaggttgttcttggcttaaggctggcacgaaagggctctgccagtgagcaatgttagaattaaagacacaataatactaattaacttccccatgcctgtgatctctgcatttattatttgtgtagagataaagccttaaataacatgactggcctctttgggggccctgcttgggagtgggtggggggcaatgtcctcattacagcacgtaagatggatggtgtcctaaggcagaggcacatcaccaaggatcacctacggaaggtgcaacctccttcccagctggcccgtgtgctttttcccagcagcacgtgggatggggagggggactgaggtgtgtgaaagaagagaagcaatttccagggatgtggccctttgcaaggtctccacgtccatggccatctgccttccaggacctgctgtgaactgtgcagcagacacactcaagctggctgcctgtggttgtgggaagtccctcactcctctgtcctcagttttgtcatctctgaatggaggaagggaggttagatcaggcttccaagagtccttgaagttcctgaaattatatataaaatgtgaatgtgtgtcaggcatttgtcaggagctaaaaggccattgcctgtgattctcagaggtccctgaaccaaaggctaagggccaccaagtgagatgctccccaaggatccatcttcctcttcccgattatgattttagaacttccaaacctaacgtgtgttgtcagctcagacaaactcagcattcaggttgtagagacagatgatggatactcggtcagaaatgccctataaattagctgctttaaaagtattgaccaagtagccttccaggaaagttccccagatatggtggttctggtgttcccacctcatctgcaacagccctgggaagcctggctccttgcctccaggttttcctcgatgtaaggccctccaccccaggacactgtagcaatcctggggctaaccctgaagaccatttccactattgggcagccttggtggtttccttgtcgtagagaactaacccagtttccccagactggctaccttctcatcatctcaccatctctagctttcactcagatagaatgatctcagagcaatcggcagcatttctcatttggaattttactaacaaattaataataatgactttgactatggggatgcttaagaaaatctcccagtccttggaggtatcctgggagaagatagaaacaactctgagaatcagaacatctgggaggattctgcagatggatcccagggacagcccaacaatcagagggccctccttcaaagcaagtgctgcctccagcctggggcagacccatccctctctgtgtcatttgttttcccaaacattcccttcttaaactggggttcatgaagtctatagatggaattccagagggtttatgaacttggagaataactggatctttattatcacaggcttctagccgaaatttctcacggtattccttcgcaagtatagacaacacaccacaatagcattagcagtttctgttactttgtccaccattagaaaccatggatattttcttatcacgttaagatggttgcaaatatctcaaaaatattgtttgctttcaatactacttcaaaattctggtaatccactagattttgttatttaacatattatcaaagaagcatgcatatttgtgtattacaaaattgtctttaaatatttttgatatctatatttcaacataactggctttatttgcaatcctttatttccatttaagaacattattctgagaaggacctacagccatcatgagaaccaccaaaggcagccacagcacaagaagcttacagacttctctaaattggcaattcacatttcaatcctgtgctgcttgtgtctgaatcatatcatagggggagctctgagcttatgtgaacatcgaggctgtgagagacagaaaggagagatgtaggagccaaccttgtgtgtgctgagattcgaaaccagtcatatatcccataagcaaatgttcctgaactggcaaatcccagaatgtattttgccctgggcaccctttacctcctcattaaataagaaaataacccatgagtatttgaaaggaacttgcatcgatgtggaactgactgacttagaatagagctcatccgagatcttgagatgggcttattgacacaaccgcctttcagctgttcttgagagtcccacaggatggggaaagccttggtattagtcactgggatcagagctgggaagctgcttagctctgggctcagcaggctggaccaaggccacttgtaggtaagagaggcagtgttccctaatgcactctagatcagctggaactagtttgtaatcctggattcaagtcccagcactatcattaatgaactgtgtgatccaggcaagtggtttatcagccttctcttccataaaatggggtgctgtgctgtgtaggtgtgcctggcttgtaagcactaaacgagtgtagctattactatgatcatatgcaagcagcacctgtagcatttggaaggctcaggaaaagaagggtgggtgggagcaaaggcaaacaagagcagtggagactaaagcgggttgtctcgtggcgatgcttaacctaggggcctggaatttccccctttgcctggtcttactgtcattggaataatcgtaaccactcctgggtggtaagagatcagcaacatagctgtagttcgttgggtggcaggaatgtgccctttgtccttggtttctaagtaatgatgtcttcatgtccggttgagcgaggggtcagcttcaaccctacgataaaccagtggagttataaatggaaagcctgaattcccagacagaggaggcgatccaatgagacagcagagtaagtagggaattttcactgcctcgtctgcaatgataatgtgaatagcaataataatcatcctaagaaaggattttgtctcagagccaaggcaaggaaaagagccttttcccatgccttgctggggagagctgaacactcaaaccacgtcaaaatagaaggaaccaaaaatacagtgaagtaccctttgccccagtgagaagccagtgcaagacaacgccctgcagaatgggccagagggcagaagaagaggccagggcccagtcctgaatttgtctgttggttctcacttcctcctttaatcatttcagaagagctgttaatgagcaggaaatctaattgattagcatttcatcctggcttccctttctgccaaaggtgctaatgagcagggaaatcacagatcctccgggtgcaaggtacttgagaggttgtgaatgcatttgccacccctacatggagaacctcatctgaacctcagcaaactgataaggaccactctgatttttaaaaccctccagacaagctgccttccttctgtggatcacacaccacccaggttagcagcagtgccaccagaaacactgttgcactcaagttttctcgcaggtgactcatctgcatgctccttggcggagaatcgcgggttactgtactgtctttgtgtaagagttcttcatattctcgaagatgtttgttacatcttgtttctactgtctttcctccaggttacacattgtgcgtctttcaccctttctgtgcaagttgttctttctgaccctaatcaccttatgttgttggatcttactccaagttcatctactttggtcgtggattcggaactgagcctagagtccatgaaggactctagcaagaatgagcacaattagaggtctcctggcaccctgttgttgtctcctttttttctttctaacaaaagcccatggtcagtctctccagttcatgactctttttcaaccccagcctccctttctccgtttgtgtacatgccctatttttcttttcctggtagacaaccctgcacttttccttctctgagcagcaacagtgaaagggaagggaggtggagggagagtaagccacatgggcaacctgcaacctgggtctccagcctcttgcagtcttggtcctcaccgtggcatagtatagtaccagtagaggcactgcagggacagatgaactccatagcaaggcattgcaagaggcctttggagaaattcctttgcaatttgagcaaagcccactccttggcttagcaaatctttttactttttggtctgctagaatttactgcatgcgtagttatccagaaggtacgtctctgtcccattcggctttattagacgccatctggaaaggggctgggagtggtcagcctcagggaggggagccaactgaccgtgaaaggagggagatgagagcgaagtaagcatagtgctcgctccccaaggattgaaactgcctgccccgagctgaagacttacaaagacgtagtccagattcccagagaaaatgaggctttatacccataacaagttgtaatttgagtcaccggggaagttaagaaagtgaaaacatgagcaaatgccagtgtgatggaatcagagtctccatgctggaagagacttcagagggatctgcttgagctccctggctttatagacaggaagaccggccccctcagatgcacacagccaggtactgcacggccgggccagaggcttttctgatgcctgcctccctctcccggcaacggaacctcatcacctagttctgataggaaaaaaaaaaaatgaggtgatcagaaaacaacttcctcaactttctcagtctccaccagcaactaaaattgttcctgtatccccctcaccttatccacttagcacccctacacccaagggcagctaggacccgctgctgtctctccatgacctccctccctctgtagccttaggtaggcccctggcagcttttgcctggaaatttgcaacagtctcttgacgggtccccctgcctccctccattcttagttcacctgtcactctgtggctgcctcacccatctaagaagcaaacctggtaaaattgcttctgtttaaaagtcttgaaatcctgcaatggcctcagtggcccctaggataactataaactccttaacatgggctacaaataggtggttttcacccctgggtgtatattagaatcacctgggatctttttaaaattacccgtgcctgggtctcacccgtagtgactccatagagtgggcctgggtggggccagtggtgtcctacagctggaaccagccccagcgactcaggagaggccatcgcttccaggaatcttatgagtgggttgttaaatgaccattattaaaaattatacaaacttgtaagtaagtacattatgttaaaaacaaaggtaatacatactcaaaagtcaggtttgcctgatgcctttactacctttcgaggtaatttctattgattgtatctgctgggtggaaatactatataatggtgtgctactacacatctcctcccaactctgcagtcagtgacatcccattggtagcttgaaattgaccatggcatgagtatttacatcatagaaattggcaaatgctacaaatcagcccctgccccccaacaagtcattaaacactgatatcactggctgcggctcaggtatttacatgatttttttaaagctcctccggttgattctgatgagcagcagagttgagaagcaccagccaggatctgactctttctgcctcttgagcaagcctcatctcttagaaaaactctcctcttccccccaactttcttcagtcctgccacacacaaccaactgcagtggcccaaacacgagtgccatgttatttctcattctgtgtttttactcctagacacactgattcttctgcctggaatgcctgtcacttccttgtctgcctggcaagcacctgttcatcttccaaaactcagctcagtactttgtcctgtgtgagctcttcctatacctcctccccacacaggttcaccactctgcctctgtgacctgtatgtcttctcattaaagggcttttagaattttatggtgctttctgattatgtgtctctatctccacccccattagacactaagcacccgagggcaagggcgtgccctgtttctctgcatcccagcagggagtgcagcaccagcatagtagatgctcagtccgtgtttactggatggataaatgagctaaaccaggtttcctgactcctggggcagccttcttgccaccccagtcctccacctgacccagcctttctaaaggcaggaagagtaaattactgccattcctgtgatggaccacattctgagcttgctgctgctagacgtggtgtgaagatggttctcacagctcttttaacaataagactttttaaactgactttagttattccaggtttagaattctgtccattcattattcattcaataacatgccaacattattccaggcctagagatgcagtggtgtgcaaggcaggggagggcactttcttcagagcactttcagttaggaggtgactcagatgattaaagaagcaatgactggccgggtgcagtggctcatgcctgtaatctcagcactttaggaggccaaggtgggtgcatcatttgaggtcaggagttcgagaccagcctggccaacttgctgaaatctcggctctactgaaaatacaaaaattagtcaggcgtggtggcaggcgcctgtaatcccagccatccaggaggctgacacaggagaatcgcttgaaaccgggaggcaggggttgcagtgagccgagattgcaccacggcactccagcctgggcgacagatcaagactccatctcaaaaagaaagaaagaaagaaagaaagcaatgactaataagtgaactaagagcgaaagaaagaaagaaagaaagaaagcaatgactaataatgaactaagagctatagcatagaaaatgctaggttccatccagggttagctcctagtctgtggggtttcatgaaggctccccagagtaggtggagccaagggctgacacctgaggcaaagaggaaggtggaaagctgttccctgcaactggaagatcctgtgaaagggctccagggccagagagagctcagcagctgcaaggaacagaaagaagttgccacaaagcctgtgaggagtgacagcagaggggcgagggcaggaggggctttggaagccattttcaggagtctggattctatcctaggagcagtgaaaccccactgaggcataaaaccagggagcccccttaccagatctgtactaagagaacttgcccagatcagtggcccaggagagatgaaactagagagcaggagaccaagccttgagtagggaagaggctgctgcaatggatagaagggaggggtttcagaagcagaatcatgtctcacttatatgtggaatctaaagaaatgaaactcatagaagcagagagtagaaaggtagttgccaggggctggggggctggggaaaatggatttgggtcaaagtatacagagtttctgttgtaaaatgagtaagttctagaaaacaaatgtgcagcatggtaactataattaataaaaatatacacttgaaatttgctcaggaagtaggtcttatgtgttcccaccacatacacacacaatttgctatgtgtggtgggcacatgtaagactatggtgactatgaggtgatggattagttgatcaccttggttgtggtaagcacttcatagtgtataccaatgtcaatcttacatctcaataatatgcagttgttatttgtcaattataccttaataaagctggggaaaaataagagcagaatcatggaacatcatgactggatttgatgatggaggtgagggaagtatgaagaatctgagagaggtagggagagctgatcagttcatggttcatgttgggtttgtggagtttgcagtgcctatgacgtatccaagtgtagttgatcagttcatggtccatgttgggtttgtggagttggcagtgtctgtgacatgtctaagtgcagttgatcagttcgtggttcatctttgggtttgtggagttgacagtgcctatgacatatccaagtgcagttgaccagttcatggttcatctttgggcttgtggagttggcagtgtctgtggcacatccaagtgcagttgatcagttcatggtccatgttgggtttgtggagttggcagtgtctatgacatatccgagtgcagttgtctaggagtcacttagaaattcagttctggaaatttgaggagagatgtgggagagaaatgtagattggggtcatcagtgtatgataactgaaactataggagcaagggtcattcattgtctaggaagaatgactagggtaggaggagaataggacatcacatttaatcaatgaccagcgtagacagagctagtagcagcaatgagatgagtgactagagaggtagagagaaaaccaggaaagtgtggagtcatggaagctaaggaagatggtgttgggaatagaggtggtgaacagagtcccctgttcttgctgataggagaggtcaaatgagataaggacagaggcgtggcctttggattccgagatgtgttgatcaccggtgcacttggcaagcatgccagaggagtgctgaggcagaggtcagagcacactgtgccaagcagtgggaggcaagtgatggagacaagcgtctgaactctaggacactgtgctgggaaggagaggggtgaaagaggacagttttgggatcaagggatatcttctatttttgttgtcatttgttttgaagtaggagaggcaagctggctaaactttaagtaaaagggaagattgtgatcctgtcctctgtgagtgaaagagagcatccttttaatgtgatcagtgccagatgtcatcttacaagccctgtgtctaacctgataggcatttagagtggccaaggcttcctggactggcctcatttcattgatgactgcttttgcagagactccattgcctcctaattgtctacacttggggcctccatttttctcttccttggcagaattttagaagaagcctcctgtcaccagcctttcggagtccccactgatactggtgtgtgtgctcctgctgtggtgctgcccacccaccctcgttcttccaaccctccggcaccgaatccctcctttcactccctctgtcccctgggcaagttccagctggttacagtgaattcccgtatttccctcctctcttacttctcatttgtcagagtgcacaggaggctgcctggaatgccctctactcccaggctgaggaaattaaagtagctaaatttttattatagcatctctcaagaatatttctagaaatcatagagtcgttgcaccttactactgaatagaagttgaggggttatttgacccattccctttaattctaggcagcttgatttccaaactctttgtaggtacgtcttctttaagatttctatataaaaggtcccccaagcccagcccttatgactagggcgaccatgtaattttgcattcaaacagagatgccaaagggggccctgaccaaacaggacttgggaacccaggtatgatctttgggaacaccagaacaacaaccagtgtaaatgaggactgtcctgggctagccaggacatgcagtcatcctgcctgtgatgagtaatgggggacagaacccgagagactcttttttggctagtgcttaacattacgggacagtcactgagcatttactatggattaggcattgttccagacactagaaccgacaacaagatataatccttgccttaaaaaactgttggggaagaaagacacaaataaaatttgccataattctgtgtgataagttttgatttcagttttggtaagtaatagctttatggacgaagtgctttgggaaaaaagcagaagagggatgagtttggaggggttcgagaatcagaggaggtgacaggagagctgggctttgaagatgatcaggatttcttggggaatagggctgcaggagagggaatgtgtgccaagagtgtggaacgaaggcacggtgggtaaaagagagagcaagagctaaagctgagaactggacagggccctgacaggacccattcaccttctggaggcatcattcattctgtgcatttgtgatctctttttgcgtgagtgcaaggtctgaagtggcctgtggcatgctggagcttagtagacacatctggtgaaggtgtggagaaggccagagtaggaaaccactagaagtggagaggtcacctcagagactctccacacagcagtggtggtgtgttgcttctgaaccaaggcagggtcagagaggacagaggaagaggcaaccctaagagagcatttggcagctgagacgataggacgcagtgactgacgtggaaggtgaggaacgcaaaaatgccaagatcacacaagcctgcttcagaagaccaagaagatggggtttcccttcattgagacagggagcaggagagcagctaagtctgacgtcaccaaaggccatttggggcatgtttgggtgtttgtggtgcatccacacggacacgtccattaggagtttgtatctatgggtctggggctcgagggacagattcatgtcagaaatactgactcctcggtgcactgatagaagatgtgattgtagatgagatgactcagagagcaagtgtggagcgagaggacttgggaacccagggttgatttttgggcaacgtctaaccccaaagaaagggcaaccacgaaaggctgttcagaagcagcagtcagcagggtgggagggaaccaagaacaggactgtcagggaagcccggaaggaagcagggtcaagctgggaatgctggatgagcagttttcttgaagttacgggcaggagccatgacagtgggcgggaggcagagaggaggaaacaaggtgtagcctactccttctgagtgcttgaagtggggcaaagacaaggtgtgaagatggagggtgagctggggtttaattgaaagtatttcttttcaggttaatggagttttaaggaagtccctttttacagtgacttctgaaagaacacccactctgtttgccctctagacctgggctatcgaatccactagccactaaccaagtgtggctatttaaatttaaattaattaaaataaataaaatgtaaagttcagttcctcagtggcactggctgtgtatcaggtgctcagctgccacgtggctggtggccaccatgctgcacagcaccggcacagagcgttcccgtgtttgccaggagttccgctggacagccttgttttaaactctgcgtttcaccatcttcctaattctgccttttggaacttagtagagtatataagcccaatctgcttatctagtttccaaacctagttctgaggtgaagaaaaccagatggtatttttatcatataagctgaagaattcttacaattttcaagtcagcattttttccaggcattgaccgataataaattgctccatgttgttaaacataagagagagaaatgtaaacgtgagaattatttctactgagccatctatttagtctttccactgctaccatcataaccacttccatctgatcattagcttttgtgcatctacagtaacttcatttttctatttttttgaaagttatgagctcgttagggaaatttagcaccatagccccttccttccaggaagctgcagaggccctgctatagctttcacctgtctgggcacctaagcagaccttgtcagctgctgggaagaaaaagcatctgatttgccagcccctcgcatgcatccatcagccgggggtgggtttctgagaaaccgttgtgtctgggcccaagctcaaagcacacttttcattcctccctgagctattttccttattattctttagaggggatttgtcatggggtgatttggtgtctccaagatacctgggtttaaaaaggtcctttgcattattctgcatacagcgggacctgaacttgggctggaggaatgttgctgatgcccaggtgggaggcagaggattgtacctgagaacttttcctgtggcctttacctgggggaggagagcatgttggcagaatgttctcagggctggccccatcgcacatggatgtgttcatggatgagttcagcagaagtatggcagctagggagcttttctttatgtccatctgggctttgctatttggctgaaattcctggaccaatccttgtgtccgtaagaaccctgtgtccttaccttgtgtagactgttgactactgttaaccctctagtattagcacagcaaagtactgtcgtgcacttcaagcccctgtacaaacacatgcccctcagccagacctcaccctgggagctgctccggagtcaacagcccttgaaagtgcactgtcctgcctcgtagctggaagctaaggctgcagcttcatctcccatggaaacctgggctcactaggaggggcaaggcctccagaccactgtcttaccatagaagccgcctagcaaactgcaaaccaagcagaaaatgcaggctgggctgaggaggcctctaactgatcaccagccaagcagagaaggggtgagtggcatgtgaatgactgctagctctaggcctggaccatggattcaaaccctgctggctggccctccaccatctcctgctccagtgaagactgtggcatccattagtgaggctagagtacacgcttctgactgtggaatccttctcattttctggctctgccatccactagctgtgtaactttgggcaagtgtggcctgacagccgaaagcttacccccactccttgctagctatatagctgagggcaagccatagaacttctccgagcctctgtttctagtctgcaaaagaggataaaaatacttactgtgcaggttgttgcagagatgaaatgatgtttatcaaatgcctaacacaaaggttctgtagatgctgcttctctattctctctggtttaaatccttggcaggtactcgttttcttactaagaaggttataagatcaaaatttcttattttagggaagtaaaactcaggaaagggtttacatctctgaattaggctgaaaagggacactggggattggtcgtggaggctcactcctgtaattccagcactttgggaggctaaggtgggaggatcatgggaggctaggagttcaagaccagcccgggcaacatagccagatcccatctctacatgtctacaaaaattaatataaaaattacctgtgtcatgggcctgtagtcccagctacaggctaaagcaggaggatctcttgagcctaggaggtcgaggctgcagtgagctatgattgtgccactgcactgcagcctgggcaacagagcaagaccctgtctctaaacaaaaaaaaaaaaaaaaggaaaaggagggacactggagaagaagctccacaattttccaaggtgccagggtgaaccagcacgggccaggcggaggcctgtcgtctgcactcccacatggccctcctcctactcctgatgtggcttctctctggtatggacgcaggagctggtccctggcccacaggagaaacttggacacagccatgataaacgcaggctttataatccaagagcttgaaaagataagagtgactaataaataaaaatttctccatttcttcatgcttgattttcaagggaagatgtagaataaatttgagccaccttcccctgcaagtatacctttaaatattaaatattttacttaattataaaatcccctgctgtctggagagaatggccaccttctctccttagtggaaacgatgtcatcgcatttactgagtttgtgaatgtaaagtgttttcagactgtaaaaccctggatggggttctggaaggcctcctctctgggcccatccaaaggggtcttcagaagtgcattggtgacaagaatggcatcaagtaggaagggccccaggtgtagagggatgggcagtggacacctctgtcaggaagagtcttccttatccagggctatcaggatcaggagctagagcccacgtttggagaaaacacaagaagtagtaccaacccagtgagtctcgggtaagaaattggagtggtttggtttcccatctctaacttggccagatgtaccataagctgtatctgcaaagccagtgtaaggctagacttaagttcaattaggatccaaattcttcactgtcaacttgtctaagtttttgtttatttcacttagtttcctagtgaaattttcatttgaaaattcccagccttatttatttatttatttacttattttaatagagacaggatctcactctgttgcccaggctggagtgtagtagcacagtcatagctcactgcagcctcgacctcccaggctcaaatgatttcctgcctcagcctccagagtagctgggactacaggcaggaagcactgtgcctgcactccagccttcttttcttttctctagctttttttttttttttttttaaatatttgagacagagtcttgctttgttgcccaggctgaagtgcaatgacatgatctcagctcattgcaacctccgccttcttggttgaagagattcccctgcctcagcctcccaagtagctggaaacacaggtgtgcaccaccatgctcagctaattcttgtatttttagtaaagatggggttttgccatgttgaccaggctggtctcgaactcctggcctcatgtgatccatccaccttggcctctcaaagtgaccagccttattttaactgaataaagggaaaggggctttttttttcatgaccctgaagacagagggactcagtgcgcccccagtggccagaggctgtagttacagggaaagcaagtcgggtccctctgagcctctggaagagccaagtggctggctgctggaaccatccaggagaaaccagattttccaggctagagctgtttcctttttccagtctgaggcttcccatgtattcctttcaacgcagcacctctatgtgcatccctgaaccctatgatctgagaaaaggtagccgaacccccgactttctcttttgcattgacattagcacagatctgagccacatgagtagttgctcataccattatctgcctttggttgagaaattagaaggtgctaggcacaaacacacgtcatcttatttaatctttacaagccaggatccggtactagggtccccagtgttcagagggattaatttgtcaagatctcacagtgagtagattccagtctacctcactggagcctggtgcccgtccccatggtctgcactcctggtgttgaacctcagcaggggctgtccctggcctgctgaaacagttcagctgaccaggaagtgtgtgtgcgtggtgtcttttgtacagtctcagcccctgggtctgacactctgatggtcttttagggtgctgggttatttcctggggttctatctgtgccaagttgtgtatctttcagtgacacacatctgttcaagccttctgagttggggagcaacagaaagaggtgaagagagaaagcactctgggaaacatggaaatatttttgcagcctgattgtctctgcatgcaacactagcaaagctgtttctgctccctttcggtgtccgagtcaaggggacgaagaggcctgcccaagaagaagagggatgatttttctctttctgtggttgggggcagaaaggcgatccggctgcccaagtggttcaggtcaggcttaactcggtctgtggcctctggcctggggaatgtgctgagctttgattcagctaagcagtggcttgttgcccaggcctgtggtcctccaaaacaccagctgaggatcccaaaacttagggcccttgtgaacagggtgagttgttgtcaccaggacttgccttgtcaccacctattacattttctggggacccagcagcccctggcctatggccacacagcaggcgcctcttggccaagagctctggcatgaagctaggcctctccaactatttaatgtttcattagcggttttctaaaggcatggggccaagcctggccgagccacaccattcagaagtacgtgaacacttcataaaaccaaactgttgaaggatcccaaacccaggaatctggtcacttggagtccaggctggaggcccagggcaggctgctgcactgtctcagctctttcttggtctggatacttctgggccacacatctgtctctcaaactgtttagcctgttagtagttctaaactaacttctaaatagtttatatttggggttcaccaacctgttttcatatctgatgaaagctttggacttgccccagaaagagacatccatgcacatatgtacaacattgtgcttagaattgcaaggtattcacaagccacactctaaagatcatcagtggatccaagtggagaacccctgtgctaaaccacacttgcttccacacttaaactctggggactgtggagtgttatccatcaagaagagtaaacaggtattgggttttgttttgtttggctttttgcttgtgtcttggattttgaatcgaagtccttgagtggtagaatgggggctagatcattagaatcactccagacttcacaggtaagagtgggagctcagttgagtgacaggcccatcccagacacaaagtcactccagggcaattattcagagcccccaggagctttcacgctctaggagcaagtcaggtaagcagcagcaacacacgtgccgcggaggcggcacctacattcagactctcattgctcttgattgactgggtggccctggaccagtccagagtccacggctctggaaatggtaatcaggcttgtggttgcaggggaatttatgtgtaccaagtgactggcacaaaacagaggcccaatacactcaatgctggcagatgatagacacagtggagcagcaaagctggtgaggatggaaacaccccatcacctgtgagtgggattagagcgtctgcagagggcatcctgctggcttcccaagccatgagccttctgataaatcttactgctctgtcagagcctctgatttaggggtagggaggggcagtcaggagaaagcatagttagctctcgggcagctagctgtggcagacagcgtgctttgtccctcagatgagtcacaacaagcgcccttggcaggcaggaaggactttgaagtgtggtgccccaaagggctggtccaggaggcccctgcctagcccctgggcctgtcactcctgaatctccatcactggcccgagggcaggcccaggcttgaaataaactcaggccaagctggaggcgcaattagaaggaagagagccatttggctttttccaaaaggtaagaaggaggacttctcatttttgtgctttaaatatcaatgcactcttttgatgccattatttgcattttctgagttccactgttcttgggcaaaatccaatagcccagctctgaaggcctcttccacatacgtgcccctcccctggagaatccctcacaccttctttgagctaccaggccaagaaaattgtattgagctttacctcgtgaagtttgcattttaaaagcaagatgtgttttttcatctctaaatataaagttttcacattgaataagcttttccaaactatatgcccttcatctggatactctgtggaagcaaagggcagcatggctgggtggtgctgagtcgggcagagctctggtctgtgcatcgggagactggccactcaccagatgacttctgggagccaccattccttatctgaaagctggacagctgggggcctccataccttacatcctgcccaccttccacagagttgtcatcattgactgagttatgtctagagaagcactttgaaatgcttctccagcattccaggtcagaacagggtggcctaccccacccaaagctgcagaaagagaggggagcgtgggtccaggggagaggatgtgtggggtctaaagatgcccaagacagttcctggtgagacagcccaaaggaggcagcaggctagaaacttgcagaggaacaaggaagctgtgacaccttcttacctggggacctcaggacaggaagaaatcatgaaacattcttactgggaaagccagaggagctttcctagtatttttgttattggtaacagctgtgaggtgccccctcagtgccctggcaactgtcattgtcacagaccccaggaacatggggctttgggtacagtttgaccctctccctgagatggaagatctcccttaacacctccccccggggacttgagacaggggtggctcctttgctcggctgctgcactctaaccctttgtgggaaggggagcatgcaggtgagtgggtgcaggaggcagggcaagtgctcttgggctttggcaggaatgaaccccatacctgcccacaacaatgtctagtggttgcctgtgacctctagagcctcagagggtgtgagttacaaacagtgctcctttagtattttccatccgtggatgactaaatgttaaaccaggtcagtggaggatcagggcgacagccttttaccccctgtcctcttggtgcctgggttcttgtccgggatctaggaagaatcaggtcacacagatgtgaaggatggtgaatgcaaagattttattgagtggtggaaatagctctcagtaggatggggagcttgaaaggggatggagtgggaagataatcttcctctggagttcagccatcctcagccaaattcctgtccaaccatccccggctgaactcctctctgaccatagtctctgatgtccagctgcctcttctcctctcaatgttcagacacctcttctcttctctccttctctgccacgctgctctgctcctctgccagcggagcttggggttttcatgggagcatggtgagccaaaaggcaacatttgggcaggaaaacagggatgtgaagttttcatttagggccatgggtccaggcttgggggtggaacccttgccagggaccccactcttttcttccctgcctcctggccatatcatccccatgggtttactgcatcttattaaagaactactcacaatgacctcagatcattaataactcagcatctgaactctgacttcctgtctcctgctttttggatatattaatgccaatgtgtctgcctgtatgcaccaggggtttgattcccccttgcaaggtttttaggagatttagacagtgagtcttacaacagctgtgcccagtttttaaagatctcgcctcctggaggtgaaagcaaggggggtgtattcctaaaactatatcaccaacagtgtgaagggcctggtactttgcattatctcatttattcctcactacaccaccatggtgtggataatattaaatccattttacacagctaagaactgaggctcgggaaagttaaataacatggatcactggtggaccaggactcaactccagcctgtggagctctagaaaccaggtcattccttcgtgccctattgcctctctctgaatgcaaaggctaaagcagagtgaggaactcagcaatgagtaatggctcattgtgaagtggactccaggtggtgcctacggggcaggggcttatgtgcccataactgactccatctacctaccaagttctcattagggtcaaagcatgcgatcagagtcagaggctgggtttgagaacctgctccttttaccgaataatttcatccccatgctgtacgagcaaacttgactttgctgaccttatctgtagcatgaaaacccacacagggctgctacgaatacagaacgagataatgcaaataacgtgcttagcatggcatcttctctgaacacctcaggttggcttagggtctcccattctgtgcccccacagcactctctgcctcccttgaagcattcttccctcttatttatccatctgcttccaagctacctaatctcaggggccccatctggcctgctcaccactgagtgcacggccctgacagtgcctgacacctgggcagagatgtacacctctaatgctgatctgctgactggtgaccacggaaggaggcacagcagctacagctattgttactgcttccttcctcccccaaatatacttgatgcttcagtggcatctccctcctgccctccccatgccaggcacctccatcctcatcctctgagccttttctcccaagtccccttctcccaagtccccttctccccactgccctcagaccccctccccatctcggcctagaagccccccaaggcttggtcctcccttcagtctctcccagctcctgcccacagccttctcagaataactggatggctcttagtgacacctcagggtctggaagaggccagaattattctgatactactgcatgtatgtttttgagtctccagtccttgttggtgtgctgggcctctgtggcaggggtgggaacctgtgtcccctgccccctgcccaggcccagtgccaggctgcgcacagaggaggcttcaggatgagtctgttgggcagcagccagggtgcccacagttaagtttcaagggaggacttcagctgcacctttaaagaaaaaaattattatgctcacattcatttcacacccttgtgacaaaggacacatttccacgacctcatctgatcatcatcaaccaacctatgaggtcagcaggtaggacaggtctcccctttgaacagatggggaaacttagtcacagagtataacattatagagctagcagacaggagagcaaccacagatctgggtggggcatccatgatggtcaagaacaaacccgagagccagactggctggtgtgattcccagctcttccacttatagctttgtttccttggcaaattacttaacctccctatgcctcagttttcccttctttaaaatggacataatacttagttcataggctcattatgaggaataagtgagttatgatcttcaaagcaagtattaactgattacgtgcctggcagctagtaagcactgaatgttgtaaaataatgcaacctagacatgcatatggagttctttacactatgtcctctccttttgtacacttctgaacacatccacaatgagaaggaagggagtaaagtgtcacctatttttctgttacttaaggaaggctctagatatggcatgagcctctgacaatgggatgaggacctcattctttaaaactttcgttaaacatggtgaatttcctttatacatgaacattgtaggttcatgcctcttggcagagaagatgaatacaagctgaattacagtatctcaataagatggcagtgtttattgcaaatgctgcaacatcctgcttgagaaaactttgatttgtagtctggttctatgactccaccaaagctagacaattatccaagcagcacctgacctttttgactgtttatcttattggctggcagtggtccaggcctttaatattatgcttctcctcttgttcctggagctttgagaaagataatgaaatgagttgagcgccacgtgcaacgtggctggctaggagactctgctggatagtgcaattggaagggacacctccgtgtgcttccaggggcctgggccagacctgactgggagctctagagaacagaagcccaccagctggaagaggcaggcaggaggtggcactgcaggcggtgtgaatgtgaacagcaaagggtttgctgtcccaggcctcactctgccacttgctgctgtgtgaccctaagcaaagcctttaacctctctgagtctcagtagtcctatctgtgaaatgagaattttaatgctggctctgacgacttcacatgtgaaactgacctataaatcttcaagtgcacactgatgttgttgtaatctggagataagcagcaatctactagcaatagccttgcatcgccattcagctttcatcctccgaaccagacttgtaggcccccagtgccagtgggagccctggtggtctggtctcacggtcaacaggaaggtctgctgtgccaccgccaccaccactagaacatcgctcccttcaaggatttattccttaggttatgatttaagccatatcaattataataccttaggaataataggtccattaatttttttcctacctatttgaccctctgctatgagcaaggttatttgctttgttttgcttttgtttttgggtagggatgcgagctgaaagagatagacagatcatgaggatcttcaagttaggggcattagaatagcactgtggggcagggcagagggacttgtgtgtgtaggcagcagcacacagatacggggctaggacgtaggcctggagtgatgagggtcaaccacagtcttcccaacatttcctggaggtcaacctgcttttaacagccttcattcttttccaactagtgtctcgctgccctgccccaaaatcaaggtgaagcagatactactccaggccaaagacacatctcctatgactgaccttctggtcttggccacacagctgactagctgcttgtgtcattggacgagtgacttcccctcttgtgtcaaggtgcgctgcagagggatggcgttggaggcaggagtgagcgcggagctgtgaggacccagggaggagggtttagaagtcaaggaggaagctgcaggcacgtgactcctgcactggcctcacctctcaccagctctgcaaggcccggagctgccatcccaaggctgcttttcctttcctttctttttttaaaattctttaattaaacttttttgattaagtgacagcttttaccactcctggcagctgctgcgagacaagataatttatagatgcattgacactatatgattaggaaagtacagtaaataacagatgagaagatgactcgtgcaacctgcagggcccctcctccatctctccagtccagcccccaccatctcccagtgagccccaggtagacgtctgccacatcactcaggggctgcgtggagcactcggtgcctttcccaccacaagatgacgaagatgtggtgttgacagactgctggtgtccgtggaccacagctctgctctggggccccagggactttctcagagatgcctgtttccacctagaggaaagacttaatgattctcacccttgaaagtgtgtacagaaatcctctagtcagaatgtccttgctgtgtaccagggcacactgtgggctccgtccagccaggcagggcctggactcaggatcccctaggctggtcacctctggttgtgggcgcttcatccatttccctgtggatgccataaaagcactgtccctttctctgtgtgccacactatggaaaaggttgagaatcaccgctagtccactccggggcctgtagcaaggagagtaattgaagtgccccgggaaactcgagccgtgtccttagctcttcagcactgccggagccccatgctcctcaggaatgagcccctggccttttcctcacagtaactaagagcgctcatgggggcagcctagcctgtctttctgggtgaagcacatctcctcctgtcctcttgtctaccctaacattccacgtgttcctttctcagggtaaaggccaccctcttcttaggagccccgcacccaagccaggcattttgcatgggaagcagtgccctgtgtacttacaatcagtattgtctaggcaagattaaatcagtgacattcaaccgtatacaatcctgcatgatcagacgatttgttggaaggcaggattcgagttcctctcagaagctggcttgctgtgcacgcctctcctaacatggactctcctcaagtgcccaggcagaaagcggccagctcccagccagatgcatggggggccctgggttccagaagatcaagtggccaagcacatgaagacaaatagtttgtctcgtcagcttctgggggtcacttgttcacatgggaagaaaccaagcagtggaggttaccatagaaagattacacagccaaagtttgtggctggattttttttgtggcttttctttgtgaagagttaagcatgaaggaccgagggtatccaggaagaagagtagctttgggattatcaggaaggatccacgtacatgtttctgacttcttctcaaattgcctggagcagtgcacaggacatagtagatctttccataaacactgctaaactgcacaaggaacttattctgttaagggagctccctacctctgtttccccacctgacaggcatgctagtttagactccttcgaggataactcggctactccctgtgggatatctggaaagaatacggacgggatatagatacattctactgatccaagtcactttaaattttttaaaaattttaaataattataggttcataggaagtttcaaaggtagcacagaggcagtgcccttcacccagtttcccccaatagtcacaccatatgtacataacgatggcacagtatcaaaaccaggaaactgactttggaacaacgtgcatgtatagttctgtgttgttttatcatatgtaggttcatgtgaccactgccgcagatgcagaacagttccttcgctatggagatcttccccgtgtgcacatttagacacacccacccttcctcctcatcatccctaacccctggcaactacttatttgttctccatctctataattttgtcatttcaagaatgttatataaatggcttttcttgcgtttctgtggattcgttgaacattttttagaactccatttttatctacctctagtgtttttgagtatatctcttcgtgtagctgttttgtggttgctctaagtattacattatatatacataatttatcagtctactggtactacttttttccagcccaaatgaagtgtgtctgtctcacttttatcctcacccatttatgatagaattgccttaggtatttcctccacacacatgagaaatgcatgtgttacgatttttgcttcaactgtcaaaatttagaaaactctagaggagacagaaagtgtattcatttgcccatattcttgctctttctgttcttccttacttcctgataacccaagattccttaaaaaaatcatttcctttctgcttagagaacttccttttgccattcttttagtgtaggtctgttggtgaccaagtctattagttttctttcatctgtgaaaatacctttatttccccttcatttgtgaagaatatttgcactggatatataatttggttgacactttccttcattaggcacttgcaaaatggtatgctacctctttctaatactcctggtttctgatgagaaatatgctgtcatttgaattattttcccccctgggcaaggtgacatttcccttgcactactctcaagatattttctttgactttggttttcaagggtttgactgtgatatatcttggtgtggatttctttgggcttatcctattttggcttcactgagcttcttgaatctgtaggtttatgtcttttgctaagaaattttcagccattatttctttgagtactttttcagccccatcctcctctttctctccttctggaactctgatgacatggatgttagagcatttgttataatcccacaggccacccaactctgctcactttttaaagattattttctctccattccttatattaggtaatttctattattctaccttcaagttcattgattccttccttcgttgtctataatctactattgagcccattcattgagttttgaaatttcatttattgttctttttacttttaaaatgttcatttagccttctttatgtcttccatttttttactgaggctctgtttctttgctgagactttctgcatttccacggtttcaagcctgcttgtaattgcttgttgcagcattttacagtagccacctaaacatttttgtcagataattctaacatctgggttatctcagtgctagtgtcatccaagtgccttttctcattcaagttggtgctttcctgttcttggtatgaggaatgatttccaattggaacctggatgttctgggtattatgcagctccggatgttatctgaagccttcccttacagctgctttcctttgccactgacccagcagggaggagggatgccaccatcttgctattccagtaagggtggaagtcaggttcccactcggcccccatcagcactcagtgaggcagggcctcctcattactgctggcgtggctcaggctcactgccagacctctgctgataccaccctggctggaggcagaggggagcctcgttactgcctcaccgacaccgcagcgagggagaggcctcattaccacatggtgaatgtcctggcgctcccttagacctcctctgacaccacttcggcagggaaaggggggcacacctcattactgcctagttggggtggaagttcagttttctcacatcgtctccaccgacaccatgtgggtactggggagcctcatcatgacccagtgggaaggaacgtccttttgataatagccgtcctgataagtgtgcagtggacatcgtctccaccgacaccatgtgggtactggggagcttcatcatgacccagtgggaaggaacgtccttttgataatagccgtcctgataagtgtgcagtggacatcgtctccaccgacaccatgtgggtactggggagcctcatcatgacccagtgggaaggaacgtccttttgataatagccgtcctgataagtgtgcagtggacatcgtctccaccgacaccatgtgggtactggggagcctcatcatgacccagtgggaaggaacgtccttttgataatagccgtcctgataagtgtgcggtggacatcgtctccactgacaccatgtgggtactggggagcctcatcatgacccagtgggaaggaatgtccttttgataatagccgtcctgataagtgtgcagtggtattgatttgcatttccctaatgactagtgatgtcgagcatcttttcatgtgcatattggccatttgtagatctttagagaaatgtctattcaaatcctttgcttatttttatattaagacagaaaatgttagacaataactattctcctccagccaaacaccacaagaaacactgcggcttcacccactcttcccccagcaaaggccaagtggggaacctcaacgtccatcctcatcaggctgtaacaaggcaccccaactcttttgccggggtggcatcaagacaggtggggaaccaggaatttccaacacacgctacaacatgggtgaaccttgaaaacattatgctaagtaaaataagccagacacaaaagaacaaatattacatggttccacttacgtgaggtacccagactaggcaaattcacagagacaaagagtagaattgtagtttccagggattggagggaagggatcatggggatttattatttattaaatacagagtttcagtttgggaggatgaaaaagctcaggagatgggtggtgataattgcacaacaatgtaaatgtgcttaatgccactgaatgctacacttaaaaatggctaacgcagtaaattttatgttatgtatattttaccacagttttacaaagtctgggtcttgctagacttcccctttcctgggcttttggctaacgagaggaggctctaattggggcttttttttttttttggtctgtaccttttgatgtttctgggttccccaggaatccagagaactctgctatgttattcctcaggtcctggggttcccttctggtctactgcttctctcctcttttagagtctttttatgtttcttttacatataacgtacagggattttggttgcacttagtagggaaagatgtgtctactccatctttctggaagcagaagtctccaggccactttatgtgaagagttttgtccacatttcatttctttttgctcactagtgaagtcttattcatttcaatttagtatataaaacttatagctgaaaaatatatttcattttcatggaaaaggactcctacttctgaaaccttgcattgatatttctagacatttccagggcaccagtcataacatcaagtaagaagcctattgccatcctccgtgacatccccttcctcaatatctcttttgcccaatgttgcaataatactaatcccaggtgtgttgactagtgccactcataatcacattagtttatcctacttatgctgatccttgtcttcttgtcctgttagtgtcttcagctcgtggctctgttccttttacactcttgttagcacatgtgatcatacacacttacattggacttgtccttttgtcctcatgataactgctgactgttaaaacacttcttggatgaagcaccctgatgtagcaccctggtaaaagcaatgggctttgaattgggatgtttgggttccgacctagttttgccactaatcagctgatcgtctccttcccctagatgtttagcctcagacccctcaccactaaagtgacaggtgtagaactagatcatccctagggacccatcctctgggaagtatcttcaggttcaggctagtcagctctgataaagtcaagagcaccgtcagaccaggaggttgagaatggaggtatcaccgtaggtgtgccctccttgatgagtttttgctgatggatatattaaccagcagtggacggtcactacaggtagaatcttcaacgagactcctattttaggtttctcaccataatttcttaatttttgttggcaattgtgcttgaagcaaaaaccaaattagaaatgatgtttgtctgttgttccccttgaagttaggtgccttgattgcgggtcctctttctgtctgccacttcctcgcagtcccccccaaaccccttatagtcctccctgaagctgcagtgttcaccctagcaaggcaagtacctgtgctcccttggtgcctcccatggcacttgtgccaaatgcaagaaagaggagccaacgcagggcccgctgcccagcaggggaggtggaggcaacgcaggtgtgatgtacacagtccctctcaggtcagggaggagagggaagtagggctaggaggaaaatggggcaggagaggaagggagagcacaagggagaactagtggaagggagaggtggatgagcaggacagctcggagagacaggaacgcaaacagaggagaattttcgctcggggtgggaatgaatcatcctcacctgccagccgcgggcctcagcaagctggcagcttcgtcctctcagactgtgggttgcttttagctgtcagccttggatggtgggctcatgcattctgttcccactccaatctgccagagggacagggtccttccccgcagcactgaggcttggccagtcgtgatgcctatggcgaccgcagaatcgacctcaacgagctcgtcgccgggcaccgttttagcagccccaccacccatttttggaaacacaaccctggcctcccattcacagcagaaaagggcacaaggcccttcgtgtcccaccacctcccttctctctggaatcactgtggctctggttgtggaagtttgtcatgagtggaccccagcaaggaattggtgcatgatatagttttcgttttcaaaggaccatgatttccatggattactttgtgcaaaggatgccaaaaccaaatatttaaagtaaatgaggaaaaaatatgcttggagtaaaaagcatctggaccctgtgcatgtgcgtgtgcatgcgtgtgtgtgttccaggagctgactctagctgtgaggatggctcgcctgtgtgtgtgtgtgtgtgcatgcgtgtgtgtgttccaggagctgactctagctgtgaggatggctcgcctgtgtgtgtgtgtgtgcgtgcacgcatgtgtgtgtgtgcatgcgtgtgtgtattccaggagctgactctagttgtcaggatggctcccctgtgtgtgtatatgtgtgtgtgtgcgtgtgcatgtgcgtgtgtgtgtttcaggagctgaccctggctgtgaggatggccttcctatccttcccttctcctggctgccctatccttcccttctcctggctgcctcccattgtgacatggatttttctctcatctttctctccctactccccttgcagcatgagaggcccagtacctgtaagactaccaggctccatcactctccagagaggccagttctgcctcttaggaagggcctagatcagcgcaaatctcaccatcatgatgtccccaactgctccgcccgtgtatgtgttgggtatttccaactgtccccagcaaagcctgcctcctccccacctcctgagccctgtggggtatcaggagcctcaccactcgagcggggaagaaggacagagcagcagcctcagcccacagcagccctgcggtggagagctgcaatgaaggcaggccttatatagacaggaaaagcagggtgactggaagtactcagtcacgggcagagtcagagccctaggacctttagggacaaggcaggtgaaagacctgttagaattagggagtgaggggctggaggtggggggtacactggaatgttacggttctatttttcgctgagtgaaaaccactaacaacaactacagaagccctgctccttctgtgggctaaaatggcactgctggctgtgtgttcagagcagctaagaaccaggaggaacagagcccttgcctctgttcctagtccccgggccctggccttgccggagtcaccggaggcaaccaagagcccctcgttcagaaagcagccatgaggtagcctggccaccctttcaccttttacaccagggagcccagaggtttccagggcttgctgaagggaatccaataagaagaagatttcagatcctcaggtgtgtgcaggggattagcccagcgctgctgtctgtccaccctgaggctcctcccccatcctcaggattgctgggctggaggcagaaagctgcaccatccttctgaagctctgccccaaaggaattgcagatgtctgcttcctttcatttggggagagaagtcggaggcacaggggccatgaaaggggaaggcgtttgacttagatagcctctccctcctggctgtccctctgagctgtcctgtggagccaggaagaggctttctgggccccagagctgtcttcttgctcgagctaggccctggctccccacgcccaagaccccggctccccacgcccaagccccccccatgcccacctgccactccactgcccttagctcgttacccctgtggctgtggaggtccctcaggaaaagcagctccccaggcaggggtcccttccttccctcaccacagccccagccccactgcaggacgcccaggataccacaaaggccccccacaatccctgctggcaaggccgtccttccacagcacacaccggagaggccttctctatgtgcctcgataacctcagacctggcttcttagagaaacgggtcaggcagtgacgtttgtggctttgtactccattaagtgctcttcaggccctccctggatcttttgagatcatggggataaggggcggtgcccagcagacctggctgcttaaaccatggtctccaggagataagagatgcataagctccaggagcccagcagtgagacaggcgcccccgcggccagaggctcacactgtatgctttgctttagggctcgggagaaagcacattgagctgcgagtgagtaagtttgccctatctctgtcattaattcaatttaattcagtcacctccgcttcatagtaagtgctcagtaaatcatctcacttttttttgaaccagagaataaatatattgatcaatatgtaaataaatagatatttaagagatgcctatacaatggatttgctgagttttcaaactattgaaatcaggaggaaggggctatgctggaggaataaacgtgtctgaatgtaggtttgtctcatgttgagtacgtagcagagaacctattctacgggatagaattgtggaataaatgacatgagggcacactgagaaaagactctgaaaagcatgcaactctgtccaagcctaacaattcaaaatgtaagtaaaatttatgatataagtgaattggctgctagaaagatactctcataaaataagctggttcttgggccgacccaatgcttttttgttttcttgagaaggagtctcgctctgtcgcccaggctggagtgcagtggcgtgatctcggctcactgcaacctccgcctcctgggttcaagtgattctcctgcctaaacttcccacgtacctgggactacaggtgtgtaccaccacgcccagctaatttttgtatttttactaaagacgtgtttcaccatgttgaccaggctggtcttgaactcctgacctcaggtgatccacccgcctcagcctcccaaaatggtgggattacaggcgtgagccaccacacccagcctacccaatgctttttgaatgactgcatgaacaaatgaaagcaatttgataaagcgtgaatgactctaccatctatcctatccccataggccccctcccccaacactcttcccctcctcagtttgaattgccatgtgaatttattgctcctgccaaatgaagtcagctgagatggaaatgttaatttattggaccagacatgtgtcaacagagctctgataaaatgcagcgacatgctgttccaaagcccgctatcccgaaacctcctaccatcctgctgcaaaactgctgtgtttgaggtttcacagcccctctggctgggtctggccgccgtcctaccatctcactcaagtcccgccgtccctccataacctcatgtgagacacacgggtccccaaagccaacctgacctttcccacctgcatctttgctcaccatggtccttccacggagaaggccctccactgccatttaggccattggaactcttctgtcctttaaggcccagctcaaatgcctcccgttcctgagctagaggtgagcttcccttcctcttccccaggcacttctttgttagggaacaggagttttcctctcctgctagactataagctccttaaaagctgagaccatctgatgagtttttaaataaccccccacccaaggctgcccccaaaactcaaatcagtgccttgcatagcagggatgcaacattaggcagtgcagagagagtgggattcagagtaagactggcccaagtcctatcccgtctccgttatttgctggccgtgggacccgggataagtggcgtaatctctgagttttagttgccttatctgtaagatggggatgacactagtcacccgtgttccaagtgtcacttgatttactgtctgcacatggcactcactcaggacatagctgcctgtctctgtattctcctcactccactagagcccatcattttcaatatttcttttaaaaggactagcacttaagcaacacaaacttcccattccttttgtggctcagaatttgggaatgggaattttactgagatcatcaaaggtgaagtcgtacataagccatgaggcagacaccagcttcccgtggatggccggattttgattgcctgtgcttagtgggaacagaagggaagggaaggacctgggaggcctggataggaactaagttcagctggtgtctttatgcctgcgtcaggcttcccacctaccagtgtcaaaggaagggcagcgtcctttgagatgtcaacagctattctgagatttttaaaaaatgaaagggttctgtgttccgggtgtcagctgactgcagcctctacctctgattgagtgtcacagggcatacgagctcattaaaggctctgagaagtcctgtagcaaagaaacctttggactttgcttaacccagtgtttcccaagttttttgtaccccttactgaatgtgggcagccctgagctggagatgtcacttctagccagagggcagtcaggtgtctgccggggagaccctggcttcagttggacaggggtgctgggatcacgggctttctttctcccaagaactggcccaaaggccagttcttttcccaggggacccaaaacagggcttaccgcctcctggagtcaggtatgagtcatgcccaccgggctctcttccccaaggcacccgacacggtctgtgtgtgccatgggctcctgttccataggcacgcacaccctcttctgctgggcagatacctctgtggcatgcgagtgtgggacctgaacccaggttctgtcagggtggcgagggggctcacgcagaggatccacttttctgtcttgctcttgtatgttttctcttcctatttgcctttttattctcctttgtatttttaaatgttcctctctagtaatttttgctagtcttttttatctctcaccttgtttcttccactgtgagtaggctcaaccattcgcctgttgtcctatgagccacatccacgcttttctacctacgtttccaaacttgagcctggccggtacactgacttccaagcctcccgtggaggccgcgcagcgcccctgtagtgccccatggcagcaagctggtgacctgagctgtgatcatgaaaaggaaatattcagcttttcttccaagtggaaatactttatgtattttctccaaggccacagaaaatgaaaataaaaaacagtactggcagcaggaataacaccaccgtcccaagaagaagaaatgaaaacagtgacacactctgtggctgccgctctcctctgagttggtcaagcagaggccctggggaggcagaggtcggacagtggtgaccgtcagtggcagttacagccctgtgtgttcggggccttcctgcttgatgtgaccagagctgagcttggcggctctcattgagcagctaatgcaggagtccccgccatggtggcctcgtcccccagcccctctctgtctttgcttctctctttgcctacctttctctcctccaagtgtggtcaacctgccctttccctggccagctcttatcaggcaccccttccccgcatttcccggccacccttctcttatgcgctgggtgactctcagtgctgactgcaggcttctcttcctgctccttcctctccccttccctttctgtcctctcagaggagcccaggtttcaggctttgctgaggtgagggtgtgggggcgggacctcttcacgtgtatcctcaagctggtcccttcttgtcctgcgggtcccagctccagtgcctccttctcagagaggcctctctcagccctggttgttttcctttgacagctcatcgctattttagaaaggtcttatttgttcactcatttaccgtccttcccacctgcgtgcacctccgtgacagcacccttcctttatggctcgctttctctttcttctcttgttccccactctatttcgtgggcctggaaagtatcaggcacattggagatgctctatcggaaaggaaaaggaatgaaagaatggaaggagtggtggaagaaaaggaaggagggaaggaaggagggaggaaaagagaggggaagggaggaagaaaaaagagaaggaaggaaggagtgggggacgattgtaatatttataagttttaacccaatagggtagctgctaccgtctccattttatagaggggaaactaaggcacagtgcttaaggaatttgtcccaggtcaaaccactagtaagtggcagcacctggctccagaaccagtctgtctccagactctgggctcaaccaccacgctctgagcctgcagtaagatgtacaaggcagaagtcctgtgggtgacaattgggactccacccaccatgccagggaacgtctccatcagaagtgggagaagaggagttaatttttacttgacactgactgtggaagtcattatctcagacacaatttcacttcgttttcatcacaaccctctgaaaaggaccctttacaaacgaggactctaagaatcagagaggctaagggactggccagagttcacacaactagcaagaagcagaggccggattcgaacccagctcttctagctccacatccggagtgttcacattcctcatgctacttggcttttcatcacagacagtcctttagatgttagtgactgcctctccctgttgtggaaagtcttgttccgtacacacctctcttaaacatgcttgcagtggatcaagtgtgctgttgcagtcacttctatacaatgtggagcagccagtcctctggcaaggatgtcgctttggtccaatggtgaaatcagacctagctcatgtcatgctgatgtagaaggccttctcctaaaagtggccgtttccatgcgtggggagactccttgtagctagcccatactctgcgatgcgggttgtatctgtggctcccgcccggtgatgtcctgtcatgatcagcttccagcagttgtgacccacttgcagtcattcaccttcacctcatgggcctgcacggtagtggctacagacacccacaacaggttcagtggatctcaactctggctgacagtgcttgtgggtgcttttaaaaacgctaatgcctggggcccttccctggccgctgtttaccttgtctctggggatagggcccaggcagtttgttaaaaattcccaggaggtacgcgccaaggacctctttctggcctgtcggatcaaggggccctgtgcgtgtgctgcagtctgtttggtggcatgtgactggctgcaaggtggtccaggcggatgacaagggagaggtaatgatgctgttaatcagaaacattaatctgtgctaatgtatcatccctcccaggtagcagaacgttctcattcagttaaaaatctcatctccttgaaaaggcccttgagaagtgagtgatgtgaatgctgacagttttggaaaccagagagagattttgggcaggagacttttcactgtgctccaattcccccctgcaggtggctacccctcccgcctgtagcaataaagattgacacaggaatggcaaggggggcctcccagagcagacattcttctagctgcatattcagcaaatacctgtgcggggcctcccaggtacaggtgctgggctcagcagggacttcagtggagaccaaaaccaggtgcagttcctgctgttactgggcttacatcaagcagaggaagttgaccttacttaagtgattctttcccacaggatgagggagccgctccctctctgcttttgggtccctgtctaaccttctgcctcagctcgctcagctgcatagacagataggcagaaccctagcattacggcaggcatctcccaggctggcttctcctgggctgcgggtggcctttgattttggagcctctgctgccccacagtgctccccacctcccacctcttttgcctttggatggggtcttccacatttcagatggctataaatacaacaggtgcaagttcagacgctccaaggagagcaaccactgccattgggttgtgcagtaaggtgtgaatgactaacatcgaatctgtcctgagagtaggttttagtagagagagagaacctggcagagttgcgggcctgacgagggcaggggaagagcctgtaaaacaagccctgcccacagcagactgttgctcagttaggccagagccctgtggaggagatgagtgtttgagtgaggagagagaggaggaggagggcaggaagaggaggaaaaggctcttgtgttatgttccagttatgcaccacaaggactgcatcatcccgggaagggcccaggatccctcctccagcaagtaaaatgagtttcaaagagcacttgggcaatcctgatcagtgggactcacctttgcctgcagggagctgacacccctggacaactggccagtggagcctctagggaggtggggtcctacaacctgacacgagccaggtttagcctcagatgcagcccatgctgacccccagtgggagcatgctgacccccagctccactgcttgtagaggggattgggagctgaggggttctttacctcctggagtcacagagccccttatggtctgttggaagttacagacccctatggaaacatacaaacaaatgtgtacatgcagcactatatgtgattttacattataaaataagcactaggagggagcaaaaggatggggtgttcattttacagattagaaaactgaggccctccggggcataacgccttcctgcaaccctaggcctctctgcctgtattaggccattgttgcgttgctgtagagaaatacctgaggctgggtaatttataagaaaagaggtttcgttggctcacagttctgcaggttgtaaaggaaactcagcaccagcgtcagcttctgatgaggcctcaggaagcttccaatcatggcagaaggtgaagggggagcaggaaatgtcacatggcaagattgggagcaagagagagggagggaggaggtgtcacacacttttaaacaaccagatctcatgagaactccctatcccaaggacagcaccaagacatgagggatccaccgccacggcctgaacacccccaccaggcccacctccagtcctccagtgttggggatgacatttcaacatgagatttgagggacagatatctgaactatagcaccaccatgccagttccctttctttctgtcatcccagatctaccatgaatcatgtgtcacatcaaattagactcgttagggcataagcaggggccccgcagtccagaatgttccaaataaattgagacttgtccatctgtgtgtcctgatttgggggttcaaagaatagtccctctagacaggggcacaaacccttccttcacacacagtaggcccttgaggaatagtggttgcagcaataaagaagagaagagaattctcaagggtgtatgtggcctctccccctaagagattttgactctgcaatccaacctcaaccacacgggagagagggcagccagtgctgaggctggatgggggcttcatacctgtgtcatcatgggtgccggggcccagcctgccctgtgctagggtcacttccacaccatctctgtacccgccaccagtctccaatttggcccacattgcactttcagccttgctctggccctgccaagcttttcgtaatggggtcactttggccatggcctcacccctctggatgtcaggacaacgcagccagacagggtaatcagacttaggcaaaatggtgtgtgtgtgtgtgtgtgtgtgtgtgtgtgtgtgtgtgtgtgtgtagggggagggagcattcaacagggagagaataccagataataaagagctacagagccaacagggacatggagccactcccactaactgaacctccctcctctttccctccatccttggaagttgcgttccagccagctgccactgttaattcatatgagagattggaccagggagatgccaccaggctttcacccccgctgtgatgctgaggctgtgggagggatggtgtggttgactggggccaccttcattagacagagctgccatcctgataaaggaaaggcttcttgtctcagagctgtgtcctcccactggcttttctccctgcatgctgtaactggtcatctcagtcctgaagcaggtatgtgtgttgggccaaggtggaaggagagtgacactgttattaaattaacccagtccctttcattgcatcctccaagtgaagaacaaaagggattttgcatttgcccacagtgtctctctaagcaaggtctctggaacatctgtaggaactcagagacgtttggaatgggccaataaaacatggtgagcatccagcagcagcctggggtgctgggcagagccgggacctgggtaggaatcacagcaggattccagccctggctctgcgccttgcattgctctcacctggcttccatatctggaggaacatacctatttctcacgatcactgtgaagatggaatggggttttgtatttgaagctctgtgtgcagttctggagccccgaatgtccttgggggtgctctgaaaccttagtgcctttatctcttctaatggtaggaaatgcacccttattttagtcagatcctgtgaattaaattttaaaatggccataatagctaagaaggtaaactattagtgactaactaagttgaagtctccatcagtgtcaagaagacagtttcatttgctgttacataaagttttcagattgtttttctcatacttccaacccaaacgtgcagaatatttaaagcttagcaaaaaaaattatagggaacttagaaatatataaaacatgtgatgattgtaattttcttgtgttaactgggtttgcaactattttgctaggataatctgcccaattaacctctcatataacttctgaaacttgtttcatagaacacgtaagggcaaaggaaaagcaagactcagtcaatgtctgaagcaaactggagtcaatgaggcaatgcctgcttagaactttgcacgcttgaagtttcatactgttaattaaatctgcctcaattcttttttgagggacaaatgggattcaccatgggaaagagagttatctgagaggaacatcccagattggagaaggaagaggtcaactcagcccaactagagtagtccaacagtttaattctatctcactacaacataagcgttctgtcaggtgagcctgctaagttcctttcctctcttctcttgggtctgtaagagtatcgcaattctggccggacacagtggctcacacctgtaatcccagcgttttgggaggccgaggtgggtagatcatgaggttaggagatccagaccatcctgtccaatatggtgaaaccctgtctctaccaaaatacaaaaaattagctgggtgtggtggtgtgcacctgtagtcccagctacttgggagtctgtggcaggggaatcgcttgaacctgggaggcagaggttgcagtgagccaagatcatgccactgcactccagcatggtgacagagcaagactctgtctcaacaaaaaaaaaaaagcatcgcaattctctgtctcttgtcatggccatgctaggacatgggcaacctggtagtgaacaaaatacctttctctgttcctccactcagggaaatctactaatacttggttagactttaatttttcaattttgcaatctagaaacagaaaatacccataaatatcccaaaatagaaacaaaatgcggcccattcagtttccaaaaagtaaacaaagtgattcttcctccatgagatgcctgaatacattcatagttggctaattaaactaccatagaaacaattattcaatataggaggagaaagagaggaggaggaaggagcgggagcattagcagacatacatggcttttggctaggaagatagctgttacaggccagtggaatggagggaaaataacccacggagggcagaatcatttctgcagacaagtctatgaaccaagctgagccttcgtccttttttaccaatagagtttcccttctttccccttggtgcctccccagccatctgtaggaagaggatcccaacaagccttccttcaagtcagtttcagagcatttctgccctacaaggacctgggtatatcttggatgccttgggaggctcattgaagtaccataggatggccatgttttccaggtcatctgagataaccccagcataatcacctgtgtcccccacaaaattattaatagttgccctctttagctctctaaagtgcccttgtttgagtgctaactcgtgtggccagtccacataccctgcagggagggtaaagggcaccaccttatgtgtcagcgctgactggcagcagctgctggagtgctgtgttgaggagggttctgcagtcgtgttgtggctcagcaagcaaagccctggcaatgggttaactgcagcggcccgtggggcaagtgagggagaggcagcactccctgccggcacagaacaaacgctggccaggtcagggtgtgggtttcaggccagctctgctcctagcttcctgtcatctgagtgggatcgtttcccttctctgatgttggaccaagatacctgaagttttctttcaattccataattcgaatctcgtcctccatcgaggattagcttggaagggagctccgatgtcatctagcatgatttcccactccctccatctagtgggggattgtgcaagataacatccgagctcccttccaaccctagaatcgtgtgatcctatggtaactttgtgagagggccctctctgctccagagtgaagctgcactttgggacggatgtcagctagtatctagtattctcatggtgcgttttatagttgacagagcacttgcatgtatctgaccacagtcacatgactctggctttattttcatcatcttcattttataggtgaagaaattaaagctaagtaaaggccaagtaaaggggactctgggctcaaactgcctgggttcaagcacttgccgtagctctcacaatatgtgtggtttgggcaagttaatctctcagtgtctcagtaccttcatcggtaggatggggtaatatacttacatcataatgatgtttcgaggattaaatgaaacgattcatgcaagctgcttgggacactggttggaatatagaacacatgtaataaaatgagttgatagagtgagtggtagaggtggtggaggtagcaattaacagcagtggtagtagtatagtagttacacccagcaagtaaatggcataactgggactcttctcagaaactgaccccacagtctgtatgtgaccccagtgaccccagaatttactgcgctgtgtctaccttaggatttatatccacaggtcagaagcagcaggcaaggtaatgagaaaaataaagatgatgtttaaagagatgttttccccatctagccctgagagagtattggctggggagctgaaattctcccctcctcaacctccgataatctggtaaggtcagtggcaggtgcagggtgcttgttatgccattgctgtactatgggctcatggcaggtggctgaatggacaagctcgtgctccctcccgctccccctcccctcctcttgggagagactgcctgcgatgtcagtgtttcttcagtaacccgcgcacattatgtggttccatatggatcagtaaatttcccccaatctctgtattacaaggtctggtgcctcattaatggcgtcttcagcgccacaagctgaggctaacagctctgtgtttttccatcttcagtgggtctgcacacattttcagcaatttgcaggaaagacctcaattagccaaattcctacgtgactcagtgaaggcattcagaatgcactcagctgtccatcctcaggtggagaggggtgatctgagaggtccagagaagaggcagaaagaaaaagcaagcggggagaggaaaagtcaagggggagggagggaaaacggggagaaggtgagagaaaccacagcagatgtggaggagcgtgtgtgaggacatggttattttcacccagcatgagacagattcacttctttcttggatgtttggtgtcttggctaaaaatatgtcaactgaatgttgtctcagggacagggagatggagagcattaggacactttgcagaaagctcaggcctggaacggggctttctttcacatgtgggtagggggtgagtgcttgggctatgctgagagtggggcccagagcatcgacagtgcagaaactcacttctccaagagcttcagcagctccaggacccttctgcctgcctccctctcccaattccattgtgaagtggcaaagtctgttccaggtactgtgtcctgtgggagggtgaggaggaagttgaggaaacctctctcccagagactgagctggcagaggccatgggcatgggcgctgataagggccaggaagcggggagggtcctaacaccatgacaaggccaggtccttgtctgcagtgtcacagggctgtggtcctctattggccaacagtagctcctctgcacctggaggaggacgtggggcccactggactcacctgggcgactgtctgcactgtgggagggaaggagagtccagaggtctggtcagggactgaagcatggcatgaggcagccctggggctaatgcaggccctggctgtcacattccccagggagggataggcccggaatcattgctaggtagcatagaaacctaacacaccaaaagcagagaattgggtaaataaattatagtacagctattcctgctactagaatgctataaggttattggaaatgatattgtagacaaaatttgacagtgtattaaatgtttaaaagctgttgttaagcaaaaatagggaatataaaatgatacgaacagtataatcgcaattttggaaaaatacacacaaaggaagtagattaatcatataagcgaaaatgtcagcaacagtagcttcaaggaagtggaatactgctccttttccttttcctgttttttgggtgggtgtctcagagttttcttaaatttataacatagaatttgttatttggctattagaaaataaaattatcgagattataagaaataattgggacaacagcaagtcacattttgctgacttcttattggccatttgagaaaactgaaccaaaggattaaaccatgagagcagggaaccctggtccttacctttacaatataaccttttgcagccagtctttagaggtgtggctttaaatgcacttacctcatttccagcctgggcttcatgctctcctcatttgcaatgctaagctttttatctattttcccctcaaagctttgtagttcactttaaagactttactgaaggtggaaaagcatgggaagcctggattatccaatcccaatgcctgggacaaatgaaaggtcacaagaatgagaagaaaaagtttccagagggtttttagaaagccccaagagacttgggaagtcaagtaataatttggcaggaggggtcttccttgctttggtttgggtgtgcctctttggatttcgtggtattcttgttgggggaacagatgactatgttcctcatattctcgaaggcatttgtggtgggactgagaaattagcccagtcctcatggaagagaatgagagagtaggatacagctcagagctgggggcagggaacactggtgagaactaacccagcacagttattttcatatacccactgaatttccaaatcttatcaatcaatgagcagtacatacgcccaccctgtgcaaaatactgggttaaaaactggggggtctaaatatgatacatgcctttgccgtgaaggactggcaatctaattgagaaggtaataaacccatctgaagttaatattatcagaaataattgacaacagtgtgtgagagatgccacaaggtgagtagtacatgattaagtgccaagagagtggcatagacagtgagtgctgggtctgtaagaatgggtaaaatctgaggatacatgcagtagatacttcaggtctgggggaaataatacaggtaaattcttacagataggaaagcccaagctgtatttgaaaggcagtagaagggtttaggatgcccatgaaaattgtggtcagaaaggtgatatatcagttagcttgtgctgcgtaacaaactacccggatacttagtggctttaaacaaccaccatttattaacttacatttctgcaggttggtaatctggattggctcagttgagcagttcttctggacctagcagggctccactgatcttggtttggtgttcaagtgtctgctgtcagctggtggtttgctagagataggcagttcatagtggcattggctgatatggctgggatggctgggatgtcctctttccacatggcctctcattctttagcaggctttcttggcttgtttgtgtgatggaagaaaagttctcagtgtgagaggagaagctgcaaggcttcacgtggcctacgcttagctgttgcacattattccaccatattcttttggtcaaagcaagtgacaaagtcagctcagattgaagagatgaggaaatagactctgattctggaaaagaagagctgcaaaatatcgtggccatttttgccatcttccacagatgggttggttggattgggtgccagaccaaagaaccctttagtaggaaggacatagaaaggatgtaatgagctagagagtgggaaggacctgtgcttcccagtgccagtctgccgacctgtgccaatctgcaatgaaggtttatcagcctgcagttagaggagaaaaacaggaagggtgcattgtgtacatgccagggacggggatggggatggtagtggggttttcagctgttctttattctagtattgcttctccttcctttcatgaaatgaaaaggataacaaatgatcattgttatttttaatatattattggcagaataaaaagttggcaaccctgtgtccattcctaacatttcttttgcttttgtactgatcaataaaatcttgactagagcctgggtgtcactggatagcctatgaagatcaagaattcccagaaggaagaaatggctcgctaccgacccacacatcaaggaggccttcccagcagaggtgggatctcagctgggccgagaatggctagcaattgtcaggcatattttattttactttatttttatttttttattttttgagatggagtttcacgcttgtcacccaggctgcagtgtaatggtgtgatctcagctcactgcaacctccgcctcccgggttgaagtgattctcctgcctcagcctcccaagtagctggaattacacacatgtacaccatgcccacctaattttgtatttttagtagagacggagttttaccatgatggccaggctggtcttgaactccttacctcaagtgatctgcccatctcggcctcccaaagtgctgggattacaggcgtgagccaccgcgcctggccatgaggcatattttaaaaagtaaaataccattgattttggaatgtttatactgtattagtggctccttatcagatcaaacactcggcctgtcgctttagagctttcaaactgagaaacactttcaaaggaaagactgtctcttattacttgcttgtaaatggaaaacctgttttaattacacctgaaaactactttcataagattgacttatgtactgtctgttcaaaacttacagaagcaagccccaatttttttcactgacatttgaagccttccctgaagggacccccagcacatccccaccctctgtgccatccctaccctgcaaacccctgctttaaccaggtctaatgggcactgtgcttgaatgggcttgtctcctgctggccttgggtcctcccctgcctttcagctttctcttctgccctctctttggtgggaagttcctacactgccttctccaggaagccctcactcctggatccagccagctgtggtgttggctttgcatgtcactcacctggtatttagttctatttggggggctattaatcctgcctgcctagactgccaccttcctgaggcacagatcttgtcttcccagtccctgagtgccccgtgtgtgtggcatctcaaaggcggggagctttgctcactctgaaaggagccaacacagtaggagccccagactgtggggccaggcatgtatctccctgctacctacttatctgtgctgtgacactcatggtcccactgaacttgcaacccaatgagatgtcctcctggttggctggacatttccttaaagacatgagagaagaaagagagctcattaaagtcagaggtgctctctgcttgccctgggcagtgactttgcagcgggaaaccaagaggctgatgctgatgtttagcctgtgtccaagccttgtcacgctgattctgtgcaaagaggagaagctgggagcatcttaggtgatgtccttgtgttagttacttaaggttgctgtcacaaagtaccatgaacagagtggcttaagacaacaaaaatgtatacttttgtatcctggaggccagaagtctgaaatcaaggagttggcggggccattctctagggagaatctgttccatgcctttcttttcgcttttggtgttgccaacagccttggcattccttggtttgtagatgcattaatcactcagctttgcctcggtggtcacatggcttccctctttgtgtgtgtctgttttcccttcttataaggacatcaacatattggattaggggcccacaaactccaggatgacctcatcttaactaattaaattggcagtgaccctatttccaaataaggtcacatcctgaggtctggaaaagacatgtatttggggaagggaggatgctgttcaacccagtgccagcctggattctgtaacaaactgactgggaaggagtctgcgctctcctcggctaacagagagaattctgggacctaacatctattcagcaggcacacaccaagttgatgtgggggaaaagcactggggttggagtcagaaaacttaggtataagcccagtctccaccgtagtccagtggggtaaaccttgctttccttgtctttcccatggggatgataataccctttcctccctcccagggttcaggttaagaaaatccactcacacaaaagctcttcgtagcctgcaggcagtatgcacatggtggatggtaccatgcttctttttgtccaggagatggctttgtaagttaagttcagaaatttgcaaggggtgcttggagctatttgatagataccagtccctctgctcactcccaagtacttcgtgatattctatgggccaaaacaccagccgtgcccagctccacccatcttaggtgatgaggaagagtagtttccacaagctcatgagttcaggccaattgtggtgaggagtaggagaggaggctgtgcatacaaagaccagagatttgagcagcgccttagtcagttcaggctgctgtaacaaaatactgtaaactggggtatttcctggggacttataaaccacagaaatgtatttcttatggttctggaggttgggaagtccaagatcaaggtgctggcagacttggtgtctggtgagggctcattcgtggatggctgtatttttggtgtgtcctcacatggtggaaggggtgagctagctctcctgggtctctggtataacagtcctaatttcatacatgaggccttctgccctcatgacctaatcacctcccaaaggccccacctcctaataccttgggggttaggatttcaacataggaatttgggggagggaatcacaaacattcggaccataacaagcagtgatcttaactttccacagatctgctgtgctatgtttcattccatgaactggcaggacaggtgttcttatttctaactagaatccagagacactcaatgtgttgcctgaggatctgcaattagttcatggcaaagtgacccagataccttgattcatggtccagtatattcttttaactagttcccaggactgtttacagaaaactgtagacccatccaccctcacacttgccttgagtttgctctccccacctgcccacccctgactcagtctgggaggtggtgggggggtccgagcatgtatgagacccaatgctggcacagagtatgtgctccgtaaacacttcctttcccctttcccctgtaaacccaagcaccctggtctctgttcttcagatgccgcttactggtatactccttcctggcattgtaggatctggatgtggaggtctccttcccccaggtgtataggaggcccttcctttgtgttccctgcagtcctcaacatgaagctgggcccatggagcccaatccccacaggctgatggcattgagcaccctggcctcactctgtttctcctctgttcctgagcctcccacccaggaaacacacccactgctgactccatgtcccagtaccccagccacacatggcttctctgtgggcggcttcaggcaaagcttctgtctctcctcacccgctctgcacttcctgccctgcaggcagagggagctcccttcattgacgggtggccatgggcagggtgatatgtttgagaagcagtgaatcctgtagctgaaaggaaccatggggccacttaggtcagtagttcccaggccctggtgcttttcagaagtggggaccttgttagaagtcaagatccccaggtcctccccaggatcttctgacctagcaggtctggagtgggggccaggaggctgcatttttaaccagtaccccaaaatatctgtaggtagttgtaggagaaccgaagtttgggatccactcatatactccaacgtcttcattatgtggatgagaaaaatcagactcacagaggctgtgtcacctacccaaggtcacccagcttgataatgatgaaactaaaattagaacccaagattcctggcttccaagatgatgctcttactgccacagcttgctccttgcccttgctatgtttccagagggagaaaaaacataagaggcaatatggaatccagtaatccaaatgtgctctgtgctgagaggtcggtagaacatgatagttaagacgccagcctggtaccaggcagaccttggttccaaccctgtaaaatgagaataatgatgatacccacctcccagggttgttgtgagatcatctacataaaacattaaacacaggacctggcatgcagcaagaactaggggtcaagggtttggcctgtatgagagggattcaggcccagttacttcattcccctgatgttatggcaatggaggagtcccccaagcaggtggaggtacagctgccattgcattgctctgcagtaaagagtcttcaatgtagggacctcctgggcactgtgagccctggtgttccaaaccccaagattcccattccctcacctaccacaaaattcatattcatctgggagaaccaactcaaggctcagcccaaccctgccaaggtcaccagaggataaggccgtgaatcacttttcccacaacttcccttttaagggcaggtccccagcttttattgtactctgttttatatcattataattgtgctgatcagcaaggagaacagacccatttttacaagggaaaggagacacccacaaaaaaaagccaaaattatgacagtttaaagcttgcagcaaacactttttaaattagatctgccttcagtatgggtgtcagacagtttcagagcagagcctgatttggaggagaggcgagttagcccttttagggggcatgtggtcggcaaagaggccaggagcagttattgggaatgaaagtcacttacttacaagaaaggaagtggatggagggtgacgttcttcgcattgctggtgccctggtgctcaccatgatgccaggtgggctttcaatgcctggagaggggagatgaccatcctgatcatcagcctcaaagacctacctctgactgacctggggaaagggacttgattttctggggttcagcttctttttctctgggagtctgaccctctcctcccacctgccccactctcttgctaccttggggattagtggccggggctaagggagttggagcaaggccaggcctgggagacacaggtgcaagtccagataatggtgcaatcatctgttctggatgatggatcagaaaaggcataagtgcaatcttctttttaaaaaatggagtgtgtaaataagcatcattaccacattactgatagtatttggttctgtggccttgagcaggtccttccccctctttgtgctatactgtcttcatctgaacaactaaagccctggaccagatgaacttccatatcccttccagctagaatgcttgctgtgcaccacaaagcctgttagtcttctgctgccttccaggtgaaccaccaggaaggaattggagactgaagagggcaaacaaagcagacactgaggctgtgatgaggggaagtcttcctttagagactaaccctgtgccacttaggcagcgacagtccccttccacagcaacccatgccagaggagcctcgctgctggaatgaggttcctgttccacgcgtttgacgtgtgtgctgatgactctgcaccatatggtaagggtgtccaggctgctgctggtgggtattttatttccttgcctgttggttttaaggaggctgtatagatgctgccctgtgcccatctcagcacaggaagcagagctgagcagcagagatgaaaggcatacagaggccaaggaggcatccatcctggtgtagctgatgtgcttggggccacaggtggtcctactcaggggcagtccctcttgtggggccgcagacctggagcagtcttagcctgggtaagcccaggtgcaggagagaggagggaggtttggctaagacaatagaagccctgcagtgccctggacccatgcctgctttgataaatagcccttctctgcctccattcatctatccacccatccattcatccacccattcactcacgcattcattcattcatccattcacccacccatttatccatgtacttctttgctttcttctcactcatgaatgtgaggatacctcatggcatcaagtgctgttggtcatcaaaaggaccttggaggagatgtgctctaactctctgaggctcagtccctccattgcctacagacagcccttccttcttgggaaactccaagtctggaagttctttcttgagacaagatcggcctccgtctcgttcccactgcttagtcctgccgacttccttctcctttccagagccacatggaccaagcctgatcatttcaagggacagccgttgagcccagtgtttctccaagtgtggaatgggcccttcgcatggctggggagacaatttggggcagtacatggacattttaaatagttatttttactgttacccttatcatagcaagcaataatagtggtgatttttaaaaaaagttccctttccagatttttatgtaagaaaaaagtgagttgatttaatgaaaaaatgaggaaaaacgctatgcatacatggacatggcaagggctccaatggtcccgggggatgctgcactggggagtctcacctgcgctcccttcctgcacccgctccctctgttcccctcacttcacactgttctttgattgtggatatcacataactatctgtataggttgtttgtcaagcccacctgtcaggcctgaccccccgtctgtaatccccacatacatctccacggggaggccatcacatctcttcatcatgtcatatctgaagtgagcttctcagacaccctggaattctagaaccactaggggttggggaaagggacatttcttaagtatttcctatttaatgtgttcagttcacatcttccctttagtcctaaaagagtctctgcaacaagatattctctccattttacaaccaaagaaatggagacacaggaaggttaaaccatctgtccaagctgcaatagttgtggaagagctaaaattctaaacttgatttgtctccttccagcgccgtggacgtcccactacactgggatgccttctagctgcatgcacgaaggggagtggggattatccagccaaattcacttttgtggataaagaaactgcggtctggcaagtttgcatggcatgtccaagtcccctggggtcactggccagcccacactttggactctgttttctgtgagcctttcattcttccagccgttctgaatgaagtctgaaggccacgtttgatagtccccgtcaggccgtaacattttctcactctgtcttttctcttcctcttctccctctctttgattcagactgtcattacctccttcctggaccacggcagaggtctccccacttcagtctagttcatctaaagattgcttttcatatttatttcctaaaacatagcttggcacatatcaccctttgatcgtgaaccgtcgtcagcccaagtcaacgtggatgttaggtcccagatacaacatcctgggtagggagtgtagactcttcctgcgatcctggaggctggctggagtttagacctcacctgcctgggcagaggctttcccccaccgtgcagacactccagcaaacaggggctgctgcttgtttcccctgaggatcttgtgtttctcatgtggaggtcaccgaccttgaccaggaccccattgtgcagctcctcccctgccaccttcaggcctcgctgccaccacacatcctgaccaccagccccagcaatcgccttttctccaaatccttaaactgccgattaccagcagggctcatgtggcaggttgcacacacaatctgtgttgtaatttgtccatggcatgtgtccttcctgcccacttgcctggactgtgcaccccaaaggcaggggaagcatctcctgccctttgtaactgcagtcctttgtcccagtgctctcagggtgggccctcggcacaggccgtccgtgttgaggatactaaggtgtcctggtgggtgctgctcatttgaattcacatggtccgggcagggggaagggttgcccgggaagaagggtggcctctgcagcacccctggagttgcaccccgagtgctgggagacaggcagcctgagaggtgaaagcatgttgtcaaccatgacatgctgcaggcactggagggaggccgtggctgggacatcgaccttgatggcattcagtgcccttcaacttctactctggaggactctgtgagcctctagtgcccggcactatacaatgcactgtggatagcacaggaaaatctgccctcagagtgctcctgctcctgaagcaggagcgaggtcttgcacgcttgctgaatgggacagcctggaaagcaggccgtcgtgccatgtaccaacatcccaaacgagcagtggacagactggccaggaggctgcagaaccacaggaaaaggagaccgagaggctgggcaagccaaagcaccctcccaggggaggagaagtccagctggcctggctgtgagagcttcccaggcaaggggctgcaggggcagtgatggagatgggtggtcagggaggcaacttctccaccggagcagtgagagttgggagaagacaagatatggaggtggggaaggaaggatttaagcagagaagctgggtcctgatgaactactaattgggaatccttataagttcttgagttagggaagtggcatgttcaaagtgagactctggaaagttccttgtcagaaattcactgctcagaaattccttcatcccttgaaggtaggaagaagccaccactaggcggggaaatattgggtctgcatccctgtgtcctccagctgtagatctgaggctgttgaaggggcctcttctccgcctcctcaccccggcctctctaagagctgtaacgttactgcctccctcccacagcctcatcctctgctccatagctctgtgctgtaacaagaggctaagcacagaattacatgggctacccttggctgggggtttgggctgatggctgtagatctagtctgagaccataatttgaactaagcatctcccacacaggctgggagctaacagggaggcagagcagcatttgtcttccagtgtctgcacgctactgccttttccacccaggcaggactaagttgagctttaatatgcccaaatggctgataaggggtggaagcactgggcaccgttgcagagacatcagatgagcccatcaatagagctgctttcagaagcaagtactagaaaactcaactcggaatgactttcacaataaggaaattttatctcacatacaggaagccccaaattaaggtggcactgaagttggttcaactgcttcccccaggacctcagtttttcccaccttttctctttgcccaccctcagcatgttgctcttgtcatcaattagctgtcctcatggtccccagatggctgccacagttccagacttcacatatagacatggatgtttcccattcaacgagagatcatagtgcttttgtgctggtatgcctctctgtctttctgaatcaatgagaaaatttcccttcatgccacactggcagggttgggtctcaggccacttctgaagctaatggatggagaagagaaaaggaataaagtcagctttagctgggttacaccagtggtgggttcatagccagtggtgctcctcataaggtggtgaccaggtctgacaggcagtgggaagaaagtgtgtggtaggggaagagtggggaggcctgtgcagcagccagcacatgactcaaaaatcaggcattcagtgtagccccaacaaagccccaacacacttcccattctgacaattgtgccaggtaaagggggttctgaggtggctgggaggtgagctgatggagtccagctttccctctaatcacaaacaatgggaaaaaaacattaaactcaacattctggctctaccacctactagcagtaaggctttgtggaagattatctaagccctctgatctgtttgctcatctctatattggagatagtttttacccatcatgcagagttactgttaggattagaacagaaatgtccaggctccgactgttgctaatggcagctatggtggaggtgatgatggtggagataggggaggtggaaatggtggtaatggtgatgatgggggaggtggtgttggtggtggcaatgatggtaatggtagaggtagtttggatggtggtaatggggatggtggtaatggtgatagtggagatggtagaggtggtgatggtggtggtggggatggtgatgatggtggtggtggtaatggtggtggtaatgatggtggtgatgatggtggtgatggtggtggtaatggtggtggcggtggtgatgatggtgatagtagaggtagtagagatggtagtggtggtggcagtggagtggtggtggtggtgatggttgggatggtggtgataatgatggtgatgatggtggtggtggtggtaatggtagcggtatgatggtagtggtggtgagggtggtggtggtaatgatggtggtgatgatggtagtgatggtggtaatggtggtggcagtggtgatgatagtgatagtagaggtagtagtagggatggtggtaatggtgatagtggggatggtagtggtggtggtggtggggatggtgggataatgacggcgatggtgatggtggtggtggtggtggttgtgatggtggggatggtgatgataatgatggtgatggtggtggtggtaatgatagtggtaatgatggtggtggtggtggtggtggttgtggtgatggtggggatggtgatgataatgatgatggtggtggtaatgatggtggtggtggtgatggtggtcatggtagtcatggtggtggtggtgatggcggaaggaggtgatgttggaggtggacatggcaggcagatggggattgagaagtccagagcagggtggccactgagctgcatcgtggaggagtaggagttcttggaagtggagaaagtggcagggatgggaagggcatgaagaagaaagctgccggaaacagcctgcctggtttgggtgtggtgagcctttggtgtggctggagcacagaatgtggctggggaacggggagggtcagactgtgacagaccttgaaccatgctaaggaggctagatcccatttaagggcagaagggagccattgaaggctttcgagcagtaaaactccctaggtgtcaatgagcctggttaggaagctcttttaatatccaaacaacccatgatgggggcctgagtggggagaggccatggggtgaggcagaaagacaggatcctgttccctgggccaggtgttggtctaactcctgaaagaaggtgggcagttagtagagagttttaaggccactgctgcactttttccccatttgggaaattacatgctagcccacaggtcactaagcaaatgcccattgtccccaggagtaattcagccctgattggtaatatctgtcaccctctccactccattgcccccaaagaagaggtaatcaccatgagcacagtgagctccttggagagtttggggctgtggccacgctctgacacacagctgcccaatgacagaacaagtagccttatgaggacctgacagccctgggatagaggaggtcagtggagaaggggcttctgccctgggcaggtggctggcctgggtggcatttgggcttcctctcaactccaagagggtgacacaggcagcattgtggcaaaggttgatcatgccctctgtactgttcaaacgctggacaccaggcaaatcaaatgccccatgcctgccctgtaggttgcagttggaaaaacgtgggccataaggaggccactggggtgtgcaaatctaccgcattggcttctcatccccagacctgcctgtgagaggtcagcacaggcacatgtcttggctggggcagtggaagtgaagagcccaagaggcgtgcacagggctagtgtcagacaacgaggcagctttcagcaccctggatctgagcacccacacccacgtgctggggcagggaggcaagtcaggcccacacccatgtgctggggcagggaggaaagcatactcgcaagaaactgataggcaactaagccatttcaacttaacatcctgggcaactacagagaaagagataagtttgagaagggtttttttttttttaattgagctactgtaaaagcaatgaaactagcatactttttaattcacccagcctcaattgctgcttgccctcaataaataggtgcattgttctcttcaaggctgctttgctgttaggctattagtggttttccctgtccttctgctttacaagaatgtcctgagtgtaagcccagaccgttcggagcagcaggcaccttctagcagaggctgctgcagaagacccccggcaggacctgccctcaggattgtgaaatcacagcattgccccacctccctgcccagcccttcttcccagtctaggctcaccctgcgcatctgtccgctggcccactacaaaaggctgtgctgtcaaacatttaagatccaaaagaatgcttctttttttattgtggtaaaatatatataacacaatttaccattctaaccatttttaagtgtgaaattcagtggcattaatcacacccacaatgttgtgcaaccatcaccaccatttccgaagtttttcatctccacaaacaggaactctgtacctgttaagcagtaattcccattgctccttcccccagcccctcgtaacccgtaatctactgtgtgtctctgtgaatttgcctactctagatctttcatgtaagtgggatcatacggtatttgtcctactgtgtctggcttcttttgcttagcacagtgttttcacggctcgtccatgctgtagcatgtgtgggaatgtgtaggcaccacattttgtttatccatttctgtcagtggaaggaaggcttcttcatggctgaatctcaggcataggtggagatcccaggaggaggaggccttcagtgtgggaggcctgctgcccacccctccagccatacctggcaagcaggcttttacctgcccagcagctcctgttgggcacagtaacccaggggtttcagacagtccatggatagagacggccgtgcttcagcagaaggaatgtcagaccagccatggagaaactctcatgcccctcacataggcaagacatgtgtccttgaatcagccccctcacctccatatcccaaggagtttgggatgggtgtcctggtttttctcccagcctcttacattctccaactcatcgatgcgctgagagggcaatgcggcaagtggagcaaagtgctgcaactctcaggaagtatttgtggcgtgctggatgaatacatgggagaagaatgaggtagtgagagctaagaggttgtgcatccttcatctctcagacagagaataggcaggaaatgcatgtagaggtcgggctgatgagtattcaagttctgaaacaacctgagatacagcgtgctgcttgaggtgttattattgtgttgattgtcttttgcaccttgtactgagatggaattgcataactgggcttctcatcaattctgtttggtggagaattcttgctggcttccataagtacatttacataaatctaggtgggcacacacaagctgtcttggtatgagttctcacaccctgggtctgtcacctagtggatgtagccacacagtgttcagcacaggtgggtgagcatcccccagctctactgtgcacatgggagtagacacttcagtcagtctctccagactgtcctggtcccaagagatctaccctggcatggcttctgctcacaaggagtctgtgttcctctaaagcacaaatattaataatctcattaatggagggtgttttgttataaagtctctttgtattcatggtgatcctcagaacaacaaggagaggaagtgaagaagaggagctctttattccgtcccatgtcctaaaatctcactgtgcctttggcagaaatgcacacaaaccagggcctggcggtctccctcgccatagcatcttggagggactttggaagttagctaccgctttggaagtggtattcaaagttccaagaaaaacgaaaaaaacactgatccctcttttcaaatcttatgcagaacctggcacataaagccagtaaaattcttccggactggtcagtaataggtagctgctgctgctttttgtgtgtattctctgtccacactctgtcatattggctccctggaccctcttcaactgtgttaggacccttcgacactcagcatgtgggattatggcattgctctggttcaagaggggatggggagtcaaagcctccttacttagccttcctcttgcctgcacctgtcccgaagccctctgtggaggcctagagctctttgcagcactgtaattttcttacgtccttttgcacatgagaaaatagacccagagaagtagagtgacttgtccaaggatgtgcagccagttggtgccagaatcaaaattattaccatcattcaaagacttctcatcagtaaagactcatcattattattctcattcttgagtctttgtcctcaagaagcttataatgtagttgaaaagagtggtaatatatacgtgagaagataaattggaaaactaggatagcctgtacacatcagtgtctaattagctccacaagtgtttagaagccatcatgattcctggaactggggctctctctccactgacctcttctaaatatttcagacatgagtgtggccatggaccccccagttgccagtaggagatctaagaaatgaacagggagagaaggaagaaagggagaagaagatggaaataggaagcaataaaggaaaaatggaattgaagagaaagtggtagaaaggaagaagacaggagctatctgtgggcaaggtcatcagcctgcctcaaggctggcagggatccacccactgtcagaggagcagggtcctccaggagcaccggggaatcccttccagcctgtattgggccgttgttgcagtgctataaagaactgcctgagactgggtaatgtataagaaaagaggtttaattggctcatggttctgtgggctgtacaggaagcatagtgccatctgcttctggggaggcctcaggaggcttccaatcatggcagaaggcaaagggggagcaggcacatcacatgatgagaacagagcaagagagagaatggagcagggaggtgccacacatttttaaatgatcagatcttacaggaatgcagagagctcacttatctccaaggggatgggctaagcctttcatgagggatccatcctcatcacccaaacacctccaaccctagggattacaattgaacatgagatctaggtgaagttatgctcaaacgatattctgctcttgccttctcccaaatctcatgtcctcatgttgcaaaatacaatcatcccttctccatggtccccccaaagtcttaagtcattcagcattaactcaaaagtccaaagactcatctgaagtagcagggctggagggcccggtaggagcaagatggaaggcaaatcccttccacctatgggcctgtaaaatcaaaagcaagttagttacttacaagatacaatgggaatataggcattgggtaaactttcctgttccaaaagggagaaattggtcaaaagaaaggggtcacagtccccaggcaagttcaaaacccagtagggcagtcattaaagagccagaatgatctgctatgattccgtgtcccacatccagggcacactggtgtgaggggtgggctcccaaggccttgggtatggcccatttgcagctttgaaagtctgggtgtttccatgctattggtctggggttcattctctcttctgcagttgttcgtacctcctctacactatccaaccttaacactgaacagtaggaatgggagtcttcatctgttccacttggcttccaaagcttcccgtttcccaagatcaccaaaagggccagtttgcatgctgaatatttggtgccttctcaatgagctctgtgaccacccaggatttaggagggcacacaggcctctggcttcagagttcaggcatgaagagggccacggaactgtatattcaaggaaccagaggcacgtggggcatctatgagaacagtctttgaccaactttttcttttcttcactccattcatactcgcccttagatgtttctatgacagcacaacgtatgttttgaaggaattaaccaagctgtcttgcttgtttttgttttttgttgttttttttaaagtaattctagaagggcagtcatgcctctaaggtcagagtgaataacactgcttcttgcaacatttagtcagcacacgcacacacacagtgcacacaaatgctacacagtgaccgtgtcccagacgtttcaacaataggcagctgtctttctctggattcctgttcagacccgctcttactggctctctgggcccttccagttctatctcagacccttaaacaatcaggcatgaggattgtgaaaccagccatgtctctggggataagtggtaccagtgaactgcgtttctccagtaccccggcaggtgagatgtgatgaacagacctttggcttgaaggtcagaaagtctggtttcctgtcctctgtgcatttctccctggcttgagtatcttgtcagaatcctaatttttcaggtgaggaggttaattagataacctttaagtttctttctctcccagacttcatgattttaagagaggtcctgtaacttctgctggagataaattcgcataatgtgaagggactttcttggggatgaggtttctgatgggatgcacatgctaatgggggtttgtagtggctgttccgtactgatttggagcccagcctctgcccttttctctttagtctgcacactctcctcgttcagccgtctcctgcaagatgaactctgctctgggccccacctctgtaggtctgatccccaatatctccacttcagcaagttcataactgatgtctctaccttcctccaaaacccctcttcctcttcttgaagtcccctgctgcagtgagaggcatcaccatccacacagtcacccaaattagaaacctcagggagggggcattgcacatctctgcactgcctcttccctcaacccctacgtacaaccagaaaacaaagcacatgctttctcctctcaaatccacctacatctcaccaatcccactatctctactttggctcccgcctccatgatctctgcatgggtcactcccctgcccttaaccctatcactcattctccagccagtgccagattgcagggcgtatctcaccaggtcattcccattctcctcagaatggaatccaagcatccaggcatagccacaaagttcctggtcatcttgctcctgccgggccctccagccctgctacttcaacaccctcactccagccaaatcaaatgtttgcatagcagagctgtccatacttcccatcttcttagttcactctccacctgcaatgcctgaccccctccacattccctactccctacccccagcacctaaccttcttcacctggacaactcttcatccttcgagattcagcttgaagattcttactttgggaagtccatccatagccagctgtgcttgcctccggaatgccatgccatgtcctaattgtattggaatcatctgtccatttgccctgcattgtaccagtacatccttgaggtctgtttctgagactttttcctcaagtctccagcacccaacacttacataaacatgtttgtgaatgcttgagttaatgttggattgaatgatcactgtcaggtgggacaggtccctctgggtctccacatgttctatgccaggatgcaggacaaatgttacatggcatggatcgcaggataggctttttttgggaaaatttgccaaggccaaaggtcaacaagagaagtcacatcccccaacccttccatctcaaaaagagatatgccaggtccaggatgctgctggccctgcagtaaacctgtacccaagtggagggccctcaccacaccccgcgacccatggctctctctttttatagggcaattaagcaagagaaagcagcctgtcaatgaggaaataagcagactgcttggtaccaggcagtctggactaggggtgccagctgcttataggagttgtctgggaatgccagtttcccagcatatagggccctcagagccttcaggatattgctgctctctctgccagagggaggagtggttctgtgcttgagtgctacctcttctggagggctcattatctagacaacccagagggagatacagggtcactttttgacaatgcaactagttgtgccacactgatcatgaatgactaaggggacagatgggtggatggatgggtgggtaagtgggtggatggtgggtgagtggatgagtagatggatgatcagatagaagaatgagtgagtgggtgaacgaatgaatgggtagatggatagatggatggataaatgtataggtaggtaggtggatggatggatggatggatatatgtaggtgggtgggtggatggatggatggatggatggatggatggatgggtaggtgggtggatagatggatagctgaataaatggataggtgggtggatggatggatgggtgagtgggtggatgtatagatgggtggttggatggtgggtgggtatatatatgtatgtatgtgtgtgggtgggtggatggatggatggatggatgggtggatggataggtgggtgggtggatggatgagtgggtggttggatggatagaagaatgggtgagtgggtgggtgggtgggtggactgacggatgggtgcgtcagtgggtggatggatggatggatggacaggtaggtgaatgggtagatgaatggatgagtgggtggtgcataggtgggtgaatggatggatggatgaatgggtgggtggctggctggataggtggtgagtgggtgggtaggtggatagatgaatggatgggtgatgggtagaaagatagatgaatggatgggtgaatgggtggatagatggattgatgggtggatggacaggtgggtgaatggatggatgaatggatgagtagtgagtgggtgggtgggtgaatggatgaatggatgggtgagtgcatgaaaagatggatgaatagatgggtgaatgggtacatggatggatgaatggatgaattggtgggtgggtggatggatggatgggtgggcaggtgatggtgaatggaagtgtgaaagcaactagcacatatgaaagcacctgacacctaatggatacccaacttgtgtgtttccctttcctgtgctttctttcccatctcagcttcacctttctgggaatatagaaagaggtgaccctgtcatctagtggcagacatgaaagctctgaaccatcatgggttggggataaggagatgggctaaggggctgtgtgacagctccactattcccactcccacaaacatcctcaggttcccctgtgctgtgttgtctcatgttttcttcttcaacattgccctgatgtacattttaacccaacatcacctgactttaaaagattggagcttcccacgtcctgtgatttgtttgtggttcacaaccccaaggcagctgcctccctaaaccaattttatggcacaaaaatgggcaggaagggaaggacgaatctgcctctgagatgctgatgaaatctgacccctgcactcctttcccacgccgcggcgtgatctgggccttcatccacacgtgagctggtggttcttccgggtacctcagaaacacctggaaattgtctacgatgcacatttccaagcttcatagccagatgatctgtttcagtaggtctgggtagggcccagaattctacagtttttaattttgcatcctcaaactgcttcacagtgaggctggcactccctacatgcccaggggattgtgatggaatgaatgggagcccagggtactgatatggcctgatggctccctgcagagcttcccatctggccctgctcccgatggccctgccttggaggaaccttccagctggctaggcaggaggaggtgggcctttgtgggcaacatccctcctccagaatgtgggtgagcctggaacaccccctcaccactgctcccacatgcacacaccagagctccctctgactcgcagaggaggggaaaatgggtctaggggttctgagccgagtgcccacttggggctgtggacaggcccgccgcactctggagggcctatgcccgaatgcaatgtggatgggtgtttcgtggctccagtgagggatggctgaggcttctgcagaggcgagcagtggagcatgaaggcatccaggcagcctttgcctggtgggggccattaaggctctgcacttgggatgggggtgtgggagaaagcaattagtggcgagggacgtgcatgaatcagcacagagtcggctggctctaattgagccaacaagtttgtcctgttcgctctgggctcccagggatgggagctgcatccttaaatgcaaagcccttcttcaaggtggcaggggaggaagaagattgtcttctgccccttgaggaaagagaggggctctttccattctccactcccacccagtgcctgcctccatccgcaaagtgctgattttctctgctgaaatgttcgacgtctttggacagaaggttttattttctcaagaaagagatttcacatttctggatcggtgtatgtgagcaggttgcctctgtctgggctgctcttaagggatcttcaccgtctccatttctttgtggctgcatttttgctctgtcttttggaggaactcggctagtaccctccccaagaccaagtctgctgtcttcagggcttgttcctgcagaatcggagcgcggttttccaggagctgtgctttatccccttctcttttggccctgacattgtttccctttagatggagacactatgaattctcttctgggagagcacaataaaatgtcaactgattaactaaataaaatgtttcaaaaaatatgaaatttttccactagtctaatatttacatgttcatgggggaactttgatgcagaaaaaaaaaaatcctgtaatccccagtagcttggtgctgtcgcggtagagcaggtcgtggagttgctaatttggcctgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgcaacggctggaacctactagattttataattgtggttgtggggtaagtatcactgtctgtttctttccctttatcttaccagtgttgcgggacttttccttaagtcagctgaagacagggtcgttgtcagacggccacaaagatttaggctcgcagatgatctagagtgagaaaaatgagatttattttgctaaaaggaacagaaagggaaagagagactcagcaaagtgagagagtgcgcttcctgcccatgggcttcccgcctcgcaggttgaatccaaggttctacccaggaaaaggaggggtcaggcttctccctgctgcagttggtggcgtgaacttccgtggttccaccctagtgtgcactcctcccagtgcgcaggctggctggagtttctctggggacccctccccacctggctgtctcaccagtacatccctcttcttccttctgtgttatctcttttcaatttggtcctaactatgctgggcttcaggcaagaagaaaggatctgtgaaaatcactttgaattcagacttccccagagggacaggggctatgacccaagagcacccctctccaccactcccacacagcatgcacacacggttggacctgagtgctcctgatggaacccaggctgctctgtgctgctgtaggatatccccctgcttaaggactttcgtttcatctcagaccacatctggccccgcagttcctctgatagtttccctgctgtatcactgagcacatttggggcagctcgtccgtgagcatgcagtctgcaggtgtggggtgagggtggggcgcacacaggctgtgcctgtgctctggacttgtacagaggcctcttccccattctcactctacagggggcctggttctgtggccccagaaaaccagactgctcaagacaggtggatgagaaggaaacagggaactatgaaaggcgaagatgacaggtaaccaaaccccaatcaaatgcagcttcccccagacaccctgctccactgtagcataagataaggtagagtcagtctaggctttcaaaacagcaatgcaaagaatcttaaataaaatgtagaagagatctccttataaataagttattaacctcacaaaaagaatctccataaaatatttgtacctaacaggcctacctacactggtgaagtgtaagttattaaaatgcaggtgaggtcaggcgcggtggctcacacctgtaatcccagcactttgggaggccaaggcgggcggatcacgaggtcaggagatcgagaccatcctggctaacacggtgaaaccccgtctctactaaaaatacaaaaacttagccgggcgaggtggcgggcgcctgtagtcccagctactcgggaggctgaggcaggagaatggcgtgaacccgggaggcggagcttacagtgagccgagatcatgccactgcactccagcctgggcaacagagcgagactccatctcaaaaaaaaaaaaaaaaaaaaaaaaacgcaggtgatgaagttccatcaacacatctgtcttgtaataggagggagcccattgcagcagattttaccttgagaagaagccggttcctttgggctaatcccttgttactctgagcccagtgagtgctcaagtggctgccaccttggactctccctctcttgaagtcctggcagtctgcagagtcaaggtcagaatgtcaggagctctttatcccagaggcctatttttggaggatccttttgtgccatcccggaggagacacagccattgtggacgtctccagagcacccgccgttcaccatcttgtgagagtgcctggtctttactgcaggaaatgacgcaggaggacgtcgagatcatttgcaagttatttccttgtctctggccatctggatggctcataaggttgcttggaaccacgttagggtttttgttgttgttgttgttgccttattttgcctggccaatgaatgacgcactttggccacatgaacctcaggaatatttgggtgatacgaggtgcactaaggttattagcatcattagccaggtctagctctggctcatagcactcggggtgtgcatgcagctataggagagattttgctgcttctgctcatgccagaataaacaaagagtggctaaacgcatgccttgaatgactcagtaaaccatagcaaaagtccttaaggtgggttgttccaaatgcccctaaatcctttttagaatttggcatctttctcaaggcctcagtctcctgggagtcttttgcacatgcatagaaaagagccttgggaatgatgagagcagatgcttctgggaccagtggagggatgagggtgacttgcagggacgaattttgtttaggcaaaattttggaattttgaagtgagttggagttgattatatgtgctttgccccatatgtggtcttaatgaaatcatgagtcgggggagcagagacaagaaatacagggtgagtaggcaccgaacaggagccctgggagggaggggccctgcctgggttgacagggaggcagtgcagtggtgcatctctggcccacacctggtgcctcacctgcggtctgtctggacccgcttcatcccttagactcctccacacaaccacaaggggccaggctttttctggggtcagcccagattccagtcacatctccctagggcctaggccatgaggctggtgaagagagggaggcatccagttgtgtgctcctgtttctaagccacagaggttaagatgccagcagttgcccagctcgtggttggtcttgcactgggacatatttggcacctagtctctcttctcctaagggctcttcatcctgtctaaatcagcccattcttgtaacaatcccccatcgctgcagggtgcagcttaccacctctcttcagctcatctcctttttctgcttcctttgcaatattaaatgggtagccctttgcttccctgtgtctcttggaaaatatctgctatccttggcccctcttctgtagctgtaggggaaggtttctcctggcctcccacaaagctgggggagcctaactcaccctagagaaaggtggacctgcctgcctactgcctgagtgccaggctgagagcctcatctctgcattgctattctggtggcacaagacacgtggcatttctttccttcctaaagcagaggcctcttggtggtgggattgctgaataaacacagagggactgtggcggcctcagatccacgtgcccctaccgagggaccgtggaatcctcagtggatcctcaggaggttccacgccagccagtgaggctttgttgcatccctacctccctagcagggtggaggccctgcctttcccattctctgggcctcacgatcattccacagcctcacggtccttttcttctaaaagctccactgccggactacagatctgccagacacagctcccagagcagtccttcggccaggcgtccacaccagagcccaaccctcagggaccagtgggcaccaagcagtggttttgcctttagaatgtctcattgaggagaaatacaccagccactcctacacccatgtttgaattttctaccctttcagaattaaaagcggatacttaataaagagtctcaacttgaggcaggagttaaaggcaagttgtctaatctccactcccttcaccgaatagtattttgtgaacctcttttactccgatcagcatattactttcctgcaggaaatactgggaacaaaatctggtttgcatttggaatgttgtttgacaaatttgcaaactggtctccatttcctcaggtttcagtgatctaggcttcagtggaaagaacatttcccttgtggagaaagaagcccactcccccatcctggcaacttctgcctgggattcaaggcctcaccagctaacataggaagccatcaagttgccaggctgagagacactgcagatacggcctggacagggttctcaaacttcgttcggctgcagaacccactgttgagagtctcgctcagaggtccaagacacagaccagatagaagggaagctcctctggactagaggagccagaacgccagtcacgcagccagtctgtgcctgggggcctccatggagcgtttctagaccaatcccctcatcgctcagccctgcctggccctgaacttctgctaatgcatctggctaatcccccagctgcagcttcccatttctagatccagatacctggggcataagtcacttaagagctcaagcctattgctcctgaatgaaagctgtcctggttcatagtttagatctgatatggagacccactcctaatacctgggctccctccttgatcccacgcccctctgttgaagaaacacgacccagcgtgtagtgcactctgtggcaatgaatctgtagcatcctctctgggtataaaggacagaaatcaccctgcacgcccttttccctatttttcttggttgccacgaaaagcccaaaattattgagtcatccctcatcacccggactcctgttcccatggggctttgtgcatcctctgatctaatccctcctttctcaccaccccgctgcagaaaccttcccactgtgccctcccatccccatagtccctcgcctgttcagggtcagccaacttttctgtaagggccggatgctggttttcatctttgcaagccatgcagtctctgttccagctactccaccctgcccagcagcaggacaagagtggcatctccatgagtgggtgtaactgaattccaacaaaactttgcaaaacaggtggcccagttctcagcttcctttctggtcacttcctgattctccctgagggtgcagctttctctgctgtctctcagcaggcagccacttcctctcccagaagcctccttccactgcaccaggttgccaggtctaagggggccctgccagctcctgatttctgctccactgcacccccacctccctggagccctccagttttgacatttgtgtcatcagatcctctatgccttacttctctttactgcagccttctgcagacctttgagtcacccctccttgtgccttgaggacaagggctcttggttcgctctacttcactccgacactcacttctccaccttcctgcagtagcttcttggttcttggatatctggcttctggggaacctatctcagtagtcccaatcccatggctatagccaatatccctgtcaccactgattaacacctcccccataatcccaaatctaacatcctaccctctaaccagcaccaccgtctttccggtcccctccctctctcaccctgactcccacgatcccttcgtcccaccgcactcttcatccctgccaccatgtccaccctccttccagccagctcagacgccatgtgccactgctgccctcactcacttgcatttatgctcagcattcttagtcttctgtctgtttatcttgcacacctggaaaaacaccaaccctaatcaagtccaaccagagatctgcttggtacctggaaagggtcaagaaatctgcaaagttgagcagactctcactttacactcatgacctccaacctcaaggaggccctcggtgacacctgagggccctcctgctttgtccgcactccattcacccttctgctttctgagctaattctttcagcacccgtgcctctctcgtcacacttcccgtctccttcccctttcacgttttcagctgatggcctcgttccccagttcccttagaaagatgcaatcagaagaaactttcatgtattcccacaaccacgcgtctatgctgacaatgcgccttctcactgaaccacgacccacggcgctgcccctgcacaggtggacgcccttcgcatgcacccatccccttcttgccagtgaaggagctccgtcccacacggccctgcccctgcacgggtggcaccctttctgtgcacccatccccttcttgccagtgaaggagctccgtccttccagcaatggttccctctcgcttctatgtcatcacattttctgcctctgttagatgattcccatcacatagaaaactgctgtcatatctcccattcagaaacaaaaccctcttgactccacgcccacttctagtaaccccctttttttctctgctcatttagagcaaaatttcccaaaagacttgtctatacggtagccacacgtggccattcagcacttgaaatgtggctaatctgcattgcaataataataattataagtataaaacatacagcatatttcaaagatttagtacaaaacaaggaatgacaaatgtctcatgaatgattttttatatttattacatgttgagatgataatattttggctatgtcgggtgaaataaaatctatgatcactgttaatttcacctgtttttactttttaatgtggctcctagcaaaggtaaattacacatgcagcccacacttgtggcttgcatcagatttctgttggccagggctgtctatcctcacggcctcccactcctcccatgctctcttgaacctatgtctgctgggtgtttgtccacatcactccaccaacacagatgccttcaaggtctggatggtcttggtgttgctaaacccagcggtcggtgtccagccatgtctctgcagcacgtgacaccaccgcctgttcactgaccgctctcttcatggggcgccgttctctccatgtccctgctctgcaagccatccctcatcagtctgttttgttgctttctcctctcttgacccctcaatgtgggagcactgcagggttgagtgctttcacatcctcaccttctgcactggcctcctaggtagtcacatacaatttgactttaaatatgaactatacaactgctgcgcttttgtctccagcttggacctccccactgacctccagacacagtagaaccaactcaagacatgcattcgatgtccaagcaacaactcaaacttcaagaagttctcagcagaacgcttaatgtccattccgccatatctcatcattcctgttgctcatgcccaaactgttggaatcttctctgattcccctctctttctcacacctcacatctagtccatcagccagtcccactaactttatcttaaggtaaatctggtatctaacttttcctcactacctctaacaccaccacttgttctgagccacccagtgtctcgcgcctggatgactgccgcagctggtctctggcctcgcccccgacaggggagtctcccacaacagcagaatgattcttttagacctgtagttagatcatgtcactctcctgctcaaagtcccccaatggcttctgtctcagagaggataccagcacccggtggggttccctatttcctctccgacttcctctcccacagttctcccctttccctgccctgctccagccacactggtcgctgctgttcctctaacgcacaccctgcccctcccttgggcccctggcttacctgcttcctctgcctggaacagtctccagatagtgaagtgggtcccgccctcacttcccataggcctctgctcaagtgtcacctgcagggagttctttgtgcagatttctcaggtgggaaggaaggcggccctcaccctgtctctgcagagcccctccccgctcctcctcctcagcactcatcactctaagctgcagtgtctgtttactgattgctcagtttattgtctgtctccctgctagaatgcaagttccatgaggggaagggctttgtccattttgctatagccccagtgtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattcatttgcgcagcacgcacctcctgagcagccaccaaggccagcacaaaggagatttccatgggccaggaacaagtcaaagagggggggtatctagaaggaaggaggtggggaaacagagcacatggttgctggcacacctgggaggggcgctaggataccatggagaagccggagggctcctcaaggagataaggactggcaacagacttcacctgcttcccacgtttgtccagcgcttgtccagctcctgcctttatgacggcagagggcctgcccctcagctcgctcaggcctccctgggccatggtggcaccctgggcatggccaccacccacactgaggggatgtcagcttacaaccacccacagactccacgcacacccacaacgcccgcccctgggctggagacgcctgcgcaatctgcttttccgggctgtatccagaggtcagagccccagctgggcaaaagaaaacccagtcctgacagtccttctctctttcctctcttctaggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtaagtgaagcccgttcttgtgtacagtgttatctcctcaccaccttctgctgtcctttgctgaattgccaagaacactctgcaaagggacctgattccatataaatggaggggtttttgtttttgttttaaaatgagttcctttgatctgaagagcccaactcggatgtaagtgccttaaaacacactgtggtcccagcgcctggaaactcctggagaaagttcacagcagtcactcagccacatgaatcctacataaaggaagtggccatctgagccaccctggaggccctgggatggggatttaaatacattttgtagcagaagagccaggtggctaatctccgaggctccagagcactttagccaatgagattatctctactttctgtgtttttccaaagaacaatcaggaaagcatcagtggatgttctaaaagttctgttttgacctttctcccagccctctcctcccttcctgtcaaatggggcagcccaggcctcaggagccctactggaaataccacgcctgtcattgtgagaacttatttttcccaaagagaggaggatattccgctctctgaatcaggggaagggtttggagaggtattgcctatccggatgtcagtcacatggacaatgcctcttctgccacttctccagaagcctggcccattatgggtgcaccccaggtactgaacacagtggcttcaggccccctgggaaggcgcaagcaaaccccagcccaaggtgctcctgggagctcagtccactttagaactcctttctactcttccctcttcagtttgtggtatctgagaacaattctggactcatttgcttaaattttgctttcagttcagctccagtagatttggcccatgactcaagacataggagacccctcagactaggctaggaccagatgagtttggagatggtgtaagggacaggaagacagaggacctccgaatgcacagcctctcctacccatggcatgcactgagcacttggttaccggtgtgctgctgggtggtatcatctggagtcatgaaaccgtggaaatgtgagggactttatattaaccagtttactttttgttcatgcacggaatagtgaaaagatcttcctgtgactttaattaactagcaatagagccaagactagaatcatgtctcctgatttctagaccagctctttcctgccatacagcactgcctcttttaaagaattaagtggtatatctctcttgattgtcttggattctttttctttcttttttttttttttttttttgagacagagtcacactctgtccccaggctggagtacagtggcacaatctcagctcactgcaacctccgcctcccaggttcaagcgattctcctgcctcagcctcctgagtacctgggactacaggtgcttgccaccatgcccagctaatttttgtttttttgtgtgtgtttttttttttttttttttgtatttttagtagagacggtgtttcaccatgttagctaggatggtttcaatctcctgacctcatgatctgcctgccttggcctcccaaagtgctgagattaccggcatgagccactgcgcccggccaattgtcttggatttttacacatatatcctgtctcttaaactacactataagccccttgaaacccagaactgtgccttctattgcctctgattcccacacaacataagcaaagggaacttactgaataagcaaaagaaagagtttgttttctttgcagtgggactccctgggcaaagcttgtggcctgtcttaggctcaaaaggcacgcagagctgagcacacaagcacaattaaagcagactttctctactcggccttaactgtctgggggtacttaggtatagaaactgcatatatcgtggccaggacccacttctttttgaagcctaaattatttgggttttcctggtcaatcagccagaactcaatagccaaaatcaggaagtaggaagggaggatgacagtgactttgaacatgactttaaggagcttgtaatggtaccgccagtgtgtcagtgatagcaactgggagttaattccagatgccagccaaccaagcgaaatggacacaatgaccccgacctgttatctatgtatttattaggggcctgcaatttttattaggggtattaggacgtatcataaagaacaagcatggtcctttcactagagaaatttgacagtctaagaaaagagtataacagtcagcttttgctgtggaaataaaccatctcaaactctgcatggcttacaaccagcaacatttacacctggctcatggcacctgagggtggtggtcagctgcagctcttctgcactcagctggactctgggcttgaccacattctgcgtgccatccaattctggagcccaggtcgaaggagccctcaccttcggtggtaggccttgtggttgtcatggctgggggaggtgctcacaaaatggggcttagagccaaaccgcactagcaacttaaggcttatgcttagatgtggcttctgtcttagctgttcacattccactggccaaagcgagtcacatggccaccctcaaagataatggggccaagaagtgtgctgtacctgcagagaagcatgggtgaacgattgagaacacatagcagcctaccacaaagagactgaggagatgattgttatcaacagctgtagctacagtaattgctctagtacagagattcttaattagagatgaatatggttgagagccactcatgctacagtgcattaaaaggaagaattagattagatcgggtcacttggtttccactacagaggaaatttcccgaggacggagccctgtctccatctgcacttaagtaaggtagacgtgtcttgtagtggtcaggaagcagtaacactcctaggaattctctcaagaggatgcaggcctcaaatgcaaggccctcatgttacctgccgtgcagtccaggaaaatattttcgccattagagatgatgacactgagatggatttgctgttgtgggtgccttgtaggtagctccatgcttatgcataggagcagcaacggtgtctggtttcctttgggtcaccagtaaaatggtggctcttcctcagctcatccagccttctgccctttcttgctggaatagtgtctgtgcagcttttgaaacagggaaccatgcagaccatggtggatcagtgcactgtaccagtgtggttggtgtcatctacaaagatgtcagcagtatctcccctgactacaaacctagacaaatgcctccgtcttctacttctcatagccataggttatctctttctgtatttcagcaaaactcctcaagagttgcctctacctgttgtctgtgattcttgtcctcccattctctcttgaatccactctgatggggctttcttccccactgctgcaccaaaacatctcctgtccagaccatcagtgatcaccgttaccgcacccagtgctctgtcctccagggccatgttacatgatctgttggcagctttggatacagctgatcgctccttgtctttgaaccaccgttgcccttggcccttggcacactgctctttcttagctctgcccttcattcacttgtttcttcttcttggaatcctttgctgacttctgtctcatcttctcaccctcttaacattgggaagctccaggggtagatcctgagacctctcctctgtctgtactcactccctagttatcacgtccagcctcctggtgttaaatataatctatgtatcttccagtaaccagcagctgtgtgtcaccagcccagaccttttttccaaacctcagacttgtatccctacctgccgactccgttcctctcctgtctgaatagataataagtatcttgcacttagcaagactcatggcagaactcacagtcttcccagagtctttctcagcttggtaaatgctagcctcatccttctagcttctcaggccttattggacttatttctttttctcactctttgattacaatccatcagaaaatcctatgagctttaccttccaaacatgtcaagaatttgtctcttaccacctgcacactcagctcagcgctggccgccctcgcctccgtcctggatgatggcgacagcctcctgcaggagtctctgcctcaacccctatcatggcccggacctaacacggcattcaaacggccctctgaacagccaagtcggatcatgttcctgccctgctcaggaccctccacggcttccctgacttgcccagagtgagcgccaaagtcccataggccctgcgatctcacgcctccttcctccctaagctcacccccttcaccctcccctcctctccctcctcaccagccctccacagtgactcccttgctattcctccaacattccaagctcaccccactgtggggtggtggccggcacttgctccttctgtctgaacgccctcggctcagctctctgcacaggcctgcgcacctccttggcccccacctcggctcagctctccatacaggcctgcacacttcctcggcaccccctcggctcagctctcatacaggcctgcgcacctcctcggcccgccccttggctcagctctctgcacaggcctgcgtacctcctcggcccccgctgatgccatcccctcactccccgttcatccacccttccctgctccatttccccacatcacctctcaccatctgccattctgtatgtgtatgtgttcatttgcttatcaccccttacctcatgagaatgtaacctacgtgaggctaacaatttttgttagttgtgttcacagctgtgtcctcagcaccgacaataaaggtgataaatatctgtagaatgagcaaacatggttacacggacgcccatggcggctggcatagcttcacatcacaggccctaagagccaccccacccactaaaatgatgtgagtggtgccagcttcctggacatgtgcctttgctggcttttccaaagggtctttacttcttctgtctcatttgatcttcatgacaattgggtgatattaagaaatgtacataggcaatatatagatatgtagggtttttcttacaacaaataggttcattgggccatttttgacatctgcaattctagaccaatagtgttagaggccccaaaagttgcattttttttttttttttttttgagacggagtcttgctctgtcgcccaggctggagtgcagtggtgtgatctcggctcactgtaagctccgcctcctgggttcacgccattctcctgcttcagcctcccgagtagctgggactataggcacccgccaccacgcccggctaatttttgtatttttagtagagacgggtttcaccggttagccaggatggtctcgatctcctgacctcgtgatctgcccgcctcagcctcccaaagtgctgggattacaggcgtgagccaccgcacccggcctaaaagttgcattttttaaatgcacatatatgtactaaatgtcattgaaatcttatgatcacaggttatggaaatagatgattgcgagggtacaagtccatgagtcatttatcaatttgttcaacaaaatcgactgagtacttactttatgtaagattttgttagccattatagcagatacagaagtgagtcagatgctaagtgtgttctagagagcttgaagtgtagtagaagaaaaaatattcataaaaatgattatataaataaaaattggagctgtcaaaaaggaaagtttaggtaagatgtgcaatgtgatgaattctgtgacaagccatgcattggggacaccatactttggggagtggtgatagagaatcaggagagccttcttggagaaggtagcatttgggatggaacttgaaggatgagtgaggagaggcattccaggaaatcacacaaaggaaggagagtggccgtggccctggagatgcacactgtgaggctgcaaggctaacggcttgattacactgcagaggtgaaaatcagattggctcttccaatggggttctgtgtagttgaaagatttggccatttggcttcatagagactcttctacagtaacagaatcagttctctctgctgtgagcatccactctcccactgcagccgtgctgtggagcatgcgtattacaccaaagactaagccatatggaggaatcaacgttatacagccagatgaaccatagggagagttgtggttaaatatttgcaatgtatatgcaaggagtacatttgcttgtgaagcagtaagcaaggggtcgtttcctgctttccatttcatctcatatgccttctggagaagaactttcaggagggacttgataaagggagaagtcaaatggagatgagaaagatgtgtagggtctttgacgaaaactcagagcaacctagacttgatctgatgatgaaaggaactgaaaaatcacctttctgtaagaccagcactagccttggaagacactcatcatgaatgtttattgagcactctctgtgagccaagcacaaagctaggtgcggggacagaggtagatagtgcactcccatcagtcaaatcagaacacctgtccagttttcataaggaccatccggttttagatctggacctcccagtccagacttgataagagaacatctttctagagcagatagtcaaaatcatgtaacttagtccctgaaactgacatattttggagttcagagaatatctccgaatcagagcagaggctcaagcccacactgcttcactctttatcctttgctttttccactgcctgtgtcctcatcgtcccagacttccctttaatcctggttaatgtgattttgatttagtcctaatggaatgctttaaggacttttcgtgggatacgtttttcctagtatgtgagtctttacaagattagatctttcaggatgtcccttttgtcagtaaaatgttatatctggaagcacacagaatagaaaacagctcgctattaaacggaagtttactttcatcctgagaggtgagaaggagcactgaggaccatgtgtggatagaggtcagaagcttcaatttttccttgctcaggtgaggactgtttcctgaaagcaaatcagcaccagttagtagacaaatatctgtggagtggataccatatagaaggcaaggaaagccttacaacatgctggttttgaacatgagttcttgaatcagactacttactggcttctgccacttactgactctgtacccttagggaagttgctaagcctctctgtgccttagtttcctcctatgtaaaatgggaattgtaatcgaacgtattacatatgctgttggaaagactaaatgagttaaggcacgcaaagcactttaatggtgtcctgcttatagtaagtgctcagttaagtggtagctgttacattatattatattacatatgtagactgaaatagaggacaagatcattctcaagagacaacaaatatactttaaaagataaggaatattcaagagttaaatagcagtttgagaccaaaaatcaccagagaggcatgtgtatgattatttgacttgcatagtgtagatgatgaaatggattcaaggggagagtttaccagggactgtggcagtctgaaaagttttatgaaggaggacataccggagataagccctgaggtttatgtggaacaggcagggatggggatggaaggacatctgagggtgaaaaccttgtttgtttaggtcaccaatgtgggccagtctcggccagcacataggtgtggggtgcccaaacccattaccgaaaaggaagtatgggtcgtgagagccaggagacaaaagtccgcagtgagcagactgagctgggtcttggatggcacaccaagaggcagttttctaaacagccactgctgttcactctccatacaaaacgttcaaaaaaaccgcactgcagagacagctaagtgtcttggaaatctacaaaagaaggtcagaactgaccatgaatcttgaattccagggaggttcacgaacccacccgggctggtggcagagctgaggtcagagccataccgaagctgtcaccgctctctcccaccctgcatgacctccatcccagaggccaggtctgggccatcctgctctgtcctgagcgccctgccagaagatcctatgctgcttgacaccaaacactcttttttaaaacattcttactgatacgatgaatattgacttaaaaattgctgctgcagaagttgaaaactcacctgagtgccaagtccccaggtgaaccacacgcatcccgagatgtagttttcctcccaggatgggttctcccctcctggggattagtcaccgtgaaactggccacactgattagcaagcggtgccagttaatcagacccactgagggcacattagggctgctaaaagcggcttttctgagtgttttcacactttgatggtttaaagccactcatgctgtcctgtctgaaatttgctgttggtaaattgagccacagcagatttgcaatcccatcgtggctcccaggaaagtgttttctggcccagttggtgccgcattgtgcaagagaggaggctaggcagcaggcatggtccctgcaaacagctcctgaacctcgcttgcagttaaggacacctcccagtctggactgataagagaacatctttctggagcagatattcaaaatcctgtaactcagcccctgaaactgacatatcttggagtcccagagaagatcccagagtcagggaagaggctcaaaccacagtgcttcactccccatcccttgctttttccactgcctgtgtcctcatgttcccagacttcctttaattctggttgatgtgatttaacactgaagtacccacaggatgctgctggtgcagctgagcacaagcctgggtaggcagaggacccagcctccagccctgcattcacccggacaagcctggagaccttgggcaggtctgccctccctctggactttgtcctgcatctggggcttgaagggcctggactggctggcctctgcatccccttccctctcccacatgctcatccccaccgcaccaggctgtaccctcactgcttgcagaccttcagcctctccacccctgttctcaccccctctcatgtccttggacttggccctcattctcccctcactttctattttgcttcctcttgctttttatcccctttgtcttataggggtcttacaggccacatacccttaaacaacatgaggggacacttacaaagctacttatgaggacaggggcatgtgcagggggccacccctgaggccgtccctcattctccttcacacagcgctggaggctgcctggtccccctgcccgcccatcggagatggtccctacaacatcttctaagccctttccctcccacttctttcactgccacaggaagtactcaaaccttgtccgctgtatgtgtctcatggcactgttcctgaatccgaatgtctgggtgggaggggactaggctagtacaactgagcttccattctgcagagaggagccctgaggccagagggccacatggcttccttaaggtcacagagtgacctggtggcaggtgggcaggacccttgcttcctgcacggtctgcaaggggactctgatggcaatggtgagggaaccctcagggctgctgatctttgctgcccccaggtctcccagcctccccagaagggaggaagccccaggacccgctccccgccttcccacccaggcagcctggggttgtgctctgcagatggggcagagcaccctggagggcagccagagacagcagggggtggcggggggcccttcacactgcaggaggcttgcctctaagaaacagaatttagaacagggtgggtcccacgcccagccccgccctgccccttagcacctgccaggcccaccctctcccccggtgtctcctgatctcccagtgtggacggtctttccccttgactgctgcatccccagttaagcaactctcttcccggcatcctcccaggtgcccctgaaagacgcctgggccagcagctcaaggcccactcagagtcccgaccctgctgcgacttctctgttgccctgccaggtgctttgcctcggtttctcaatctacaaagagtgagtgatgggggtgccatggataaggaggagattctacctgtgcagccctgtgagctcccagcatccgagacctcttggagagggaccctgtgggttggcaggagccaccgcaccagataggaagggaagaggcccgccatgcggcaaagtgagctgatggacacagtaagcacactcacaggttcccgcctctgctatagtggagtttcactgagaggttactgagtatcaacaacagtatgtggctgaactgggaacatctctattatttagtgttctagatacagcaggtaaaaagtcctcatggcaaagaatgcctgcagtcacacaggaacgtcacatgtgtgctaaggcacacacacattcctccagtcacgaactggtctctttttgatttgagaacaaaatgtaggaggcagtgataaatgttagggttacctccaactacaagcaatattcagcatccgttcaaggccttcagactcaaagagcttgattagctgatgaatcggcccagtggtctagaaacacagggacgttatccctaatttagagataggcaaatccaggctatctagttcagactgttttccagtcgggataactccctccaggacttggtttctgttgtttggaagagaacacagcttcctgagccgaggggaatcacattgcttctgggctgtagggcgccctgcctggctctagagattgagagtagttcatagtttgcctgttgccttatttatgtttcaagagttgtgagccccttgggtggcaggacctgatggcaaatagtattgttgtcacctcaggaattgtgatggggtgggaggcactccggcctgccggtgaggagaccagggatctaagtctggccagctgtgtgaccttgtcatttaacctctgaccctcagcctcctcacctgcaaaatgggagggtacaactgtattcgccctagagtattagcctttagatgcctgccgtgctcacctttcaccatggcagttgccctctgaatcatgcgtaattttcagtcagctgacttcttgagcaccctcttgcatgttagttagtttagttttgttttgttttgttttttaatatttggcttgggaacgtttcagagccaccaaggttgttgccatttctgttgggggtaccccagtagactatgtggtgtatgaccccaaggatatacagaatcacatcgggaggggaaaaacttgttggtatatatatacatatatacaaacattagccaggagaaatggttctgtgcctctcacaaaaagctcacaaaacactgtggtctgtggcagcagcagatgatattgatgatgatagaaaagttctgtcttcactcagacatgccattgatcaagagcatttattcagagactactatctgccaggcatcgagccacgcgacacgagccaccagtccgtttcttcatctatgccgcattgtgttgatactggcaaaggactgaaataggaaatacactcatgtcataggaggtgtcaagctgtttgtcagggcagagaagaggagagtaacgtggcacaagttgtagacatcttccttctgaagacatgggtgattggaacagcatgtcatcaggtgagttttcagtgttgcttccagttctaagctgggataattctgagtattcttaaaatgtactgctgttggaggataatggaaaagcgctgaactcagaaaaagccttgggactgtgagcaccatcaactgcattgaggagacatccaaaagtataatgccttcttcaggctgtttttactagaccatatagtcctactaataaatacttgtgcaaaacagaaatacttttaaaaaaataatatatttattcacttaattttcccagaaataatgccttgatcatatgttttccccagaaattgttagacttaccttctatggtcaacaagagctttcctgaatttcttgagatttagtgaaagcaggtagatgtaaactatattaattacattgcattttccagaaataaaaaaaagcttgaatacccctgaaattcctctgagtattatcatcctgtgctttgttgatagagaatagcagtgacctaataatttcttttttaaccactaattctagacctgaggtgtcatgacagagtatgaccctgggcaaatgccactctttcagctcccaatatagtaagcaatcacacagcccagaggtgggagagtaggtcctaaaataagagcaggtatttattaagcactcatcttgagcccaggactgtggcaggtggtataatcatcacaagagacaagagggcttcttaaactcaggaagctccataatggattcctttttgtgtctggagacctccaaacatgaaatcacagacaaggtgatgactgattaaaaataatggcaataataaaggccacttaggcttataagtgacccaggctttctaaatgttggaaagaaaaatgaggggggaatgaaatgaagatccagtgaggccagcgtcctgtgaagtgatcaatacgcagaacgtgagccccatgtgcctgttattattggttgattctctcgtgctgattcatgacacttagtggttaaagactcagatggtggaatcccactacctaggttcaaattcccagagccaccatttattagctgtgtgcctcgatttcctgatctataaaatgggggctaaaattacacctgcctgcttcctggagttgttgtgaggattaaataagtaaatgcttttaaagcaatagaattgtgtgaaacacacaggaagcactcagcaaatactagctactagtactctgtgggtccaactccctatctgtctacctcaggctccaagttggactgatcagagaaggggaccttctatacttgatcttttttttttttgagaccgagtctcgatctgtctcccaggctgcattgtcaagatctcggctcactgcaaccaccccctcccgggttcaaatgattctcgtgcctcatcttccaagtagctgggattataggcatgtgccaccacgcctggctaatttttgtattttttggaaagacaggatttcaccatgttggccaggcaggtcttgaattcctgacctcaggttatctgctctcctcggccttccaaaatgctaggattacagttgtgagccactgtgcctgacgtacacatcattttaaaaataactttattgaagcgtaatttatattcaataaaattcacatattttaagtgtacacttaagtgtaataaccttaaaatcatagaatttcacttacccaaccccttgtcctgtgtgattactatatgtcttctatttacacatactttataagttccactcaacaatgtttttatttttactttagtcaattgtcttttaagtaaattatgggaaaaaataaaacatagtattttatatttacctacttatttactgtttctgatgcttctactacacattctatagatccaagttcccttctggtatcatttccccttatcttgaagcaacccaatggcatttctataatgtaggtctgctgctggagaattagctaagcttttgtttatctgaacatgtcttttgccatcctcttttgacgaatatttttgctggtatagagttcttgattgacaggtttttttttctttcagaactttaaagatgttccattttctcctggtttccactgtctctgatgagaagtcattgatttttttttttctttctgagacggagtctcgctctgtcgcccagactggagtgcagtggcacaatcttggctcactgtaacctccgcctcctgggttcaagcaattctctgcctcagctcccgagtagctgggattacaggcacctgctaccacacctggctaatttttgtatttttaatagagacggggtttcaccatcttggccaggctggccttgaactcctgacctcgtgatccacctgcctaggcctcccagagtgctgggattacaggcgtgagccaccatgcctggcctgatattattgttattatttccctgcacataatgtttcttcctttgctgactgcttttaaaattttctctctcagttttcagcagtttgactatgatgtgcatcattattatattcattatatttgttctgcttggagttttctgagcttctcagatacactcataaatgagaagttttcaagttcgggacttttggggccatcatttcttcaaatatttttttgtactccattctcactcttctcttgctgggactcctgttatacatggtgtttggccatgttatagtatctcattggtccccggggctttgttcagttttcttcagtcttttattctctgtgttccacagatcagttcatttctgttgattattctttcagttgactcatgtttcctctaatgtctccatcttcattaagcctattcataatttttcatttcagttacttttcaattatggaatttccattctgttcctttttatagttcccatttatttgtggaattctctatatttctccctttaagatcatatactcatttatttcctttaatcagtttttcttccatcctttaaatatatgtatctatatatggatacatatgtagcactctctctatatatatatatctctctacacacccacatatatatagctgttttcaaatcgttgtctgccaagtccaacatctgaacaatctcattttttgtttcctattgactgcttttttccttgactatcacattttatatttctttatatgtctagtgatttctttttaccgaatattagaatcatggataatatgttgttgtgactctggatcttttcatattcctaagagtattggttcatcagcagacagtttaccatgaacgtgtgtaggcttggttttatgcttgttggtgctgagacattgaaagcccaaacccctcaacctccacatttaattttcccctcctgatgttgtcagggcaatgattttggctttgccaggatggatctagagtgggtctcactgtagacaaagggccttactcccaggaggtgcccttgcagtgtcagagtcatctgtccagggtggtaatgagatgttaactaggtctctccacaatttcagggccgtaagtccaacctcctgacactgctttttccccagcactgattaacctgtaccatctcttttctgctgtcaaccctaaaccagctgctatctgatatgcctcattggtttcaccttgtacctgtacaacccagccctaagccacagacacacaggcaacccctacacaaacttctagggccctgtatctacctcgctgtctcttctggatgtcccaccacagccacttcagcttcccacattccaacctgatttctgccttctcaattccatggggctgcagtgttgtgcttgaactgtagctctttgtgctgtcctcgggaaactgttcttaattatagtatattagataatataatgttatatgttatattttactttatatgtcacacatttactgaggacttattgtgtataaggcacagtagtaattggaagaaggaaaggtactagaatcttgctttatttggaaaataacaacttagaaaattttagagccagattgcattttctcatccaatgtccaccttttaaagatgttgaaacctggacccaaaaggtgacatgacttgtcaaggtcacacagttattgatagcagaagaggaaatagcctggcattttcccccactaaatccctccaaaaatatattttaaaagaaaatctaagcatgatgtttagaaatttttaccactatagaaaatttggttagtgccaaagtccctattgatgcaatagtgatttgagccagaattagaaaataagtaagtatgtgaccctaagagcattttgttcgagttacatagaaagattagcttatggcgtagagttaccgtaagttggcagcaatgaacaaatttggttctttgttacactccatctcaagaacatccagggaagagaaagctgttgcctgggtataatggtatttgccagaaaaaaaatcattagagaggtataattaagactagtttagtaactcattcaactagataactctataatgagtacatctcatttaccaccaaaaccatagagatattttgaagttttccccaaaagtataccttttttacatttctaaaggaaggagtgaggatttgcagtgagtgcaaccaagccaccttttcctcctgtttggccttattatcaagtatgttgctcagcaaacagccagtcctcagaaacttcactccaagaggctctgtcaagggtttggcacaaagagaatgtcgcaaagattttccagtgctctagaatatatccttgtattcaaaacccagttgtctggttctgggagtgagtgtggcaggaaaagctacaggtggatcccgtaggtagtttctcccataagaagtacaggccaggccaggcgcagtagctcacgcctataatcccagcactttgggaggccgaggcaggcagatcacttgaggccaggagtttgagaccagcctggccaacatggcgaaaccccgtctctactaaaaatacaaaaacttagccagacatggtggcacacgccggtaatcccagttgctcgggaggctgaggcaagagaatcacttgaacctgggaggcgcaggttgcagtgagctgagatcacgccattgcgctccagcctgggcaacaacagcgaaactccatctcaaaaaaaaaaaaaaaagaaagaaagaaaaagaaaaaaagaaatgcaggccactttttctttcagaattggcagttgagatgattcagatcaactgtcctgccgaggacaattagaaatgctggacaaaatattctaaatcttctttctggagcttggaaaagatgcctgatagaaacaaatgtgaatcctctgtggagaaagataacatcatcaacattttcaaattactttgaaaaccaattgtgtgaaaataaggttttggctgggcgcggtggctcacgcttgtaatcccagcactttggtgggccgaggcaggcggatcacgaggtcaggagatcgagaccatcctggctaacacagtgaaaccccgtctctactaaaaatacaaaaaattagccgggcgcagtagtgggcgcctgtagtcccagctactcgggaggctgaggcaggagaatggcgtgaacccggtaggtggagcttgcagtgagccgagatcacgccactgcactccagcctgggcaacagagtgagactccatctcaaaaaaaaaaagaaaagaaaagaaaagaaggtttcattcatgataccaaataactatatacacaaggagacaaagtaacctgagtgaaaacggggagaaactatagaccatagaaatagacccacagggaattgagatattggaattgtcagatatagacttgaaaataactgtatttaccacattcagagatatcaaagacaggactggtaattttccaaagaaccagatatggaaaagaaccaaatgtaaattttagaaatgaagaatacaatcactgaaatgaaaaaggcagtgaatggatttaaaagaagacttggcacagctgaaaacagttattgaactagagagagggcagggaaaaatactgataatcaaacacagaaactgaaaagaattgggaatgcagagaagagtacagaatatcagggaataagtggatgctcacatttatgaaatgtttttttcctacatctgacagaatcgttatttttaagttaatgtgaattacatattaacttgttatggaagtataatatagtggttatcttggtgtaggaggggtgagtggggctgctgtatagctggtggggttttatttcttggtctgagtaatagttgcatggctgtttgttttgtgataaatcatacattgtaacatccccctttcttgcatcttttgtatgtatatttcacagttttttccaaaaaaagatgtaagaagaagcaaaagtacaggtccaggtagctatatcattggcagatgccgaaggagatctgctccttactctgcctggagcacaaaactacagtttgccaccaatagggaggcagcacagagggacggccatcgtgatgcaatcacttccaatggattagagctgtcatgagagatgcactgttgagaaggattgtgaggccccatctggaccagagggaaggagcagcatctgccatgacgcgggccaacaagtggcacatgtgtgcagtgtagttgtcattttgcctggataatggctaaggaatggaagtggtagcttcaagttggcttggcttctaactccaactctgccatttaccaagtgtgtaatctgggacaatttatctgtcttacctaagcctcatttcttttatctgtattaagacggctggggaattaaatgaaacaatgtatgtaaagcacttatgtggtacccagcaggtgccgagtcctcgggaaatggtagttaatactattattgttgttgtttgctttagatcatcttgtctgcctttcaccatatgcagttttcttctaacacagggtttcttttatatctttttctctgaatttctcttttcaatccacattggtaatataaaaaattaattcaacttgaaggctgatattttaattactcctaaagttttaatttattggggaaccagttacccaccatccctttgctaagacaagaaccctcctttagtgttcctcataccatgtgtgggatgcagaatttattaatctggaaaggctaaattaaaaataaatgaaaatctctaatgaataaggacactctaatgagaacatgcaaaaatcataaaacttgaggctgtaggaaagctatccaggcaatagttctttccccgtttataggaagcttcttttcccagtaagaaaatgcattagtcacttttgaagctcagcttgataaacttactcctttccccaagagagaactatctgccttcctagttctagacctattttcttttgaaagccattaagcctgtgagaccattaaaagtgtctgttacttcatcagccaaatgaaggcagaaaacatgatctgtgagattcatcacgtctccagcttctagccagtgcaacatgattcatggagatcagaagtaagcgtgggctagtagtcacaacctgatgatgacagtggtgattgtcaccaccacaaatgctgaaaggagcactcatttttagaagcagtcaggtatgactttggaagatgaggacccagagttggctagtgagttatagtaagaggatatttatctgatcactatccctgggagggaacttgttggctcacaaaacttagaagccctccaggtggaatacctcctcctggcttaatggaaaggtgatggtggcacatagaaagccactctgtcttatctgcgagtcatcctacagttgcgctaccacatctgctctccacccttccccactctgctctctggctggggagtcgaccagatggcctccatcaacaggctgcctcatctccagtctgtagttgggttcagtcgatggggagccgagcaagagatcagcaggtgggagtagggtgaggtcaggttcttctgtccccagatccttccctgcaggtctgggctggcattgtcacagcctctccgagtggtcctttatacagaatgctgtccttcccactttctgtaaccactctttccacttgcttcttcagcctagtggtgctaatagatcactgttgttgccacttccaggccacccttgtggttctctttaccccatcataaaaagcaccagtcatctcaaattatcttaatttgagtgtgaggagatggtgggacaacctcgtagaaatatctagtaggcttatgaagcatgtcttgaactcagaagagaggacaaagaaaataaatgtaagtacaggtgtggatgcatgtacttagtggtgactattggactcttaggaaggagtgaagtgcatgaattttctgagagagagtttagagagagccacacaaagggcagaagactaacagaataaaagggcagagagaagctccacccatggacacagctcacaggtctagtcttctgggaactgttttcatattttcctaggtgaagatagtctctccctctcctctatgcttccaccgtcctttgggcataattcttaggaatattatcactgaggataacccccatgcaggcaaaactccagtcactgcttgagagcatctgataacaccaaaaagactggatgaggttgctgcagcctcccaggatggccagcgtgccctagggcctggctgctggttggtggggcagcagctgcagtgtcacttgagacccggttagaaatgcaaactcattccccacccatgatggagaattacaatccacattttgacaagatcctaggggacctatgtgctcatttaccctaaagggtcccactgagacctgtgtcacgcttctaagaccacacttcaaataacaatggctgtcactgatatggcctttactatgggcctgatgttgttctgggcactttgcttaaattaacttgtttaatcctcacagcaactttatgggataggtaaacgatcatcctctctttaagatgaggtcaatagttggtacaaggacacatggatgagatgtggtgggattgggattcattggagtcatttggctccaagggtccctcttcttcaaccactgcactctcctccttctcccacctcccatggcaatcagcagggtgcttcataggttctccgtaggtgcttggaagatgcacaagtgaatgatggcatagctgtctgtggtagcctcaagaaagggaaccttgatcatctggggaaaactttctacagcctgggtacgcctgtctctctcattacagaagggagagactctccgatagtattttctcagatagaggatgtagctgaggatggaaaacttcattctagattcccctgtgggagaagctggtgtttgatctacattttcttagaatctgcatcgcaaatccaaggatagtgaggttcaagggcagttatggggctcggtgggcacagtaaggacagtgcccttcacttgaacacctgttttttttaagtttttaaaaattgttttaaattttctttttgttttttagagacagggtcttgttctgtcacccaggctggagtgcagtagtatgatcatagttcactgtaaacttgaactcctgggctcaagtgatctgcccacttctgcctcctgaagtgctgggattacaagcctaaagccactgtgcctggccttgaacacctgtcttaagagaaatctatttctttcagatgacatccaattctaagaggaaggacttgtagcgaagcttagaatttgcccaccatctagtgactctttttgtttggatttggctaaagtttatttggaaatacagaaggcataacttgctttggtagggccagcctctcagtcagccatcattcagctaatcagacatctggattaagcagtatggctttctcttccattctgcaaggacagccagttcaagttaaggagcagctttctaaaactccatgtcctgactcctgccccagtcttgaaagtgggctgtcgccttaatgctggcttgaagcacagcagaatccagagtcagccccactcctgggaagccctgactacatcgggattggggatatcacatgtagaaggggttttcccaggcttgaggttgactcgccatttcttttcatccaggctttccgtattggcagaatctcacatggtgccgcagccctctcttctgttggattgggtcgctgagaagttgtggttaagattgccccagtaaagccagcagagtagaggacccctggcctaatgctgtccttcccctgcccctctgtggcaccagatggggattatttcctccactttaccagcgaggacgttatcaggagggccttcctcgtgtgcttcctgaatttgttttcctgaaagtaaaagtgatatctgcttcctctgatttcacacacaagcaacaaactggttcctcaaacctctttccagggatttctttgagagacagaacaaagccaggaggagcatggggctgacagacggagagccctgggtgtcctatagctatccaggctacgtcgcagtctggaccccacagccctggcgccgggaccctctacctgcacatacctgaccaggtcctctccccattcagccttcagcttaagcaccacttcctggaaagcctttctgcagcctccatgccaaaggaggaccctcgtggtaccctattctgcttctttaaggctcttcacagagtttattatacatcagttgcatgattatttgactaatgtttggctgcctacaagctctgtgagggcaaggcctgcagggcttgtagtcaccaccgtattcccatctctagcacgcaagcatggctcatggcctgtagagcttagctcagtaaatagtctttgagtgaaatgaaggtattgggttaggtgatcccaaagtcctcttcctgtcatggcaaactctgagtccacctatgagaaacttgtacccaccaaccccctaaacccaaacttctcttttcctagttcagtgattctcagcactgtcttctgatgaattctgtcatcaagcctccttgatcgttttcatactttcctaaggcttggctggaatctttgagtttgaataattgggaatgtgaaatgttcatgcctaaacaccaacagaaaagcagagcgtcaatgtggaatccaaacaatggaatctaacgttggcaatgatctccaattctagggtcttcaacagtttctccctgtgccctcccatctcatgtgaaatgactcaaaatatgaattcaaaagagggaagtatgggttgaagattacatgaaaagaatagagtccttaagaggagccttgaatcaggcacattaccttccagccccaggaagttctcattttcctctgctcataaaggcattttcatactcttttgtgatagtatctctggggccctgagcagaacacttcatcccaaaagtagggcttggtgagatgctgttttataaagcaaaagaggatgtgatctgttgtcagccctcgtcagtcatggtggacaatatggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgccggctaaactccatcctccccttttcccgagcccagcactgaatgatgccactgcccaaggccccatctccctggaaggtcttcctggtaccttgagagtctttccacccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaaaaacaggctcatcacatgcgtgggccaatagtgatcttgtgttcacagaacgtttgtcagcagttgcttcaccaggcttgtctagggcccattttctttcaccaacatgagcagccagccctgaagaaggcccgacactcgcttatcagcggtgagcatggcctatctgagaacacttgggtggagaaatgtcgtgtattttccaaattagaacttgagttggaggagctgtttctggggcagctgtgagccaatcccaagaagctgttaaacatccaggccctgagagccaaactctacatggcagggtagagaggaggatgtctggccgcacgccttcacaagccagcctggctctgccaccccaggcaggccgcgaggaaagcagatggaagcgagagcctttcctggaccagccttggaaacatctgggctctcctggaagcagggactccactagactcccccgccttcccagcagatgctgcaagcacgtgtcactgctttatagactcaggtcgtggaggctgagagctgctgtctaagcgtgtggggggcatttgcacagtcgtgaagccatgggctaggagccagaccacctggcactgagccctgtgccaccacttcccagctgtgcgaccctgggtagatcactccactgctctggacccactcttctcatcagaaacatatggttacaaatagtgcctacttcctaggttgttgccgggaggagatggaatgatccaatagagtgctgagggctgctgtcgcccatggcaagtcttcagaacgcgctcatcaagttggagggcctttggtgttccagggcagtccttcacccagtgacagaatccccagtcaggcacttcctcaagtcactgcttggatacctctgaggatggggaatcactacctcttaaagcaccctattccaccttcagataagcctgtttctcggacagataagtgtttatctgtgctgaacctaagtctttcccggacacttcgcagttggtcgtagttccatcctgtggtcagacagaactcatctaacccctcttcctcaaatagcagttgagatcctctgaaaatcactgacgttaccctcctgcctgtgccttttcaccattcctgacaaaacaccttcaatttcttctaatgattattgaatgatgttatttccaattctttcattcttgtggtttctgtcttctgaaggcaccccgtgctcacgcacgtgacttggctccatgtgcatggagtccctccccacgtgcctgagacacaaagataagaagatgtgatgagactcaaggagctctcagcgaggcagggaatggctttccaggcaggggagccgcgtgcgctgggattggaggcacgaagccagagaactgcggggtgtattgctcaagcctagggtaaaaactgggagtcatttgagaccaaactggggaaggaggcaggttagtttacctgcaggtgacagggagtcactgggtgactttcagctacaaagtgacatgttccagtgtgtactttaggaagagcattttaagtgtagcttgaagactgggcaacactggaacccgggagaccagttgacaaaatgacgagcaccaaggggacagagaggaggaaaacgagtcatggatggaaaagctaacagtggctcttctcctgggggcaggacaatgagtcattgcttttttcttcttccctgtgttctgcaatttctctataataagtattttctgttttctctataattagcatgtattatttatacagtaagaaaaatgtattcatgtctaaagatacttttaaaccaaaccagcaggacttggttactgagtggaagaaggagcctaggagatcagttttctggtctgggtgctcaggtgagtggcgtgacccccagcctggacggggatgtgaggaacagggcatttggcaggaattcttatggcatctctgacagctgaaatgacgcccacaagctgctttcactccacttggcctctctccagcctgttcagtggcctctgtcccctgcaggccctgaaactcacctgtcccttagacacctatctggaaagcaggtgtctgtgcagcaatactcaccagcgctccaggacagcagtagcatttatttagatgataagttttgtcactccttcagtaaatatttactgagtgcccacatatgctcagcaccaagccaggccttagcaacaaaatggaaaagaacaggcacagtccctctcacaaaactcagcctaatgtgagagacagatataaatgttttaaaatcccgttaaggaacataacatttcaaactgaggtgcactctccagaggatagaaaatagttccaagaagacataaaggaaacgtttctggtctgggagttgcgtgatgatccctggggaaacagatgcttgggctgagagtgaaggataagtgggagggaagtggggaaaagcattccaggttgagggaacagcatatgtggtggccctgtggtgggaggaacagtagcatattcaactctctaaaagaagagctgttttactggagtgggttggggagaggcagtgggtggagaggtgggtgtagccagacccgacagggccctgtagggcacaggaaggatcttgtcttcatcctaagagcagaggaaggcattcaaagttccagcaggcctgaggcagcctgctgagcagccctccagctgtggcctggaggggagcctcccgatgggtgtccctttatgtcccacacccaccgttctcttgccattggaggcggtggcactgaggcccgtcgagacaccccttcatgcctgggtagcccagatttggggttcccaccacctcgagtagcacttggaagacgtcccccaccccccacccccagcagatgccctgaaagccgctttgcagttcagttttcaactttcttcgcggctctgcatactccaacactaatgtgtatacaacttgctaattaatggaatcatttcaatctgaaaacatcttgttctaatgggaggctgcaagcactcttattaattcacaggtaaaatcattccagcttttctcttctttctttttttttttttatcttcccagcttggcttaatagctgggaagaatcattctaatcagccttgcgagaatcacatcaccagaatgaaaagcaccaacaacggccttggggtttgggaaaggggtgaccagccttagtttacccaggggcaagcgcggtggatgaatgtgagggtgagatgccccacacagaaggtaaagacacaaaaagtgacctgtgtagtgcgacttggaggggggtttcctgtcctgtgtgtcagaggtggcactcagggtgactttctgcaccactggctctgctggagggaaggaggagctgcctccacattctcacctggcatgtgagactcactgcactcacctgggcaggaatctcacacgtgactttctcggggctgggtgtcatctgggggtgacttgctgataaccaccttcctgtcatttgcaaatgatttgcagtgtccctttaaatgaatgccatccccagtgtgttatttctggtataaccgagcttagtaaggggggccttctccccatagaccgcggtgcaagccccagacctcaccgacaacacccatgtccccaggcgggcttttcctttactcttttttaccagagggatctgggtgctttttagagtttcttttcttgtggtaataagaacataacaaaattgatcatttcaatgattttcaagtgtacattcagtggcactaagtatcttcacactgttgtacaactgtcatcaccatccagctctgggactttttccaatcccaccatgggaaaaacctcgaggataaatgagtccctgcagggccgtcttgagtccacatgagctctcactgtcctgagatgctgctctaggagaaaaagatgctcagttgtctgtaagatggggtattacacaatttgacagttatggatggaaacaacatgttcttccccttggaagtacagcagctgccagtcctttgctttggatgagtctccaagacagatttggagtgaggccaacctggatttagacccctgcaccatcagtccttggcgtgtggctctgagcctcagtcttctcatctaaacaacagggctggcagttccttccttgcagagttgctggaagattgcatgagatggcgtcagcacggtaccgcggtgatgcttggttcagtgagtggctctgtccccgcaggtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcaggtaagaggggcaggcggctgcgctcccaaggccctgccctctatcgctcccagcacctttcccgctgctggctacaccaacatgaccagcagagcccagggaaggccccattcattcagacacacactgggcatggttaagtgagaggcagagacccgtatcctttttttctcagttccaatttttgttttaatctctgttaaaccggcctaacgcaaacttcgttcagcacttttcaataagctacacaatttgagaaacatttgaataacttagaacctatcttttgtcaatctacgacttttcaagccaaccctgagtattttaagaatcagagctgacctggggtcgtcagtctctgctccttccatgcttcagtgtggttggccattgggagccctttcacggggccgcttagccctgagcaacaggttctcccagcaccactctaagatttttctaccttcatggtgctgattccagatcctctgtaattattgtttctgcttctccattcacaggcagatgccccagagcccctattccaggtgggggaggagggcaggtgggaatcacccccttgccggcagccaaacttcctcccttcaaggagaaggcttagttctaccccatgactcccagtcccttcctttttgagccttcccacttcacgttccttccataaatcaatatatttaacagcaatgctggctcattaggcgcttccctgcgtggcactggagttttggcttgcaggatatgctgcaagctgctgctaaagctactaacatcgcagcttggccttttaaagaaacatttaaacagaaattgacaaggcttttaaacagacatatacagtggcttaacacaaagaacttgttgaaaaaataacacccaccccaaaggggctagctgtgttaaatatatatgatttttttcacacagcaagatccatcatcttagtttttagcatcttggtggaaaaaggggagcatcatctgccggaaacagtgaaggatacctaattttctccatcgacactgcacctcattcccactcagtcccagcactcagttaaatgggacctctcgcttcattggggtgaggagggatagcttccaaacaacagggagtgaaattcgtagcagaaaccaaaacagaatactttctatgtatgatctagtatgaccggatggattaactgcatatttgagggcatttctagtttatttctacatagccacagtcctaaaaacaaaacaaaacaaaaaaccacacacacaaaacgtatactcctatagacacagaatcacacaaatgttttcactttttggatggaagtctgtttaacaggagactgttttttcactctagagagaatttccaaattacttgggtcataattgtataaaataaactatcctgttttcaaaaatggaatccttgttaagttggaagaagcaggtcttgcctgtagctaaaattctgagactttttagccttgcttaaagaaatgcgaaaccatatatgaataatattttcccctttaattaaaatccttccttttattcaggttgatttatagctagctcagaaccaataaatttatatgaattgtgtggccctgtgagagctcattttaagactccttaaaaactgactgtggtatgtctgaagttcatgcagttgtattgaaattatcaatgacccatttgacccaaactcctcaggaagtctcagacatgtggagtctcaaagattccccatcagttcagcagtgaatgatggtgaggccctcactaacaaaatgggggagagcgaaatggtagaattcagccatcgagccaaagatggcggccctgctgtgcaatcagaggtctgtgcaccacagagtaaggagaggggctccaaagctgcaggcaatttccatcatcctaacgagaaagcagtccaagagtgttttctgccggtggtgggctcctgcaagggcgggtgaggataagcggccctgaatactggttggaagcccaaggctttgttaccaggcctcagaggccctggatagtcagaaaatggtgagcatggtagacaaagaaagcatggcacggggagggagccgtcctgaaggccatagccgtagggcccagtgaagaggtcgccccaacgccccaagtaccgaacctgtcatggcctcctcttctcttaggacaaagataagacttggcctccccaattggaatggccaatttaggatcacattgtccacccttgatagtaaacaggaccaggaaaagtgcctgagaagttgcctcctaccaagagactcatcagattgtttatgtgatgggtttatctttgcctgcaagttcagaagagaagtaggctcccatcacagaaatggccatgagccaagggggccaggacaacagcagaagtgctccagagagaagggccctgccaggctccatgagaaggtggcctcactcattcgctggagtcagagtccctgctgggaagaggggcccaggacacagctgcagaagcctgtcctctcaaatactctgcaatcaggagcttgctgtcccttcgttcccaaacctgccgtctgatcacaagccaggacccactctgtcactcttagcacaacacgatgccgctgctatcaagcccttgtccacccacagagtgggcagtgcagacaaggagggaaaatacgcgagaacccagacatgtctgtgcagccgtggagtagaagaccaaatacttgcaggctttgaaaccaacccctgagtgttttggagagttttatataaactttggaatgggtggtttaatttttttctttctttctttctttctttttttaaaatttcagactttggattgaattaccctattttccgcaaatttagattacacaaaagtgctttgtgagcctttgttgtaatttttgatgagatttacatcaaattctttttatagtccaatattatttcacagactgtgaattttatgtatctctagatttcaaaatacgtttgattttgagccatgtttccaataaaatccataaagaaagttatggaattgtccaggtgagccatgttctacctctagactgcccttccagggagcagccccggtgaaggcggtctcagaagaggcggcgtttccctaatcccggaggcatctgcaaggcgccttctcagctcctcaacagacacatcaccatatgccgataccttttgtttccggttgtcccatctgtttgatggtgcactgagccaggtcactctgaatagcttcccaatcacagtaattacccctgagactggcacagagctggttggctaaaacctagaaatgaaatcatcttcattctatttactccttaaagttgagttttaaaaaagtaattgatttttgtcttcagtgatttctccttggaatcactaactggagctctcccaggattgcatgtttgtgttggtattaactgcgtttctaactctctcctaatcgtcacctccattattttaccgaaaacttaatttggactttccagaatgactctacctctcttcatttctgtcttaaaatgtagaacctgcattgctttgtttctgtctcccacttcatgttcccactttcctccccaggacttcatgactctgcaaaagaaaactaacacatttttacatttaagcaaatttctcctcaccctagagtgtgtgttgctaggacctgctgatttgtgtgtgttcacattttttcaagtgttcgctttagcgctttttatagatacctatttttaccagatcatcactgcttcttaattgttctcaaatctttttcattattgttcaaatcggattttaaatagcagagtggcactaaacctttagataatgtttctgaatctcatccctttctctcttattagtgagatcacttccccttgatgccattttctttttcgcagatattcgtaaaatccccagagatgttttcctttctcgaggacactcagaattccctttggcagccttctcctcttccctgtttgtgatgtttcaggaactgagagtgcagggaatgctgtcagatgagtggtcccaatgtaaagattaacttcatctttattctgcgaaaaagcaaaacatgagaaaaagatgcaagaaaaagatgcaagcttccccttcactttttcaccctttctctttgtcccgtctctgctgtcattccagtacttttatcacagtgactgaacacatctccctagaaagctatgactagaatgggtgacaacccaacataattaatgatctaattggctcttggttttccagtctctcagctcccaaatttttcggtgcttattatccactttttcatgtattatttaggcttaggatttacattttagcctcccccttttttgtagcatcacatccaaatctctaaagatttcacatttttaaaagtcataaaaagttgtagttagaggactgcttgtttcagctgcgttaatggagccctcctgggagctggaccctgaaataaggaaatggtgtggatactgtctctctagcagttcagggaccagcagtgcagacctttgcaccttgatcaacgaacacaggactcacacacaactttaagcactggcccaagaataagccaggaagcagcattattcataatagcccaaacctggaaataatccagacgtccatcagctggtgaatggataaacatacaatgaaatacactgctcagcaataaagaggaacagagcctactgatatatgcagcagcacggatgaaactcaaaacattatgctaagtgaaagaagatggacataaaaagcctcatagtgtgtgattccatttatatgaaatttctagaggaggcaaagcaatggagacacaaagcagatcaggttgccagggactggggatgggaggaaggattgactgcaagcaggcgaggggggtttcagggagtgatggccgtgctttaaaatggattgtggttatggctgcatgactatataaacttactaaaaataattaagatgtacatttacattgataaattctgaggcatgtaaattataagtcaataaagctgatggggtcagtgggagagaaagagaggagaggagaagaaggaggaggaggaaaaggaggaggaggaggaaatgacagaggaggaagaggaaatgaaattgacagagaacaaggaggaggaggaggccacaaagatgaccacgaaggtgatgatgacaatgaagaggaggaggcatgtaaattataagtcaataaagctgatggggtcagtgggagagaaagagaggagaggagaagaaggaggaggaggaggaggaagaggaggaggaggaggagctgccactgctgctgggaagacacaatcgggcatatattttcaagtagactctattctcctaagaattatctcttacttaaggattaatatttctcttctggtcttcctcttgggagtgaacagtttcagatttaaagccaccgactgagaatcagcccaccggccagtcctgttcaatgcacagcctaacgtaggcaaagtaatcacacttacgattgttttgatatatatgaaaccagaaaataatcctgggttatctgttgtctctaaatgaagaactataagcaaattctctctctctctctctctctctctctctctctctttggaagtgtattttcattgttataggcaatcatttatttgttggaactggggtctcttctgtctgttattgtcattactttgtctaaggacaggacaatgtccttgatttcacaaacttttgtgaattccacaccgttaccttccatagccagagccaagactttctcagtgttttcccataatggaaattcttagatcagtcaggtcttgtttaaatttaccatcaatctccacactcaaaatataagtcacatcttcattcattaatttgctgggagctattcccagcacgtgaaattagtccaactgctgcatttagccacagacactgtgttctactgtttcctgacaaagccccgtccgtactgaggaagcacactccctattattcactgccgctctatcttgatagaggtcagaaaatgattcttctcttctgaaaagtattcatgctgcagagcaaagggcagagctgtgaagtcccacatgacatgcatgaaatacagtcagtagcgtgtactcacaggctgtaaggaaaacggctgcaggtgatccctctccccggcagtcagagtccgttttccgtctttcgcctatgtaaggcttcactgtaaagtgacttgcgtccctggcaatgtatcctctaatacatagtggacccatatagttagaaagctttattggatgggatcggttggctaactatgtgaaggagtctttgcattggtattgtccttaccctaaattctggtattccaatacaagtgtctatagaactctaccaccagaaaaagaaaatatggacttctaatcgctttctgggtcagtttccacttgcagtggtggcatcatcattattttttgattggccatttgattttgaggctgacatgttgcagcagaatgggcaatagaaatcaattactaagattaaaatacagcttttacaacagtgagtggaaaggactgaccttctaaattaacagcagcctaaatggaaagcctactttcttgtgttgcttaattcacatctggggacctgatttaaacatgtcttgcgctgttgttgccatggttgctttgcccatcccatcaacctcatcctgtcacttttctctctgacttctttctctgcccacatctctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtacgtagcatgagtgggcagtcagagggtgggggaacagcggccgtgaacccttccctgacacctccctttctcctcctccccatggtcttggggtcacatacgcatcttgatggaatggttgatgaagagcgtctttgatttcttccaggtcttgcctgagaaacaaggcatgagcttttcaccctaacgagtcccctcccccacccgccagccttaggggaaggtcatttttccagtgcgtcccacagtgcaaaaccctggtgtgcaggcatggatgagctggccaggctggcacaagggttccgttcaactcctcctcccatgcagagttccttctgccctcatccttttcttgcctctttcctcaaaagggagctagaaggcagaattatgtattcttagggcagaagagaagaagtcctgatcttctaaaaagaagttatataaagaaaccatttttattgaattgtgtagcattgtgacatgctattcaatttttactttttattttactcttaccttaacatattagaatagtccatcagacaaatgcattggcagcatttttactattccccaaacatgctgctggtcatgtgatgcctatttagaaatacactttttttttttaatttttattttactttaggttctgggatacatgtgtagaacgtgcaggtttgctgcataggtatacatgagacatggtggtttgttgcacccatccacccgtcatctattaagccccacatacattaggtagagaaataccacttctcgagagccacccaatcaatagcaaatcttcgtttaccttaaagttgccccttttattacccagtagccaacactactttgctgcgctttgagcctctgaagtgccagatttttgtacagcctaccccacaggcaaatccacactccatatttgagctgtctcgattctggcaaagtccattattaggaaaaactccagaaaatttattcttcatagtgtctccaacttcagcctgagaaatgacttgccagaatccagtgttgttctccagaatttgggcgaataaagcatgctgccagtcttaaaaataccatctccttcagagttttgcaaataggcaaatttatttggccatcgtgaaaacaatctaagagcctgctcagggaacatgtctacaaaccaaagcagggaagagtgagaggggagcaaatgcttcccgttgagcagagctgccagatcaaaaggaaatcatgccaagagaggcgttgacttcttcctgaatcggaaggaagagttttgtaactgtacggagatttggtgcacagtattctgtcatatgatttctttaaaagcaccatgtcctgttgattcagaatccctctttctcagtttttacatgatagtcaatatgccaaaccccagtgttgctatgacatgtgtccctccctctgtaagtgacaacttgaaacttgcccgaggaccttgtacccagcaaacatttcctgagtgtccttgcctgccaggggtgctcctaggctctgaggattcagtcataaataagatccagtccagtccaattatctcagtctaggaagccaactaaactctaaactgagtaatggcagtatggctggacccatgccgcggcaaagctgctgtgttgtgatactttcaaaaagaagacaaaggtcagaacccctctgcctcaaactaaaatgaaacactggaaaacatttctgagattcatgctcaataagaccttggttttgaataatttgtaagacagaaggaattgaacttattacacttagggaaacttattttgtttagcaaagcagacaaaattcccaagtggacctagctggtccttcttcctggggtgggtccctctgaccagccaaggacagaaacatccttctgccaacaggcagtttctgcctacaggccacataggataaatgattgtgtgggactgtgctttggggcctcatcccataagcttcaggcccatgcattccatggcatcaaactgagggcaggtggcagtggagggtgggtggagggtaggaatagatatgactgcctttgctgatgtatttttgtgttcttccttcaccactcccttcttctcccaccaccacaagtcattgatgccccaccagccagatgtgatccaaagaaatactgtcataatgacagccggggcggggagcagaagcagcaacaactgcaaccaccaattttcagcagctgtgttgtgccttctcccctggggagcgtgtgatagtgctcaggctgggaatggaaacagtgtcagaggtgaagaaacaatcccaggctcatgggacatgcctctctctgattttcccagcaccttcccaaaatggccatgttgtgtgtgtgtgcatttgtatgtgtgtgcacgcctgcaagtgtgtatacacacacgtgcacatacacacacctaaaactgaaacttgggtattcatgatagaagccctgcctagcccagtgctcctgctttcaatttctctaattgctttgacctttctacggctgtttcttccttcttcctccctctccctcttcctttctctccagtgtccctcctccttagcttctaggccagtatctctaaagcacagactctcaaatctcaaaatgttctagcatcaaacatagagctttgtaaatataaaaatacccaaacctccctcagagccattgaattagaagctctaaagtcggggccccagtatctgcattttgaaaaagctctccaggtgattctgatttccaggctggagtttgaaaacgctggaaatctaacctgttgaacctcatggtgctggtatgatgctgctggctttgaacccttctaaggagatagtttccacagggaggagggggaaataaggcctttcactcagaagaatgaattgtccttcaggcacaagggcaagtctaaaggacttgagaaggagcagccaagattttcaaatatagtaatgcatggaaaccccagagctccattcattctaaatcaccaaacagctggaaaagagtaagtcactaaagcatcaaagaagcgattggtcagccgctggttatggcctgagatagaagggatcagggaaggcacctagcagatggcagcacttgcttccagttgtggatgatacagtatctttctcttttcctctaacatccgttattgcattccattgttagattttaaagagtggactaaaaataaaatcagacttggtcgagtaatacttgaacattgcttcagctatgaaagccattggccatgcattgcattgaggctccaacaagccgagcaatttgctgaaaacatttcttctacctaatatcctgtttgaggagtgtgcagatgacagaataaggaagggtggataccggggatttggaaatgaaacaaaactcgggtttggtgtatagtttccttaggaaattacttcttaagccaaaggctcatcctttactctcagaatgtccaagactcttaaaaacagatgggtaggtgtggggagtgtgatcagataaaaagcgctggccttcttcagaggcagtgaagcaccaaggagggaagaacctaatgtgtaacgttaccattgttttccattcttagtttcacgttttgtttttttcaaaaatctaaacatccctagccttttgcacatcattcaaggctgcttgtctcccatggtctacgcatgagccatctcaaagatgtaaagtctgctgggtcagcctcctttgcaggaccttgtcgataggattcataggcatgctctgagaattccagttggtttgaaactctgagcatgacctcttacacactgtgggcagtcacaatcaggtaacagaaatatccatcaattaaacatcttttcagtgctgactttgtgttcagcacttgagatgaggcccctgctcatgggaaacagaatgacatggccactgataggggttggggacacacgcagaacgttgcaggtgagaattgtggaaggggggcagcagctagactaggcatcacactagaggatgtgtttctagctctttaggaatctcaatgcctggataattcatcaggagcattctgttgacttctgtccaccccatgcccttctgggatccccaagaatgttgcacactgtgaaccacagtaaagagcctctggcccgcgttatcctgggttcatgccccttcccatcctattgggaccaccctcttcctgacaccacccattgcccctgcattagtttctccgtgatcagttcttcgactgatttttttttacaagttaaaaattaaacttaaaaattaggttataaaaaatacttaatgagaaatcatctaaaagaaagatttttttagagtcacaaatagtgtgttctctagaacctggaatttgttttggttcagccaacaggagactcttggaacaaaaatctaatgagttaacttttcataagtcacttgtcagctccacccttcatcttgccatcccactatgtgtctggatgtgcggagaaggtatttctattaaattcacacacacacacacacacacacacacacacacaacagctattaatctcttggtattggtgctgctgaaatatccctcgtttatgacaaagaccttttgcatccaagcaggttgaattgggtgttttaccctatttttgtctactccatcttcacaaagccacctcctttcactgcagaatatagagttgctgaaggcttcataaaagttagagctgaattctgctgatgacctaggagtcattctaagtgaggagctgagaaaccctcaagtaacccagaaacagtgtccagggccctttctcaggtatcggagtagagaccgtgttaggacctctgtggtccctgacttttcacctgcctccgtgctacccccagggtgcacctgttgcctaaaatggagaatccctgatctaaacagtaaactggctgttcagaagcatatcaaggaagagagtcagcatctctcaaagccattctttatttatttattgggtttcattttatttattttgctggtattagatgagtccttatgattctgtaatttaatttagcaaacatttattgagcatttgctgtttcctgggacgagggatgtgggagcacagagaagaataaggcctgcccaggcagttcaggtctaactaaagagttgcaggacatgcggaggaacacagctgagccatgggggtcagtgccctctgtgggagcaggacagccctgaggggcacagagcactccaggaccaagtggggctttactggaccaggagagaaggctcttctgcctggggaaagcaagctttgtctcagtttgggaggccgcagagacctgggttttaggttctctcaacattgctatggctgtcagccagttgtctcctgcacaggtcttcacacactggggcccactactctctatgacagctcccaacctcccacatgatgtcagcacatgagtccatctgattccagggagtttgaaatgcatggaggagcttattttgttggcttgccttggtgttaggagcttgttgttttcttcccccatgtaaactaagcttttacctgggctctgaggcactcccgggttttcagcactcaataagcaggtgcaggggtggggagcagccaggtggagcctgttccacaacttcctgctcacttggtgctccgtgaggtagctgcccgtgtcccagcaagcaaggtgacatagattctgaaagccgcaggttgatggagctattgccctgagctgactggtgttcactggcagcagcagatcctgtcccccagtgacagtgtaaagcaccgtggctttcacagatttacacctcctgcctttcgatggcaggtgtcagcctctctctcgacatttgctgaaacgattcagcctttttggatccacagtgcctgtgccaagaaccttacaggaaaggtacacacagcttgagaacccgtggaagtctgctgggctggggagttggcctcgaggagaggggctagggaagcttattcccctgtttatctttttggggaaagataaaaagtggacttgagggtttaaatctggggttcccttcaaggaattagatgctggttgccgaaaggtctttgatagtgttcattcaatgctccctccctttgtagtgaggctgtttcagccaaggcaggggccgtcctgccagtacttgggcctggaggccctcaaggctacagacaatgagctgactttccttaggaaagtcaggagacctgaggaacacggcttaatggctctagaagacctatcccttatttcacctctaaataagggtgtcagcaatctgggtcatttttttttttaaatctgactttattctttgtcttcttaatagctccatttcagctgctttaggacatcaatctcatgactccaggcatcgccctacttcagagccacccagctttgtgtgctctctactcagctgtccccccaaagtaggtggaccagaataaagaggagaaagtaagagggaagtgaaaggagaactttcctttcagaccagagccaggcaggccagagaatcaccttctgtggcagccgagcattgctcacccaggcagtggggttctgaggaccaccctggcctcgtccgtctccatctctcatctgtcctcctgcttcctgccctcgcctgctgttccccatctcgaacctctaaaaaaccagcccacagcccaggggggaccaaagcagcagtgtgggacggcgagggggacccatgagtttcctcttatggtcctggctgtctgtggggccatgaccttgaggtctgtagctccccctttgaagtccttcatatgctggaagcctctcaccttgtgtgtggcgcagaagaaaggattcccagactaagctcgggccttaggaaatctccaaggcgcgtgggtttgtgtggcctccaaggctgcattttctgtgaggttaaatgttcacaaaatttaaggggtgtgaggaactagtgaggaaagatttcattttgaggaagttgcctgggcgccatcgagcccaactcccactcgccatctgcccaggctccagaggcagctttgggaggggaactgtggtgagcacgtcgtggcctcctggaactggctgctcccacgtgtcctgaagaaggtggggtctgtgacccagagaggagcaaggggagtttgccaagaacagacatcctctgccactcttgatcccctgacgcacacggggcaagctcctttggggtcgaacagaacagaccagttgtttggagtaggtcagtaccatggggttctgcacgcgcttcagggtgccggcgtgccctcgaggctgtctgcaggatgctgtgtgtgtgcagtgcacattactgctggtgggagtccatagttctcaaaagcttttcctgactgccccaccctctcaaaaaagtaaagcaggccgggggcagtggctcatgcctgtaatcccagcactttgggaggccgaggtgggcggatcacgaggtcaggagatcgagaccatcctggctaacacggtgaaaccccgtctctactttaaaaaaaaaaaaaaattagccaggtgtggtggcgggtgcctgtagtccctgctactcgggaggctgaggcaggagaatggcatgaacccaggaggtggagcttgctgtgagccaagatcacgccactgcacctccagcctgggcgacagagtgagactccacctcaaaaaaaaaaaaaaaaaaaaaaaaagtaaagcaatactcatttagaggaaaagaaagggactgcttctgaccctccttagcaggacttactctgagagaggaaaagctacaaggacacccacaggctccccctgaccttggatccaggtttccctcttcctcagcaggtgcctgggactcccattccagggctgtctcaaccccattgccttccctgtatcagagagtccgatacacaacagaacccttacacaagtaggcgctcggtaaatacttgttgaacaaacgtggactctgatgtgaccactgctaagaatagtcaaagaatgacctcacggttcccatcgtcaaatgggacctgcagaccacagcccatcgtggccagcacggctgtcagtgtggcctgtggtcaggcagctcatgtggctctcatgcctttctctccctaatctcatgtcaccaatcccacccatcctgtattggctcgggtttgtttttcttctcctggtgctgaagtctggtgtggtttcctttgcactgttggttcagacagttaccttatcgctaaaggaaagctcccaggctccctgggatggggacagtgtctgacacacaaggacctttcaccccgcctctcctaacagatgctcttttgctggatattttagtagttcagccactgggagaatctttgcagccaggatggcctcacagccataggctctatttttaacaattgccgacttctgcaaacctccattgctatcataggaccacatggactctggggcttccttcctgctctttatctccgttgccttcagtggctgtgcagtgcaaggttgacacaggcctgctgagcctggcccttgcccccctcagcctcacgcagacactcttccactggtggaagccttctgggaccctgcgtgcttccttctgcagttgcagctgccagcctgcactgtagctgcctggtcatttcctgtctcccctccagcaaggatttcgtgtttacagcacagtacctagcacatatcaggttcactcattcactcaaagagcgttagctgaggacctactatgtgcgaggcatcgttgtaggcacctggggtacacccgtgaacaaagcaggccagaaccaactgtcctcggggagctcacattctagcatggaagacaaacagcaaataatacacgtaataaataggtaatgatacagttaccaagtgagaagtgctctgggaaagcaaaccagatgtgagaaaatgggcatgctcagtaaacccacgttcaattgaatttcacgatggcatggccaagtgggcacacactgggaatcttcttgccccagacacgatatttgcactatgcacaatgattatgttgggtgaattttcctaaccaaaatttagtaatatcagatacatctcaatggatctgtaaagaacatattgggatgtaacacttcataccagtcagactagctaggtgtctcggtacttctcagtcttttattcccggcatgcagagaacatgtttatccagcgtacttagacaaatgcatgtggctgctgaagctgcaaagcccaagggctgagggtattactatcccacctgcctgaactcctttgaggcccctgggtggaaatcgtggggtggttatcaaacttgagcatagcctagaatcacctgggatggttaatatgcagactgtgggccaccctgagatcttgggggcatggggcaggaatctgctttgttcataactctcccagatgtttctgatgctggtggtccttggaccacactttgaggaacactgctatgcaaccttgtggaggtacatggagagccacacacttgtgttgttacatttgaaattgggagctatggagagaacaatgtgatcagtggtgctcaagcatgcatcagaatcacctgtagggccgtcaaaacgtgggttgctgggccttccccacagtgtcagggtgaggtctaggtatgtgcatttctgaacaggtccccaggtgacgctgaagctgttcgtccgtgggccacactttgagagccattgatgtgaatcattcaggacacttgtgtgccttggaagtttgggtttctatgagctagtttcacaaggacaaagttgggtgcatttttaggaagccagaacttaaccctgtttagtcagaaggcatcagaagagatagctttgagaaactaaatcagaataaatttcctctgatggaagcacagctctgcaatttatcttcacgtccaccctccagccagtggtgagctaataaatgtttaagcatctcttcttagggtcagcgggtacagggggctgatttattgcttgcctatctctgtggtgtaaatacttccaccatggtcagtttcaagctgccagtgtggtcaacgaacacggagctgggaagagatgtgcacggtgagctcccctcagcccccaggagccagctccggcgcaccactccctctggctgccgtaggggtttgtgacctttcagggcgttctccaccattcagtagttacagtcagtttccacattaaggaccatttacccctaagctgtggttgcagtcacaggacccttctctgaatacataaaccaaaatgattgcctctcccagccggtggcccgcagtacgtgtgaagcactggggtttagcctctaacttccgggcttggcccacggtccaggtggccaaggttatcttctgaggaaggttatctttcctcacacctcctctgtggtttcagttctccaggcctgtcagcaggagctgacgcacttcatacaccaaggtcaggggcctccgggtgcaacagaaggcttaatgtccaggcaaacccaagtgagttaaaccatcccatgctgaagaaattattttttgaggtgacccattttctcagacaagtgaatagaaaacattggagaaatgtttctttttcagaaaataaaaccacagagagacagagtgattcctcttgaggcagagcgggccgaggtccccttcggtcacaggagttcctttgaacatgggcgatgccctgggtaacacgggtaacctggtgcacatgaacaaagcccacgttcagccccgtctgtcccctcccaatctgctcacacctgctgcctgcctctttgctgtaacccaattctgcttcttctttcctaactttccttcgtctttccagatgcaggacgctatgggctatgagttaccctgggtgtattttgtcagtctggtcatctttggatcctttttcgttctaaatctggttctcggtgtgttgagcgggtaagctgaccgtttctatgtcctctccacaacgcagccgagcaaggtctcaggttccactccgtacatgcccggggtcctcagggatgggaccctgacaggcccaggaaaaccacaacaaagcctctgttcaaccacagattctgacccattggccaggcaggctgtttggcctctgatttgcacctagagggtccccggatcctggcgctgcgtgggtcagtgtctcgggagccggggaccggcactggccgtgctcggttgctgagtgtgcctcactaactatcattccgttcttccaggtcaatgatgccgtaggaagggactggccctggatctattttgttacactaatcatcatagggtcattttttgtacttaacttggttctcggtgtgcttagcgggtaagcaggaccaaggaaaaaggtcttgatttttccatttatttttatttattctttctgctattcctggctgtattctttttctggctctgatgaacctgggataaggggtcaccacaggagccttgaagtggatgtccttgtcctggctgggtaaagggtcagatgtgccactggtcttggtggtggacaatggaggagagctggcttcaccacaaaaagtgggtccagctggcccctcccagcctcaagtagctgtccaggcaggcagggcacttctccttgtgccttcgtggcctctggtgaacaggcctgggtaagaaaagactggtttaaaacataaacaaagacagactcaaaatctaattctcattttacttcatagactgagcagtctatctctgagtttccttttctgaatggaaaggacccttaactgtttaaagccatatattatttaagaatagaggagatgggatgcaatttcctctaactttatatctagttggctgcaagtatcacatctacctaatttcagcccttgctcagatgaagttagaagtggtagaagtaaccgggcatggtggtgcacacctgtagacccagcaactcagaaggctgagacaggaggatcacttgagcccaggagttcaaggctgcagtgagctatgatcgtgccactgcactgcagcctgggcaacatagcgagaccccatggtagaagtagcacgtggttggaaggaagcacctgaggatggccaccttttcaccatggaaacgcataggatatttcctcaacccactttcttcttcagaagtccacaccagccatgccaaggcctaacacctaaatgctcctggtgacctgctcatgggtaacccactctgctgcctttgccacttgggggaggggggtaatctacttctactctgcttgagactggtcagctgctttgcagagtcttccctaaatgtctagagaggttaatgctgggagaaatttaagcataaagacaaagattgctctccactttcccccagtacctaaactgggaatcgctactcccagctcctacagctgccctaatgcagttcagagcagtgggcttggccttcagagctgcgtagaggaaagaatctcctcccagctcttccacctcccatggagaatggcccagtagagaccttgatgacaaaatgccttttgctaaggtgaggccacacaggagactagtgccttccatcagggataacagtgatgagcagaacaacgtaagtccctgattcattgcctggaaggtagagaggttttcagttttatgttcaaacacaagaaaatgcccatgtgtttatatgtgaatctctaaggaaaagattgaaaaaatcaacctcatcaccctgaatcaaagcagaaattgaggcatcccagctctgcccttgctgggtacataatgttgggtggtttcacctttttaaatcttagtttccccatctgaaaaagtgaagctgataattccagtgcataggtggctgtgatgatagaataagatcattttcagaatacttaacacagtggtatataataagtgcccaataatggtgctatcattacaatgattattatttacttggtgcctgttataactagaagtatagaatcatcaaatattagacatgctccagcctttcctcttaaagatgaggagcgtgagcccagagatgttaagtgatttgtacaacgtcacttccctggtaagtagcagaaccagagccagccctcaaggcaccgcctcccatgagatctatgatgaatgagcttgaactgcaacacaagccacagctcaagacttttaaaagaatgtaactccactttcttcccctggagactgggaaccaaatctgagcaagtaaccccccaccaagagcctgaagtggagaatgagggctgggccctgagggtcctccctgagcagagcgtctgcccaggaatcaaagcagtgaagtcaagtgacagaaactgctgatgttggggaagaagccactttgaaggccatatcttggctgactcagcctaaaagcgctagggtgtatttagacccctcaccccaaacctggagcttagtaatattcaaaaatgttggttgactcagaacaagaacattaaggctatctgacctctgaacttaggagtctttgagtcgatacgctggtctttcctggagaccttcgccagcctctgtttcctgacctgttctgagagctgccgtctgctccttgcagctcctgaatcactgatagaacatctgccaaggcttccttggccaaaggtctgccctaaagagcaaagatgtgtgtatgggcgagcacctcccctttctggtttaaggaggcctctcctcatgtgtcaagggctggccactctgaattggttgcccccgccccatgcagtgccaaagctggaatcagcttctgttggctgaccactcagaggcaacggtttccagtcagtgtcttgattagccaggaccgtagaatagtcacacacttactgggtgcagatgtagttgaccatgcagtcaaacacccacttattcatcagacttctgattaagctacacttccagaagcattcaaaaaggtctcactgctccatgaaattgactgtcacattaacagtcactagcattctctgtgtcaggctccgtgctcggcgtgttcgctagattcgctcagttaatgctcatggcaactcagtgagctggtgctattcctgtgtccattctacagagaaggcaagtgaagctcaccaggcaaaatgacctcaatcccagcaggtgagaaatgcaggatgcagagctgagcccaagcgatgtgaatccatcacttctatccctgacctctgtggtgtactctccccaaacccataggacgggttcatcccatgcttttaaatgacaggcgagaaatggagaggggaagagcagaagctgcagtaggaagggtgagaggagcgagcaggcaggcacagaagcaatcagcacagactgcgggaaacagccagcaggcacacagaatcccagcaggaagctgcgaaggcaaccgcccagaggcctgcagcagggctgggctgcttagcagagggaccggcagccctgcagatcttcatggcccttgaaagagagcaaagccactaactgaatagcactgcagtcttggagccttctgggactgggagaagtgggtgtgaaaccctgcattccaacaattaaggataatatgattttatagccctgcacagtaactcatcctcataaattatgtccttcagtcactaaggaaagattgaacggtgcttggtgtgttgtgcttgtgaaggtagagaagatgactccataaagcttccatttaaagtgtggaaattcagggctgcgcatggtggctcatgcctataatcccagtgttgggagactgaagcaagagaatcatgcgaagctaggagtttgagatcagcctgggcgacatagtgagaccctttctctacaaagaaaatattttttaattagctgggcttggtggcagcacctatagtcccaggtattcgggaagccgaggtgggaggatcacttgagtccaggagtttgaggctgcagtgagccatagtcatgccactgcactccagcctgggtgacagagcgagactctgtctctaaaagtaaaaaagaaaaaatttttaatggaaattcaaagacttttggccctgagagggttagacctcttctatctggatcatgcacacatccagaacacctatttctgatgaggccagataaagtcaatataaagaatagatattaaaggattttttcaaaatactttattatctgatggtcctcacattaaccctatgcaagacataggactggtgctcttatggataataatcagattatgattacttcccctcagaaagctcaatctccagtcgactagaataaagacaacggtgatgatgacattcttgaaattgcacttgaagctgtaatgaggtggaagcctctggactctggttgctttttgttttaagcgactgcaaacagagggcttgggaagtgcgcctccagttggcaagaggcccacgatttcttacataggtagtcatcccatcccttttcccactgggagatgggcatgtcttgtccccaaaaagcagaggacccgggaggtaggcattttacagccaggaagtatcgctggaccatggcccacagttaagacacagtatctgggaccagaagaaagcaataaaaggtcaggacacacgtgccttgtgggtgggagcagaagagatggcccaacatacacagtcatgttatggaatgtaacccttacatgttatggaatgtaacccttattcatgacggttacattccataaagtcaccacaaacatgaagtagtggacactgagacgttggtcctgaggaactacagagttgtttcctgtgagcctctgcccacattttgtcaaccaatcaatacataaccttgttttaagtgtgtttctatttaaagacaccttatttaatatatatgattgattcatgaacattaaactcctggccactagcaccgtaactcgcacctgcgtgaagcttatttaatgcacgtgttttctctgtgcagcacatcatagccctcctacgcatagtgacacaggacggcacttcagcattatgcttggggccattttaaacagcaaaatcaccaacaaaaagcacaaaaatgagaaaacatggcactaagtggacggtgaaaaggacacctcacagtatgagagctgaattgggaaggcagaactctacatgccccttgtttggcctcagcgggaacatgtagagtttttgtcatctgcacatgtccacagatgactgaaagtgccacgagtattgattctggagttacaaacacattttagtgagtaggcgcatttgtagatgtgggatccacaaataaggagcctgggtggtatcgatgatcaaagggcctagcacacctcaggctattggttggattccacacacaccgccctgtgcatgcttcacatcgctgagccctggcccctggctctccacaccacccctcatttttcatgttggccattgctggcgagagatgcagtcctgtctcgtgacaaatcccacagctgtgactgattgtcttgccggcttcagtccctgggcccagtgcagactgtcaggctggggctccatgtcttcattagctcagtccccagagcaggaacatggctggcatccaggcaaggagataaagagagccaggcactgccaccagcagatcctttaccgtgggaaaccttggctcatcttccatccagcctcaagcctgtctgtgcctcatactccatgggatccagccatgctccagatctgactaaagcccttctccatccctctcacactcccaaaacacatccttcctctatgaggaaaattatcttcaagccaggcagaatcaccagcatacctcgtgttctgtttctccccctgtaatgtttattttagatccccagaggccttggggtatagatggtgagcttcattccatgggactgttgctgtaaaacaggattgggccaattgtccctattccagttgagtcccagtcctattctcccaattccaaaagaaggatgggaaggtgttttgtaaccagaacttgaaccctctgcaaagtcactcaaaagagctgaagtgagcccttacaagggactgtgaagttcagccccttgcaactccaaacccaccccagaggggtgcaaatggaggtagacagaaagacagtcaagagaggaggccttgaaacatagtttttggagttgatttgcatagggagaaaaatgctatatgaggttactgtctccaggagcaagactaaggccccgaaggcttaaccaggtacaggggataagaggttaggaggagaggggatggcatctctctatgatcatccccagaagggaaggagcaaagtttccctcgccattgtgagctgtcaatctgtcccttttccctagcataaaagtccttgggaaaaaaatgaaggtacccactggttggcaggaagcccaagaaacagcaagtacaatccaattagaattggattcaatcaaatttaagaagaaaattcaatccaaaccagagcatcattaaggcagcagttgaagagaactggttagcttgacagcccccacattctcccaattaaaaagttccctaggccccaccccagccccaactccatctcaccataaagacggtgcatgctgaaattagtgctctcccaagtggcacaggccaaatgcaagcactaggcagtgcaggtagtgatggagctgccccacatgacagtagactcagaagcagagccctttgccctcttatggtttgtggtgctgtccctccttccatggtgcctttcctagagtgtggcttcagcaaaaaattctccaaggtgcttccagcagcctcgtgccctgaactgggccttcatgggtgagagaggaagacatcatggctccaagaattaaccaagatgtcctatgcatgtacacacacacacacacacacaaatacacacatacatgcaccaccaagggcctcattccccaaagactgcatatcaaaaccaaaaatactcccctatgcctattttgcaagaaaaggcacagacttgctttgagggttgagaattcactttgttgatgattgccttctcctgccagcctcctccttgctcagaaagtgaattcgaagtcagagagaaaattaggacagaatcatagaaaagaaatagttattgtgtcagaaatttttcaataggccattcttccagcaaatcccaccccagtttcaatttctactcattattactttaaatcaaatgcatcatttaacttttatatcatcttgattttatgtatttttctattctgattggatttctttaaaccaaaagggcagcccccaggacattttcttgtgtttggaatcttcatttgtcttcatgtgggagagaaccttctctagattagaaatccttccaggaatgctgagtggcaggttgagctcgtcataagaatagagattgaggacattaaatctcctgggtcccaaatcagtggtatactggtaaatatttaacaattggctctctatggggaaagccctggttttcagcatttgccagttaccatggtgtaaatattcccactgtggccgatctcaagctaccagcgagacatccctgaagccagagttgggaagagacatgaatgattggctctcaggacctggggcgagtgagtgggctttggtacactgccggtcctaaaaccttgtgtcacctggagacccttgggagaattttaaactaccactcaatactgggtgggatggaaatgcatgttctggaatggtggtggaggtttttagttactgcttggaacgagttcccaggtcttcggagaacagttattaaaaagcaaagcctgtgatcatgatccaggaaaagagggagatggacttcatccatccccttaagcctctcctggccagtgtcaggaatgtccccttactgacgcttcccatcgaggtgatagtagacctaacctaggctgactagcggagctgtctgtggaaagtaggggcgtgtgggcaggtttctccctgcaaagcaattaagactcttgtttctccttatctccatctctccttccatcctcgacccttctcggtgctccctccttctctgtgctctcctgccctgcccctcctctcactctcaccagagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacagtgagcagccgtcttcttctgtgtttgggctgggttctgggggagaggagacagcatcggggtcagcacagaactttgaccgccaccctttcttagaagcccacggggtgccttcctggagcagcagttatctcactgatggcagtcacttgctgcacacagacatcggtcacatgtgggaaatcatagctgtcgatctagaaaacctcatgctccttttagaatatttcaccttgaaagactgttgagattttgctaaggcagaggcttttttaaaatcagagatccttctcctccaggttccacctctttgggcaggggcacaggcttcccgtttgaaagcgcaggcttgtttaaaaggaacaatgtgtgccaagcagctgcctggaaaactttatacctgctcaggattccttccccctttgcagatttccatgcaccactgagctttctcataggaaaggtagtgaaaggttttccttaagggggttagattcaaagacctggggaagtgctaagtgggagtgttgggggaagcccagaggaattcggcagaatgcaattaggtgatggaagttgagccaattcccttccttgggggttcacgtggccccttgttggataggctgtggctgagatagaaatgaaagtgatggatgacattgactcacaaatacgtaaaaaatgacggatcatgaaaattcaggctcttaccagactagctccatggttctcaaagcatggccgctgaccagcagcgtcagcattacctggaaacttgttagaaatgcaaagtcttgggccccactccagatctattgacccagaaactgtgggaatggggcccaggaatctctgttttgacaactcccccaggtgatcaagatgcatagtaaatttgagaagctttgggttaactctaaccactctctatatctcatttggccttgatctctgtgactcgaatcatactctttctttctttttctgtgtgtgatatctttctctttcactatacatgtttgaataggtgcatttttgtcctctcaagcagccttacttaaaaacagtttcctaaacactgagcatctagagtactccacgaagcaaacaggttaaagagccatccagggcatttgctgcgtggagtcatgctggtaaagacagggaactggaacttcaccctgagcagagaggatgatgagaagagctgccaggagcagaaacaggtgcaggaagaaaggacgaagatagccaaagatgttcacgggagcagaatctctgctccctcatttcaaagatagctttaataaatctatcaactgctccctttctgataacgctgctcaaggagcaaatacaaaattaaagcacacaaacaacaagggactgttaacaacataatgtagtaacctaaggaggcctttgtgctccattaagtggttttgcaagttggaatacagggcctttgatggattataacaatgagggtcttcctggaaaaatgcctgacaccttctattacactgttgatggaactgaggagtagttgattagtttgtggcactgagtggtatggtaaataaataagttggcctgtgagccacggagaagcctacctctaaaatgcaggaatttgtatgctggctcctggctccaccctaagtcagagcactggtgctaccttgtgactgacggtgatgagcatttctgtagcgcgtgttattgaaaacctgcagtagccactacacgcttagcagccagtggttatccaccgagataacagaacgttgctattctgttctccgcctaaaacaggagcttccaagggagagtgtgctgcttctccatctaacccattaaatgaataaattgttaggagagttcccagcatggagtattatttgctgctggagcagatcacactgacaaggcccatctacccaaatttcttgacaaactttgagaagagcataatgagctgcctaacccaatagacagtctcgctaagattttcctaagcctagataaggatggccttagactctggagactggtttctctcaccttgcactgcttccttacggctggaggagccctgggggtctgtttcttgtcctaagaggactggagtgggagcctggctccttcattagtggaaatgctaattagtgggacagttccaggggatgaggcaggggaatgaatattttaaaaagcaagatgtagagagtaagatagacacatgcaatgaagtggaacgtgagagacaggagtggagctgggaagagactgtgtctgttggggaagtccaattaaaagtagaattgatgtgatgaaatgattaaggaatcagaggcctaattcacttgcaaaaaaggtaagacagtggctcagaaactatcttcctgtcttgagaatttcatagattgctctttgaaacaaatacaaggggagaaatcctgctacgtttgaagcatgtgtgtttcaattaccgtaatatcttagcctttgaaatttctaaaagactatagtatggtatgtttgccaattctcttcagctcaaaagccaagtcatcttttaagagaaaaggccgatcactcttcatcagcagctgtggtgactccgcttctcccctgggcagcatctggatgcccgtggtgtgaggctggggaggtggggctgagtgcagtgcaggagctgcttggtgacacccagcatatcttaggggagcccagggattctgtttccttagggaaagctgcaaaagccaccaaggagtagaaaaaatgggctggaaggacaacagaaagaaagcgtgcagttggggacatttctctaaatattagtgtaagtgaagtggcccgtaagttatatacaaaaatatgttccagttcattcattcattagtccacccatccacacatgaaaggtctgctctctgccaggcactgccatagacactggtgatagagcagtgaacaagggagtcaaaagtccctgccctcgtggaacttagattctagtagagagacaggtggtaaattaaatagcatgccagagaggggggaagcagtgaagggggaagagtgttgagaggttgtgattttaaggggtcagccaaggaatgtctcacgatcgaggcagcattggaataaagacgtggaggctggaaggaaaagcaccatgcagatagttgggaaaggagccttctagaggctagcgagaaggggccaatgagaaggggccacgctgatgaatccggagctgaggaggcttgtgcagctggagaggagggagtaagggggtgaatggtgtaaggtgaggctgtgggacccaaggagtagggtatataaactattgtgagaacttggctcttactgggagtgaaccaaagagcctctgggtatttaattgctattgagcagagaagcaacacgatctgacagacacttatcaggatccgtctgcctgccatgtgcagaatggaatgaaggtgggccagggagaggcaggggtcccgtcaggtgcctgctgcctcaggagatgctgggcctggtcttgacacccatggaagtgataaggtcagacttcaggatgatgtcatttgcagacgcgtcagatatgggatgtgagagagagaggtagggcattttccaaggcaattgtcctaaacgatggcaagaggggaattgtcatttatggatatggggaagtctgtgagaggaacgggtgtcagggcaggaggatcaggaaagccatctgagacctttaagtttgaagtgcctattaaacatccaggtggagatgttgagtatgtaataaggaatgaacctctccaggagagagatctgtggctgaactgtaatttgggaagtcaacaacatatagaagatacttaacccctggatctctggataagatcactggggtgtgagtgtagacagaagtgagatgctgtccaagaactgagtcctagccctactgatgtttggagattgggatacagggaaagaaccagcaaacaggactcctaaaggcatggccagagagacaggagggaatgcaaaggaaggggtgtgagcgttgctgctgtgactggaaactgaccattgggcttagcaatgtggggctcacttgctggtgccttaacacaggctgttggatgaaatgctggggagaaagcttcctggcaaatcagccttaccctgtgcatctctcgagtctgcatgcctcctgcaatggcatggagcgttgctctgcaggcttcttgcttctttggcatggcccagcttccagccatctgaagagtctggccatcaggaaaccagaaagaggagaggaggagactcacacagactctagcatgcccatggcctcaagacagtcagtgtctaaagcttagcccatcacgatgttcccttctacagcaatgccaatactagccactgcctctgcaatgggttacagtcttggaaaaaagaggacgtgatactcaagagccatttcagagccaaaaaggcaaaaaaggggcaagaaaggggcatgtttatgtactgttgccctggatgtggcttcctaagtggggcagccaagagccaagccccttttctctctgggtaaagactaggataatgttgaggtctccccactctagtgactgcttctcccctccctctgagcagcagtgagaagcccctgtgaagggacccattgcagaactgtcattagtgcagggttattgtcatcagcagagatgcactgctcaaagggacagggctcatcttccagctccgacgttaaatctaatagaaggtcagacactacagggagaagccataaagaaaaagagacagattctcttctttttcctcttcaagatgaaaaaacacatctattaaatatccatccttacaggaatctctctttcatgtcattaagacaacttaaatgcaccctggctctctaaagcttgcagttcaatacagacattgatgtggatgagcacgtaaacagacagacagacagtggaaccaaaatattgaatttccatgcagataagcaggattaaatatttaccccatggtatcgagttatgtgactcgggagccacttttgcagtcatcaccagctagcagagccacgtgcctgctgcctgcccaacagagtctaggatcacatattactgagacaggaaattggaaggcttgtaagagctgcaggttgcccacgatagggccccatgtggcttgagagcagtaacctgaatatcgctgatttacattattttatatgtgtcaagggcatgtacatagttatttgatctttaaaaaaaaatcagggccgggcgtggtggctcacgcctgtaatcccaacactttgggaggccgaggcgggtggatcatgaggtcaggagattgagaccatcctggctaacacagtgaaaccccgtctctactaaaaatacaaaaaattagccaggagcggtggcgggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaaaaaaaaatcagtacgatcagtatttatctagatctctcgatacctacaacacaatcccatgtcatggcacatacgagtcacacaaacacatgtgaagcatctggctcagattacatgagaagacatgccaatatttgtttttgtccttgattctgttcataccttgcactgttgagtgatcatgctgccaggccatgaagtgagagcagatccttaaggcagagcctggaagtagctcctgggccttcacgttaactcttagctggtcctaatcagagccctggaaactttagtgctggaaagttgctggagagatcaggtgaggaaactggagcccaaggtgggaaacagccacctgcctaaatgttactgaagtcagcactcaaacccagggctccagattccccatgcaggaccctgcccagcagaccacagtgctccttacagaaggcttcttggatacccaggcagcagcactccctaactgtccctctgtccccctagctcttggggcacatccccatttatcttgtggaattacatccacctctttacacttgcttgctgggctacactgagaggtccttcttggggctgcctttaattcaccgttgtgtccccatgacctgacacaggccagagcatgggaatgtcatggcacatatgagtcacacgaacacacgcaaacgcgagtgcatgccatatgccagttttggcaaagcaccttctgccatgctctaagctgttggaacaggtgagctcacactgcccctggactgagttggctcattgttctgtctgctcagaattgacttccttgtggcatcaccgatgacatcctttcaaagtcatttcctttcatgaacacggttgctttccaatagccctcagtcactctcaactcttggaaggcaccatttggaaacaggcgaataagcacagagccccccatacgtgtggacagtggcgatgacagggaaattgaagtgccgtgggaaagcattgggagttcttaagcaacgagattttgctgttccctgaagaccatggtggctagtggggctgtgtactggggctctgcagtgaaaccactgatggatatttctggttctggtagtcatgaatacccatgggcgaggtcctgtggacttggtgttgtgagaggcatctcacccaaagcggggcgtgggggccatgttgtagtaaggatccagaaggggtctgttcattggtagcacattacctttggagcacagcctggctgctgtgctatctggccccgtaagtgtacaaatgccattttcccagccaggggagcagtggaagagctatggaaaggctgtattgtgtatacagtgcgaagtaggcacgtcagcctgtttcagtgagctgtcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccatgacagtcttctcattgaccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcacaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgaccaatggccgtgtgcttcagaggagggaagccatgacagtcttctcattgaccaatggccgtgtgcttcataggagggaagccatgacagtcttctcattgaccaatggccgtgtgcttcataggagggaagccatgacagtcttctcattgcccaatggccgtgtgcttcagaggagggaagccatgacagtcttctcattgaccaatggccgtgtgcttcagaggagtgggaaggtgacagccacataacattttgacaggagacattcatagcttcctgggcctggcattagatcagcataaaggtgcctggcagctctgccaagccatcagctaataaaggctctgctccccttggggagacgcctacttgactttaggggagtgtccaggccaaaacgataaccttgataagccaacaaactccagaatccagatggctaggtttatggtggagaatattgtcaataccagctgagaaagacaccagaagaaggattcccacaccctttttagatacctgcctttgtattggtctacctttcactgtgtaacagctatggtaggaacagaggctgtgtggaggggcctatgagcagcaggggctgggtcgggtgttgtggaggccacactgtggttttggagggacaagagttaccagggagccaccgggacctctcctgcagtttaaagtggatgtggatagagagcagctgtgttcctgggatcgctggctagccagccaccctgcaggggcagagcaaacaggctgttagctcttgaactgccaggcacactgggggtccttggcagggtgtggagcatgaaggccctcttcctctccagggcctggaggacagcatcctctgcctgcccgccagggtcccagcccaaaccagcatcttccgagcccacttctctctccagaggcttcttcatcttcccagttccccaggatacaaagccgccttcctctttcctctcctgtgcccttccacagttatcagtgcctgcgttcagtcagtcaagtcgtatgggctgtcctcttcgcttcttcgcttggacttctcactccttccctcctctcccctcacctctctccgcctggactcgcagccaccttgctgccctgccttccagccccgttcccacgcaacctgtgtaatgcagccaagttcatatttctgcagccgactgtgtcactcccttgttcaaaagctttgaatgtgtctccatgggtacagaataaagcctgaacatctctcagtatttcaggcatctccaacctgtcccagccaatagcttgaaccttatcactccctactgccctgccgcaaagccagactgcatcttgttttccagaaacgcctgctgctgtcctgtttctgcacctttacccatctcccatccctctgcctacagcacctgtttcctcccctgctcctccgtggcctcctagcccaggtcgaagagcacgtcttggctcaggcctcccagagcccccatctcaggacaggcactgtcagcactcaaccctcacctacccaccagtcggtgggggtggcccagccgtcttgttatatagaaagctcttgggaggcagcagcgtgcattggtaacttcttattcactctcccactcagtatgtagggcaatgatttctatttcacagacttcccccaaaaacacataatgaattgaattgaattctcttcggatcagagaattaaggtctgatagccctatattcatacctagttggccaaataccatttttccagtcttagccatgctcatggtagcccccagagagtgtattgtggttgacagaatgggcagaaatgatttggcgttgagaaagtgggccgagaggaaagtttggaaggagttagaattatatagtcccaggagaagagaaagccgggagtcgacagaacagggacaaagctgcctcatgcccacatactccccgtaggaggggtcattgtttcactgtatggcgtcaacttttagattctgagtttggatcatggatacatttcagccctctggggctctcctgggctggggggcagaggaaggacaggggcagaggcatgagaggggatgtctttttcttgcatggaaggtgaagaaggcctggatggtctcctttcatcttgcccaagatcatctcacatgggtattgtttgccccattttgcagatgggaaaagtgaggctcggaaaagttaacgtattcacattgttcagcttgtaagttgcacagttatgtggccgttgctccctccgtaccatgctggtctctaccacaagccccctcacgaatgcccttctcttccaaccaggggaaccagaagtgggccctccagtcccccagccggaacagcctgtgaattttccttggttgttgcatttatcgcttcagcctaatatgcaaagcaggtggacggagaaaggaggaaaagagcggagatggggcgggagggcgggggcggtggtgctggtagtagggcatgggtttgatttttttttaagttgaactttatgattctgagaactctgtttgaagcatggaaagaagttatggcattatcttgctcacggaaagaaaaagcgaactgaggtcaagcgccatccctttggaatggtttaagaggcagttttgtttggaaggagatgtgtcaattccgtgacctatccgatttccttcagttcagggttccttgggactggcttagaggagggtgttgatcagccacaatgctctggggatgggagttctagcttaccactttcctgccttggcaagtacggtgtgaggaatgtcatggaaccgcctctgatgattctgggctgtgcagtgctacagcgtcatcacttctgagtctctgatcccaggaacctcagcactatggggccccgggggggatcactgacacgtggtgtctttggagaagtcctgtcacctacctaaagccacgggtcgctttaagaatggatctgcctgtgtccacttggccttgcccagagtaggcactcagtaaagagctgatttgactttaatttggtgctttgcaaatcgatctatacacttgggcgttaaagtagctcagcagagggatggaaggggagatgaatcatcctgagtttccctttgatccattttctccaataaccagtgctcagccccgaaacagagctgcctacactacagttacccttgcctccctcacccactccacgcttccttctctgtaaacagtgggggtaagaagctcatgccgcatcaagatatcttaactgtcagaggctatcagtggaggggagagtgacagctccagcctttctcactacttgctgatgtggaaaattatcatccagtaatggagggagattagccacgtattgtatttccatcgtcgggtgcatggcatgggaggatgatttatagaactggaaccctgaagctagtggaaaggtcacagaaagtggaatcattggcctcaacacagtggctagtgtctgagggaacctcctagagccacatgcatgccaggccatcctgagtgcttgagagagacatgggcacattaacacacatttaagtcccaacagggcacccagaatactaagataaatagacaccgtctctgtcctaaggggaattacagcctagttcaggagacagatgcaccaacagacaggtgacagtgatgaattgcagtcatgaaccaggggctggagaaacacagaagacagagagcagagtttggaagagggtgggagggactgcctgccccaagaaggattcatgaaggtgccatgtcagtcagggttggtggaccattgtaataagcagcccccaaatgaaatctcagttgcttagtacagtaaaggttacttttcaccccacggtggagtgtgagctggggatgggagggaggagagttccaccacaccggtcttcaggccccaaggctgcaccccttttgtggctttgccacccccggggcctcacagtctcccctgtctgctctgcatcgggccagcagaagagggagcagagggcctgctggaggcttcagcagccaggcctgggagtgtgggcattgctcgcgacacaccatcggccggaacacagctcccacttccgcctgacttccaggggactggcgaagagcagctaactaagtgctcgggggcagaaggactggggctgggtgggcacaggacagtgttcctgctgcagtttggcagcaggtcacacggccaaaagatcgcaaccggaccttctaagctgagggggctacatttgcaaagttgtagaagcaaaataatttttaaaagaaggaaaggaaatggaattgcacatgtttcatggtgatttgagttcagggtgcacaggggagaagccaaaaagaaagatcaggacagaaagactgggacctggtcccaaagggcctcggagtgggactctatcctgtggttaaggaggagccaccgaagagatttaagcagagggatgacaaggtaccagtttaccatcgaaaggtcactgtgcagccgagtgtggacaatgggctggaaggagagagaagctggaggcggagtgggggtcagtcagaggctgataaggcctgagtgggagtggacaggcggggaaggattggaaagagcctgcatccactgggatagggtcctaagggctggcaggccctgaacacctatcctggaggctccaggataaacaccttgtgcttttcagcctcaggaatgatggaggaggttgtgcagtgccatgcccctctgaggggctcttcctgggagttggtttgtcctgcctgctccttggtgggatccctgccatgaccctctgccccttggcattccaaggcctgtttaatacccatgaccataaacacacccacaagcagtccccttaccctaaaaggtgccacatggagaattccaagcaactcagcctattaaatccttgcctgcatgattaaatgcctcctggggaaaaagtcgagtaacaaccccaaacataggctttgatggctccatccttcaggattacttcaccaaatggaaatactcatgcctctggtgacagctgcagtgtttccagaagagatttctaccctcatataataggagagactttgtcctcttaaataactatgatacctgctgtaagtactgaactgttaatcaccgtgatcactttgtgtcgatgccacactgctagagggacagaactgaagccttgccagaaacaacagagaatctgctcaaagagttgcctaatgaaaagggtggtctgttggggagatagatggaattcttcaaaatagaaggcaattggcagcgttaggctggggtgagggtcaggagaagaggggcagctggggagagaagggctggctcatttatgtcttactttctttctatatcctggtaccaggtgctggattccttatttagccatgtggttagctccatcgccatccaaaaattacggaattctaaaaccctggggcataaagggggctccaggtccctgagtctgtcctcattccctgggcttaatcatgcatcccccgaaccacaccctaccccatgtgggggctgttggcccaaagacaagtgtctgtgctgctattccagggccttgtcacatcacactggagtgaccacctcccagctgacagtgctcccggattccgtttcttttagagatatgagcaggtttcaacactgtctctggaaaaatcacaggacatgctcaaaggtagcatcatgggaacagggcaagggccttccacaacagaacaggaagttgtattcatttccaaacacctggctttgagccgaaacttgcactttactgataaggccataaactctcctcctcctgcacccagtttgattcaccagcagggcccacacatgtggtgccatccagagtcatccctcctcaaaggaaatgatgggcaagaaacgtgtttgcacaagagtctctaaacacagcccatgaatgaatggtctccggtgaaggtagactggagtgatagagtagcatgttcacttctacatggcgctgcagagagcctaagaagagaatgaataaagaaaagtgtagccatttactcagtcataaaaatacacgtccattgcaatttagaattaatacagattagttcctccgactgaagaaaagtaaccccagcaaagatctgcagggccgagccactggacagaagagctttgataagagaaatttaaaggtttatgctttctaaatagatacatttgaattttgataaaagagaaatttaaaggtttatcctttctgaatatatatatttgaattttgataaagttattcagtgttttgttttattctacaagaaagtaaggatattaagacattttaaaaatgtctgggcagaggagcccttgctgttccctaaatcatgttctaaaaccttatttgctaagcctgagtctggttttgactaacatggcccaagtcttactctaagaacttcaatagtgccttgtgtgcaggatcacagtgtataaagattagaggtcaagcgaagacaaaccgcaggccagcactgttaaagaatgattacaactgtgctgggacttgtttgtgtcttttgcttgaagtaatagactagatctactctcaacaacttactgatgaagttgaaaagccttaattatttgcttgacaggctagctttaaaggaaaaagcctttgtttaccttctcaatttcaagcttcaaatcagcctgtccaaccattgtatctcatgtccatgactcatgagatatgataatggtgtccactgtcagttattatgttaacaaaattatctgaaaataaccaaatgcacacctactaacacatgcacacacaccaaacacaggagcaagaagaaattaaggactcctttcttgtcaggaatattcagaattagagtctcaatgaatttactaatattcgctaaggtcagctgggtccagctttgagtaaaaagcttggcatgatgcttgctatgcctggcagaggcagagaaaaagatccctgctgtccccacaggggagagcatctgcttgacatgaaaaagtaatgtcagtggtgggtcccagccccttggaccacttctgcattgactaggaagctaaggggtcagttgctaaccatcaggccgagcatcctaggttttcatcaagaagatcccaagcttcaataaaaactgcagagtttcttcttgtacctcttagatggtatacaatcatgtccatgaattataatttccataatcccttagtaaactaattctattaatctattaagtcctaccccttgattagatgagttgagaatacagcaatctgggatgaatgaccctcatgttcctctcccaacaggatgccagagtttttagtctgaacaattgtcgtgtgctatacaggaactaacaggagccagagaaaagcaggcagccagacttcacggccccacttgatagccagtctgcagttggcctctcccagtttccttgcttgtaaaatgacgggggttaggtcagtaaaagccccttccagctttggaatttgtttctgtagttctcagttgacacacgttagctttagctccaggagcctgggccaaacctgatcatttcagtccatcagaccccagaggaattcagttgattctagcttcttaagtcctcagactcctggaattgcacttttcctcctgcaggattgcctgcaccctgaaagccagcccgttcttccaacgatcctctgcacacttgtgcacaccctgatctctgcacggaaagcccagccccaccatctgccttccgaactgccatgttaccaggccaggcttgccctacccatcatgccatgtgccaatcacggagacacaagttttgcagcggagaaagcgtttgttcacaaggcagccaagcaaggagatggaagagcaggtctcagatccacttccccaaagatggggttttagggatatttatgggatagaggagcaaggtccaaggcatggggaaaggtgattgggggtaaggaaaagtgaggccgtcggttatctgcgcaagtatagtcaagcttcacagctcttcctgggattcaagttcacaaaatggcatcgttagcgtgatctgaggatggatgtttgggccctctgatgccaaaaggtcgcccattggacactcacgcaggcccagttggaggattagtggtctgagctagcttgaactggacaagagctgaccccaagctcttgaaaaatgacttaagcaaccattatcatggtgacttatacatcagagatgttatctgtaaggaggcttgtagaagtttagttacatattccttaactacatgacttttagctgcatatgttttaaaatcaactagaaaccagtgaggcaagttaggtttggtgacctcattaggttagcccttggtttcaccaccccaccttcaaagccccatcaaccatcccttccttttctgccttttctatcctcaccacctcttctccccagcagggtcttacccgctccttcatgctcccagaaaccccattccacagctgcatcatagtacttattgtatgtgatctgtagtgtctccctgtctgctgtattcattgcattttatctgtggcattcatctatctgataccgtctgctgggtagtacatcttgaatgtggggacttttgtattaccagaatcccatacagatcctggtgcataggcaatcaatgaatattggttggaaaagggtttggaaattgggggataaaagtagggtcttggcttggaagtccttggaattctgcctctgggaatggatcacttaggcctgctttgtcactttgtcagatctaaaacgaggttgggccagatctgatccagcagaggatatgtaattaaccaggcacataaattaatttttaatcttccattccttgcctgtcaacatttctttttcacttctcaaggaggacatgattatcccatgatgtttttcttcatgtactaatttctcctcctctttcttcttcaaacctgtccacggaagtgtcagaaatacttctcattttatcctttctcaggaaggccagctagccagctaagaatagcagtcaggaaatggttaagagaataccaagaataaattctgagttgcttctttacaactagaaagctgaatacatttaaggcttgaaaggtcaactcccttcaaagggggcagaggtttgatttcgtccattatgtggtcttcagcacaatgctcatttcattcactggctgcaatggagatttatggagtaaatgttatcacaagctgagacttaatgagaactcagctgtatctcctggatgtagtggaaagcaaccattttggtaataaatagagaacagcatctaatttgtaaattcctttttccgttgctaagtttaatcagatcagtgaaactgaagggaattgttgatgaccaaaaattattttccatgccttaatctggccaggaaacattactcctaatggaaatggcctgttgctctggcgatggaaggggatgacatttgtcattagactaacccaattgttgcatattgataaatatgtttaggccaaaatctatttaaaacccaatagaagctgaggccccatgttgccctggtactggtgttactggttcctagaagtaaaaactctttccagttaaactacagagatctgtagcagtggccatcctaaagatttcttcttgccctcagtgatcatccagagcaaggccagaaggaccatgatggagcccaaattgtggtcataagtgaccttttctgaatggcagagagtgggttcagagaacagaacacaatctctggcagggccttggcttactttagggttaaaacaaattcaagggggcacaaaagggagttgaatgcagctctcttttttccagcggtgcttcagtttttttcgtgatgaatcataaagatcatttccaggatagggaccatgccatgggtaagtgaccgttaacacgcagtaggaactttatgaatactgcatgacgagaatgacagcaatgaggaacacatctgagaagctgatggccccagagggaacacggctaactgtgacatctttagggggtggccctgagaatgctgtatcccttccagtaagagtaccgcctccaggcgacctttagacgcacagcaaggggtcccgaggacattcttctcttggcctgcacttgcttttatattcatgtgcttttgtatacatgcccagtgtccaggcatcctacacactcagagctctaatactgaatattaggaacgacagctactgctcatcaagcacctccttttgcccatattatctttgccctcacttcacattttcagatgagaaaagtgaggttcagatcattggcctgaggccagttcgctaacaggaggtttacccaggcttacacccaggcacgccccatctgactcgaaagccttccctctttctcttttgtcagagaggcaagcacatggtaaccccccagaatcatgagcctggtgataggagaagtggagtggaaagaagccctagaaagggagtatggagacctggttcctagtcccagctctgatactaactggccctgtaacctaaacaaccctttcctctctgggcctcaatttcctcataggtaaaagtaatacccaaaggatctctaattgtctgttaatctttctgcattccaatccccttgaagccccatccagccctgtctttctcttggagtttcacattccagaacaagtctgtggctaagctgaggagaggatgccctcattttgcaaagagacgcttctcccatcttggccaggcagcagaggtcacaagagaggaagtgtccactgcataaggactctggacagcttctctgccagcacgcatccagcagctgactctttcctcggggcccacgctctcctgcccttttcccagagccactaccctgacaatgtctgtctaccttgagagcactgaacagtagaacctcagtgccgggaggtgtcctgaggttctctccttctctcccgtcatccccacctatgtgtgaaactcctctacaacaccttcactacggagtctctccaccctgcttcttacacactctccgtgtaggaacttaccagtcacaaaaaacccttccatctttgtgcaagcctcagctgctggaaggtcttccagctgacacctgcagctattgagtgacagtggaaagacagtgtcctgggtgcagtggcatcctcccgatggtgtggtgaattatcctggcatggttaattactcacactaattgcttttctgtcactgcgctccctcctgcctcctatgtttccatgaggggttgtgcttttgagatcttttcccacctcttctccctttgtcctcccagtgactctgagggaagcgctgagctgctacaccatgttccttctcaaccaaggagccagcactgagcagagaggagctcttgcctcttgcctctggcccaggcaggcatcagggatctctctgtctctctctgtctgcctctctccctcccacccctcgacacagtccttccttcctctctgacatctgtgcttggtcactcccatctgcaagaaggcccgctcccccacagtattattgagatagtaacaggccactgtctcctctctgctttccccaaatcaggcacatcccaacttcaccatccaggtagttgttactcttgtaatgtaagcagcaaaagcgatagagcagcttgaagctgcccagggcccatgttctggctggacaggcccaccgatgcctgtgttcacacagcccacactgcccgacactcccactcctcaccccaagagccttcctgtgttccatccaccaggaccaggactccatccccaaatcagaacctctgtgtcctttccttccttccaggtttcctgggccactgagcctgcagcatgaatcctcctagaatttaagactcagaaggagacaggtcacggagaggtagcagtgtaccccaggcagtcgggcccaggtgagcccaaggtcaggcctcacatttcaagtcgatttcaggatcattaacattcccacttcctgtcatgcccccaggccttttgcttgttgaagacagtggtccctgttctctggatttcaaaaaccatttctctcttctgaaggaagaacaatcagcgtccccaacaagcccagctctcctgagaaattacagaatagttctaagattcgggcaaagagggaggagggatgaagggtgaagaaggcctttgattcagactcagccttgagaggaaggatctggagggagaggctgttcagtggaataatgagagtgacagaggcaggcgttcatccccgtctgttctttttgcacttttggtttggggtcggtttctccttcaatgtgcttggcttagagctgccccagctgctgtgggcatgaaaaccactgctcaccagtctccacatcttggcccttacccaaaataacccaggagggaggaaggagctcatgggtgggtggctggataaatggctccagaataatggatcaaacattgaatgagtgaaggagtacacaccccgtcccttggccccaagatgctcattcatacccctctctgagcgtgaaggagaaacagcaaaagctgaatttggggtgtgtgccccagtgccagccagtctttccagggtgcttccgatgcctccagtggaagtccccagccatgttccctccctggggcattcccatctgccctcccagggaaggctgcttggtgcagcagaggtgtgctctctgggagcttcggtggagaggaaaggacaggggagtcaggatacgagggctggtggagtctgccaggtggggctagggcagcctcgctcttccttgtcccaggagcacatgtcaaaagcgccagggctggggaagcagcagggagcagaggctggagaaggcctgcgtccctgtcccggttctgctctcggcagcctcagttttctcatctccacctgtggctggagacgccttccccagtagtctccccaggttgttgggagcatgaaatgaggtgctgtcatgtgagcgcttgaacagccacactgctggactctcctaatgaacgagcaaagaaccatatgtgtcagcacaccaagctacatggcacaaatagtaaatgcctcagggaaaaggaccattctgggatgccacgtaggtcaaggaggcttcatggagatggtcggagttggagggtaggtaggaaggcttttgtgcatgtgggggagtggtggggatggaattccaagagtggggcagcagggcaaagacccagacacaggcgcacagctcccagcaagcgccctggatgcattaagccctccatcagtggtgtcaaagcaagaggaaccgtgtgtggcatattctggaggcagagagtaggactgagtgcatggatcagagggcgaatgctggaaagggaaggtgtagttagatgggtagagtgaaagcggattgccaagggccctgggagccaggacaagggtcccgtgtgctgagtgatagtgatgtgacatggtgaagtccctgctgagaaagactcctccagaagatgagagaattacgtgtgggcttcaagcccctctctctctgtgccgagagtccccttacaaccaacaacttaactgtttcatccaatcaacccactcctttcttgtagagcttaatttttttttccaaggcaaagaaatcttagagatctcctctcaaccttcacctcccccacccctgcagcaaatgcttatccaggctttgcctggaaacttctactaatgagcaagtcctcatctctccagatagccaggccatttgggaaatgtttcatccattagggcacgatcttcccctgcagttctccttctttagtgcagtgccctctaaaactactctgggcaggtgctgtcttcctcctgtggaaaaaaacttcatatgttggaaggtggtggcgaggtctcttaggttctccttatctaaattaaacctttccattttttcttctactgttctctataagtgacacaacatgacttactggcccttccccatcaaagaactctattattgccccctttagacatgatcctgagcactgaacctctatcctaagggggcctgcctgatacatgggagagggaagccctgcctccctgggtctttgcctgtagcagtgagcctagaaatgcatgaagccgcaggacctctcacaaaagatgtgggcaattaaagcagctagagccgggcacggtggctcacgcctatcatcccagcactttgggaggccgaggcgggcagatcacgaggtcaggagattgagaccatcctggctaacacagtgaaaccccatccctactaaaaatacaaaaaattagccaggcatggtgctgggcgcctatagtcccagctacttgggaggctgaggcaggagaatgacatgaacctggggagtggagcttgcagtgagctgagatcgcaccactgcactccagcctggacaacagagtgaggccctgtctcaaaaaaagaaaaagaaaaagcagccagaggcccggcatggtggctcccgcctgcaatcccagcactttgggagggcgaggtgggatgatcgcttgatcccaggacttcaagaccagtctgggcaatgtagtgaaaccccatctctattaaaaaaaaaaaacaaaataattagctgggtgtggttgtgtgggcctgtaatcctagctacttgggaggctgaggcaggagggtcacttgaacccgggagttttaggctgctgcaagctgtgatcacaccagtgcactccagcctgggtgacagagcaagaccctgtctaaaaaaaaaaaaaaaaaaaaaaaaaaaaacctaaaactaaaacaacacataaagtagccagatggaccaaagactctgtctgccccagggcaagaaagaggaaaacaaactgcaagcatccagcaggcagagttgggagaagaattaaagcaaaggacacgctacatagcagggcaagctgatcgatattctgacagctgcccataaactcattcatgaaattatggggctgaagagacaccatggggttggagttaaaatgactcacttcacataaatgtcatcaatggcggcagcctagaaatttaaggcagcaatttacttgcctgctggaagggaagacacaaatgagacctgtctgaggaagtcttgctccatactcaaggcggctttccctctgtggctgttcacggccttcaaggtagtgctgggcccctgtagatcctccttgcaggaaatctgacctgctcttcagcagcagaaagcagtgaagcaggaaagacggggccccagagaagagagaaaatgagaacaaatcgtgagctctgcatagctttgtgaacggcaaagaacagggtgcaaacgtcaaaactcatccatagtaaaactctgacttccgtacaggagagggagcctggggcctgtgtccatccttgatacttttctgaccaagggtgggctcctggcctctccgtgatgtgcatcaatggtgagtgagaaagggaggcagcactgatggtggaaagaggttcaaaactctaccactatctgcctctgcgactctggacaagctgatgaccctctctggaccttaacattctcacctatacaatgaagggctaggtggggcacagtagctcatgcctgtaatcccaacattttggaaggctgaggtgggaagattgcttgaggccaggagttcgagaccaacctgggcaacatagtgagaccttgtctctacaaaaaatttaaaaattagccatgcatggtggtgcatgcctgtggtcccagctactctcaaggttgtggtgggaggatcacttgagactgggagctggaggctgcggtgagccaagatcatgtcactacactccagcctgggcaacagagtgaaactctgtttcagaaaaaataaaaataaaaaatcaaatgaagggctggcctacaatcctacagaccccttctgactgtgatgatgtcatgattaagatctccatttcacactggggaaaccgagccacagaagagtgaggtcacatagctccaagtggcagagccaggatccaaactcaggcccctggcccccaagcccatgctcctaaccacgctgcctgctgactgcttccttctgcccagaggagccggcagggaggccctgggcagggtcataaaataagtggcttctccccaggaccaccacctgcacccactgccctcctcctccacttagtgatgccagcacatcctcagggctctcttacccttgctctcccatgacagataggaaaaggctttataaattcatcaatagacattctagctaagaggatggacttggcatcagatctacccgggttcaaatcctgaatcttattggcgcttgcttggagtaaacgactgaattttctaagcctcaattttctcatccaaaaaatggggacatctaatgcctccctcatagggttacctcagttaatgtatgtaaaattcatggaagagtagctggcatatagtgagtgattgagagactgagctttgttgttaatatgaagatagaaatggctgatgttgctattgcacactctgggagacaaggccttaaaatcaaggaatggccattaggtgtcatggaaccgggttggaggaggattgggggtgcaaatcatactctatccctttccaatcataccacgtgggtgaccatctggcatgtggcacttagcacttaaaaggacaccactaatgtccttttagtagtgagaactgggtttccaaaggagtgctctagagaaagaccaccacactccatgtctagaagatccctgtcccatccctaatggttgcaggcaagctgtgttttccccttggagtgtctcgccctcctgtgtggtcagatagcctgttttccccatagtccccgagggtctgagcatgtcccaggctgccctgccatctctagtgaaggtggggtgggggtgggagagggagtgtgccaaagttcaagagtttgttgggtgcagctaaacttactgcccctgccccctcccggccccatccacctccccgccaacccggcagcaataaccaaggcagcctgatagactccgtggtgccctaatggtggagagagattttctgcttgggagcacaggatgtttatggcctgctgagatcacagtaaccctggctttcttctttggattatggctgcagatcaagggcaggcatttatgcctcctcccagtttatagcagtgatcataattatggtgatggcagagcgcacttctattgtgcctttttaataaggccactttgtttggcttcttaatatttaatcctgttttatatttactttctgatggcttaaaatcaaccaggctttaattgcttatgcagaggaagccaagctgggcctgggctggcaggaagttgttgagaaggttctggaagctgatggcacctttctctgtgacctttccacccaggcaggctgctgtggcctgggaactgtgtttctttttctcttctctttttctctcatccactctttcctcttattctacaaccttcttttctcttttgccattcctttcctttcttttccttagaagagatcctcagttcaccctccggttcaatttatccatgtaagagaccagagttgtactgtgacctgccaaagctttggagctacttagggcaaggccaaggcgaggactgtctttgttgtttttcctggactcacagtattagagactcctaagactccaaactgggcaaacacatatgaagagttccttcatctatccacttgacaatacatatggccacgtgcttgatctatccaacggtagaaaagtcataaggaataactttccaagttattgttttctgaaagagaaaattaaatcagatgaaacatgccgtgccacagttcctcaattcctgggaagtaacacagcccagttgctcaggtctattctgcggtggggctggagcaaccctgctacaggcccctgcaccaccagctctcagcagcagtccagcctgcaaatgtgcatttcagcgacgtcgcctgatggggctgaaaaaggcctggactcaagacctgtcattctctgccatttactagctctccccttgggcacctaacttcagcctttggggactacactttcttttgtcagtggggataataatatctaccttgcctgtgccgtaggggtatgtcggtcagtgtccccatggaaacagtaggtactcttaaactaggtgacttgaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctgttaccggtaaaggctggaggaacaaagtgaggggcagcctcagagtcagagagcagctatgtggagagggccatggggcagacatgtggccttgggcagcaagaagcagccagtctacaccaaccctgtgtgctgcagttggggagcgaacgccccacctctctctcctcgggtccacccacggacgtcctgctagtgctgcccatgggccggcccaagcaggaagcaaggtcagcttcctggagcaccaggcctggggagagggaaggagagtgggtctgaggacagactctcaactgtccggcacctaggagtccccttaaaaccccatgatgatatgaagtgttattctagggagagggtgaaaccaaaacacagatccaggtttttacttaaaattctcaccgactccggagtcacaggagctcagaagaggagactcggtgggcaggagggtggtcctgggagctgccacagatgcgaactgggcctctgagaagggatgaaatttggatagatcaggggtcagctaactttttctagaaagggccagagagtcaatatcaaaggctttgcaggccacacagagcctctaccgaaactcctcccctccactgctgtggtgtgagagcggtgatagacagcacacacagggcacggcagtcccaggaggactgtgctgacaaagacagggcaggctgcagttcgctgacccctggaatacgtgcaggaggtggacaggcactccagggacagggcatgacgtagggccccatgcacgggaaagaccagaggttggtacggagccagcacgttgaaggatggtgaggagggcagcccggtgtggttggagtttctgcaggaagtctcaggacatgagagagaaccgacagtgtcttagtcggccagggctgcccaacagcgtatcacagacccaggagctggaacagcaggagctgattttatcagtctagaggctggaagtctgagatcaaggtgctggcgggcttggttcctcctgagggtcatgagggaaaaggggtcagtccccaggcctctctttggcttgcaggtggctgtcttgtctctgagtcttcacatcgtcttccctctgtacctgtcagtggccacagttgttctgcttataaggatccggtcacactggattcagcccaccctcatgacctcatcttaatctaatgacctctttcaagactctgtctccaaacatggctacgctcagaggtatgcgggggctgggacctcagcatctgaatttccgaggggatataactcaactcacagcagataagatgaagccaaattacagggtgttttagataccagattggagtcaatgaggtaggaaatgaggaatccttttgcttgttaaccgtaagtctgattagtactttgagaaaataaatacaaattatgccgctcatatgcaaaaaatgtaataagatgggcacctggccaagtacatggcaaagtcaattccttagttccatcctggagtgccgggaagcctggacactggatcccagcagactggtgacctggactcagccattggccttgtatgacatcccaccacactggagaagtttgggtggggcaagcagtgctcccgatacccccagccactgcctgggatgtctgggcctgaggcatcaaccctcttcctcccggaggaggcataagattgacagcagctggtgagctctctggccttggataacgagctaccagctaagttccggaatacacactgggcatttttcttagcaaatctcatgagaggccagccactcctgctgacaggcacatcaggacattacaaagctccatccctgggacaaagtcgaagctattttgggtgaccaaaggtttcggaactaggcagattgtttcatctcgccccacatccatccctcattctctcatgtggagctttgctctggtgccactcagtcagtcatgacgcataaaaagctccgagacgggggcctcaggaacaggccggatattctctatgaggatggttctccccatcctcctgccagtctcaggatgggaaggaagggagtcaggatgtggcagggaggaaggaaacgagagtacagcagcgggcaccaaagaggattttgctcattgtttccttcgtggatttattgctgtcaccttagtgccatttttcttttttatcaaaactaaagtggttctgactctcaatcctttgccaaaaccccttctggagtcattttttattcatgaggatgactttggtcatctttggacacatcatgctggcctcatggtggctaaatgagacccaatttctttttaaggagaacatgagtgttcacacgctgacacagcctgcggcagattcactacttggagacttgctttcagcaatacagggaactgtcaagagagccattcgttttacagagagctcacttcctatggggaaagtgaggcttgtgtgctctgacattgcccattttttgttgaccacagctgtaagaagcctggcccgctgatcagtgcagccatactttcaaagcaccacctggtgtttaatggaggattcccaaatttcagcgagtaaaccctcagagggtttgctaacccaaacaccaaggaagggcaatctacacaatggcttagctctagcactcctcccctagcacagctggtgtgcttccagtttcaagagattattccagggagaaaatgactttttataatctccccagtagtcacacaccaaagcaggtcgggggagacactggtgctgtaagacaataactgggcacctctcttgagacatagaaatagtcctactaagtgctgttcaagcaagagtggccaccaagagtacatgtttgtggggttgaggggagaagacattaattaaaggatgtaatcagttgttggcaattcgaccatacaacttgctgtagccattgatgatattactaaaaatgcaatgatgttagccatcttgagctaccagccaagttccagaatacagactggtcattttcttagcaaatctcttgagaggccagccactcctgctggcagatgtttcttgcactttcaaagaaacctcattttcttgtggagtcttctcaccagaagcaagggactggatagcccagagaaacacatttggtccatagcacctggtaagagggaggttagaaaatcggaaaacaagcttcctgtatagctttcttccccagcattctccttcccagatccattcaataaagcatattgtgccttataaaggatgtgctattatgacattgcctgcagatgagcagacaatcaaacttcacttctaaggaagtgaagcaagttggctttagagaaaaggtgccccttagtttccaaccaactcatcatttgaatggccaagggaggggtcaggctttccatctcatccactgaataagtatccagcattcatgattctaaactttcaacaatttggacattcagcttcctagaagttttccttgaggaatcagctttgataccactatgtaatcccttggtaataggaacacaaacaccatttcaccatttgattcctgcaggtgcttatgggataaactatcgcaaattaataggcactaatgtgttcatatattgcttcttccaggtgagacatttttatttcagaaaggaacctttagatatatgcagtgccccaaaagaaagatctgagacttatgtgaaccatccagggagatgatttagttgctcttcagatcattttccatgcaggtgactgccaacttggcccccatgaaagaccagccctggtcaaattcaggttcataaaatgatcatacagttacttctgaaattggacaacataggacacttaggatgtcagagccaaaagctgaataatgcttctgcatggaaggcgtcaatgttctggactctccaccactaagcagggctctcatcccctcagacagccaccacacagatagaaacttggtgactggcagcctacgtccaccccctatatctccagaaagaaagaccattcattatgagagtcccatgttagtgactgtttgagacacctttccctagaagggaaacttgaaccaagtggctcatttcagctcctaactctcagtgctttttgcatgtaggatttctgagaagtgaaaaaaaaaaaaaaacctgccggttatgaagtttctgttccacactttgtaccttaaagatgagtgtgtgagacacagatcttcaggttaaaaataggcatggcccttttctatcactagccagtctccaaaattctccttaccaggcaacatccaaggaagtccattgactataatctgtgttctaggataagaggatgaaatatagaaaaacctaagatttgggttgcccctcccctcatgcctttcctggaagtgatggtgcagcccacaagttcagcagggcacatgtttccttctgtgagtggtgaccaacttcccacctgcatttgctgccactcattaatattaggttggtgcaaaagaaattgtggtttcagactgtgaattttaaatcattataactaggctcaaacacatctttattaatcaaaagaggaaccattacaatcaacacatttttgccaacaagaaataagatttttattcctattatgtaaaactccgtgcttccagattcagcaaactctcggaaagcattttctgcatcctgctggttgtgaaagcattttccctgcaaaaagtcgagatgcttgaagaagtggtagttggttggcgagaggtcgggtgaatatgggcagatgaggcaaaactttgtagcccaattcgttcaacttttgaagcattggttgtgcgacatgcagtcctgcattgttgtggaaaagaattgagccctttctgttggccaatgccagctgcaggcattgcagtttttggtgcatctcattgatttgctgagcatacttcttagatgtaatggtttcgctgggattcagaaagctgtagtgaatcatactaacagaccactaaacagtgatcatgaccttttttggtgtaagtttggctttgggaagtgctttggagcttcttctccatccaacccctgagctggtcgttgctggttgttacacaaaatccacttttcctcacacatcacaatttgattgagaaatagttcattgttgttgagtacaataagagaaggtgacacttcaaaacaatgatttttttttttttttttgctcagctcatgaggcacccacttatcaagctttttcacctttccaataagcttcaaatgcctaacaaccatagaatggttgacattgagttattcggcaaattctcttgtagttgtaagaggatcggctttgatggtggctctcaattggtcatcgtcaacttcccatggcctgccattatgctcctcatcttcttcattatgctcctcatcttctttgcaaaaccttttgaaccaccactgtgccgtacgttcgttagcaattcctgggccaaatgagctgttgatgttgcaagttgtctccactgctttatgacccaaatcgctcgaatttgctctttaacatcctttccatagtctaaaataaacataaaataaatagcaagtaatacatcattaacaaaaaaataaagtgagaaatgcccattaaaatgatgtataacataaccaaatttatttaagaatgtatttcaataccaaatggcaaattccaacaatgcaaaaaacacaattccttttgcaccaacctaacttgtgattgtgccttacttgcctctcattcccagcaccctgcatagtgacctcgcagaggcacagctcatgccagttctttcagatgaaatgggaaaactctatctgaacagttagctaaagcacttgacatccagaactccaagtccatacataacttcccgttccccatgcaatgattagtgtcttcatgctctccagtgcagtggctggtgtcttcacatgcttccatgtagtagctggaatcttcacattctcccgtgcagtggctggtgtcttcacactcttccgtgcagtagctggtatcttcacactcttctgtgcagtggctggtgtcttcctgctctcccatgcagtggcttgtgtcttcacactcttccgtgcagtggctggtgtcttcacactcttccatgcagtggctggtgtcttcacacactcctgtgcagttgctggtgtcttcacactattctgtgcagttgctggtgtcttcatactattctgtgcagtagctggtgtcttcacactattctgtgtagtagctggtgtcttcacactattccctgcagtagctggtgtcttcacactattccgtgcagtagctggtgtcttcacactctcctgtgcagttgctggtgtcttcacactattccctgcagtagctgatgtcttcacactattctgtgcagttgctggtgtcttcacactattccctgcagtagctgatgtcttcacacttttctgtgcagtggctggtgtcttcacactcttccgtgcagtagctggggtcttcacattcttccatgcagtggcaggtgtcttcgtgctctcccgtgcagtggctggtgtcttcacgccctcccatgcagtgggtagtgtcttcacactcttctggagcactctcctcttcagctgtagccgagacccagcagagctcacagaattcttcttccttatttacaaacttcctcaaatgaccacccattgacaggcaatttaacaacttattggcccatttaaactgattaaaagcagacacatatatgttttggatgtgagccctaggcctttgatgggtctttgctgaatagaattgaattattgaactgaacaaggagcaagtaggtcgaccagtgggttgtttttctacctgcaggtgactccatccaggtgcaaatagcaaggaagcccttgaatccactacaggtgaaagttttgcattgtggtcccatgtgagggaggagacaagtcacctggctattgggtagggatgaaggggataccagggctacagttagactttagcagtgaccccgcttgagcctgcaaagggcgacagctccctatggaaacaacagggatgagtggcagccccctccttggaagccttctcaaagtcactcattagatatgccagatagcctctctctcctggagtaattccttctctccagggtccatcatttgttttgtgatgttaattcatgtgagttgggagtttggttctattgtgttatgttttcctgtatgttttgatttattgaattttttttgtttattttctgtgataaaaatggatgttctatgtgaaagctgagttccttgtttctttctcttgcccgtggctgactgcgtgtgctctattgatgtcttgttcctggttcttgacactgaccatcttgtctgtgaaaggaggcactccggcgggcatgcttgatcagaagaaagggaagtttgcttggtttagtcactccacagaaacccatggtaatgttcccctgtgctctgtgtgtgtaaatgcgtgtgggtgcataccagactgaatgggaaggtgtctctcttgatggcttgtgccgcagtagttctgtgtgtgtgcatatatgtgtatgtatatatgttgtgtgtgtgtgtgtgtttgtgaagggatggcaacctgtccccctcaaagccactgccttatcattgcttcatatgtgtaaagtcagtgggtgtgacaaacaggcagagctattcctccaggagctcttcctctgggcagtgctggcctagagtaagcacactgtgaatgcacggttggaaccagcacaggcagtgccttgatttagaaggtgctgtcgttatttccagtgcccaggcctgcccctccgattttgtctgtctttccaggcctagcaccaccacctccacagcactgtactcacacataaggctctgggaacgaagtgtcacaaagtcacagaactttttctacgtggcctagcccttcaaacaaggatgtctggagggtagagagctaaaaactaaaaataaaaaataaaaaaaacctttgggctgagatggctggagatagatgggttggaagactgagagtgcttccattttatggcttccttagtgtggtttgagcaaagcccctggcaagctctgaaggtctgagctaaaaccatccctaagggctggtctcaccagcccctccagacttcagactataaagtgagtgtaatgctgtggaattcagtgcccctgtttggctactcactgccctcctgtggtgctcccagagcctagtaggctttaagaagcttgtctgcctagggtgtagagtacagaggtggtcgagactggggcgctcaagatgaacatgctacaggaggtgtgacacttgtgccctggacccagccctacttgaacacaccatatgaccatgggcatcacatcccttctctggcctcactttcctctcctgcggagtgaggaggacgagttagagccagataatttctaaagcctcacccagccctagagttctataaaatgacatctggattttttttaattcaattttattaaaaaggtcagagaggtctctcatacacaacagtcaaacatacggtaagtcgtggactttctgtttgtatcttccatgttcttgaaatgattctcttctcaccaacctggcttgtcttcatctgaaggaaaggaaaccaggaaaaatccacatctatcaacattatccatgcaaccagtaaaagtgtttcttgggctctggcagcctcgcagggacttgtcaccagaggccactccctcaactaacagcagattctgtgtctgctgagggctgatgactttctcagcatatgaggagttctattctggaggaacagcagaaccaggaccaaggatatgatggccactctaaagaataagggttacaaaactaaggaacgcattgtatcatagtaagagagtgttggaaggtggagaaaaattctttgagttaaacttttatttagaagaaaaaataataataataaaagaaatggcttctttcaagccaccaaactgggttctaagccagaaaactcccattgttctggaaattcagcccacagctgccttgggaggaggctggacaagttgaattaaacggcttatatccaagtcagcctgttgacatgggaatgtcagggtggctgaaaggggaaatcgtatccctacaggctgtcttctgaccacaattaaacataattgtgtggactgcacacttccactcctcactccttatgtctgcagggctagcttgaatcttagtgcatggctctggggatggccattcccctcaagccctctgtctcagttgtgctcctgggtgtaaccaactgccggaaagggaaggcctctgtccacccagcagctcatcaaggtagcaagcacgccctttctacaaacaggctggtccctgttcttggagatggagccccttagagatggtgggtgggatgaagtaaggaaaatgatatattttcatgaaagctcctctttctgtggcaagtggtagttgcaaatggaaagcctctacagcttcttccagtccacagagtggagaggagagattcaatggtcagttttttcaggatgtgtcctatgaggtaaaatgctcttattaccagatgtcctcccatacttccattagtttacagtgttcttggcggcaaaacctgcctggacaaccagcagatgtgtccatcaaggggatctgtgcagatcagccagccagcgtgctcagcctctctttctgccaacccgcactgggtcttgcggtgggcgtgttgcaaactactgctcttctgttcccttgtctccccaccctcaatgcctggctctgcttccctttgactcttgcagtgagcatgcccaccagtgagaccgagtccgtcaacaccgaaaacgtggctggaggtgacatcgagggagaaaactgcggggccaggctggcgtgagtaggcacggcgagcccaggggctggggctttttctggagcatgggtggaaaagctgcatctggaaatcacagtgggctggctcatcactaggaagggcagagattagagccggtggcaagaaacaaacctcaggtgggaaccaagatggggagcagagggccctggggtgagggtggccctggccgggggtgagtcttaaaatcaaggctagtcttcaattcatcacttcttcgggggtgctgactcttaggttttgagcctcttttcatcacatctgagaaatatagagggtgtgtgtgtagggggcggccccaaagtctgtttctttcactccagtccctttcgcccctcttcaaagagacagcgaggttagggccctgagtcctgctggccaccctttccattctgataaatgtgacctgggagagaagcagccaggtgagaagatgttctgggagatgactggcatgtgggtccttacctgaagctctctcatcctgccagtaagggaagcagaagtgcagtggagcctgctgttctgttgccttggggtgtcacgactgtaaactcaccctggcctctggaagaactgcaaacagaggctctgagtcagaccagtcccaggtacaatgcatttctgaattgctccacctggggggcggggcagggcggcatctcccttccctcctcgtctgtggaatgatggagagcctgggcaagcgcagccctttcacaacgctgagctgtggaagagtctaaacacagcaatgccggccttgagcgtggcctgggagcccatgttggggagggagaatgaggctgacggcagagcagctctcacagccgctgtttccagggagcgtggagcttcagtatcactcactctgacactggcaccagggagtctgcactgcagatttctcagcattgtcgggaagcaattattgtcaaaatgttgttaaaatacgatgctaattacatttttaagcagcagtgcaaacctcttcttttggaatcatacaaaacaagcacttgagtttctggaagtaggtcccaaacagcaactctagggaaaggcctataggaaggcttcaaagtctgtcagttctaggcctttctgttgtcttgccaccaagacgaggcttagagagatgatcaaaggccctgcaactctggctgttgggcaggcccaagtcgcataccaggagggactagggagctggcaccaggaagtcacttgatagtacatttcaggagagcatgaggctctgttaggaaggaaacatgatattcccccacggatggagcctggcagtctccagtggatctgtcgtttgctcagagcacatgctctgcagcctggagagctctgcagaaatggtccccgttatccccatgtttagccacattcgtactctgtgcatacagaacgctgagtcacagtgccagaattataatatgccccgaataaaatgtggtctttccccatctccctacctcccaccccgccccagacaatgatgagccaagactgccagcattcctggcgggagaagcagcatgggaactgagattgcgtgtgatggtctgaggggaagtgagtgaccgggatctttaaagctaagggttaaaagtctcatgtaatgagattaggtcacgatgaggactgctgtgtagtaaggaggcctggatgaagacggttcctgttgggggaagggaggaaggaactacggcatgttacttcatggcagcaggggcaggcgggtgcaggtaatgaagaggaaggagccgtcacagtcagggaagaggataatgaggcagaagtgaaatctgaagcaggagcccagttggagtgacctgcgggtgtcatggagaccacgagatacggaggcccgaaactcagccctgaacaagggtggacacacatgtttgaggttgttgggatgaaaactaccaatgaggtgataggacgggttgttcagagtgaagtggaaaacaagaccaagggctgaatcttgggaaatggacacacagaagaataagaccaagcaagcaaaatagacaaaggaatgttaagagaacaggcagcagcgccagcctggaagccgcgggaggaggaatttcaggacagagctgtttatccatgcattcgttcaacagtctgcccagcttggtgctaaggctaggtggtggtgacacacaacagggaggaaattgacaccatcgtgctggagctcacagtctagtgtgggagagacactatgcaaataaataggcaactataggattggggtaagtgttatgaaggaaaagtaagtgtaaagtcgggctaataacaaaggtttctaatttggactggcaggttaggaaaggcttctttgcagaattaaaattccagctgagaacagaaggatgaacatgagttattgagggactggcagacccttaaccgtttgggtctgcatcagaagagtgtgagaagtcactgaagggcattcagaacagagctgagtgggaggttgatttggttagttctgagctcctgaaggatcactgcgacgtcaggaaaagagcagggaggaatgagaagctgcaagagcctgacacaggtgagaggtaatgtggcagcagctcaggctgcagagggaaagaagggctgtgttgtgtgtgtgttctggggtgctacccctcagggttgcagggcactggtcttgggagtcggtctcagtgagggagatggggtggaaatgggccacgacagagtgctcactcaggcagtgaggccatggacagggaggaagatgggagcatgtgaagaggagtagcatgagtgtgggaagcgctggccttcattgtaataaaggcaagggcaaacttcaagacaaggaagaagtcacggagcaggaagaggtgaaacaagctgtaggggaagcaagtgcttataggaaggcattgcttctgaagaggagaagggcgacagcaaagacagtttgaggccctgaacttgctcaggaaggaggaatttctgtgcacctgaaactaattggaaaatgaaagaagaggagtcccagagtctagtgcccaccaacctccagctagccctgggatcttggccaaagcactccgctctgggcctcagcctcgtcctctgggaaaaagaagggtcagactgacatctctgcagaggctggggtggggggcggaaaccacctgcagcggtgcaagatttcatgtgaagaaagcattctacacctggagaaactgcaaaccgtaggtccatgtggtatctaagggtcccttccagttctgtaaagcctacagttctgtaaagaatacagaatcagaaacaggctctgatgaaggggtcagtgacaggagtcactccgaatgagctcagccatctcatctcccaaagcaagggtcaggggtcacaggaacttgaagggcagtatagagactgaaaccagtgagtcgtcgagaggatgctcaaaggttgctgggcagcactgatgccacggtggagactgatatcataaatgtgcagtcagccgtatttttggcagactctgaagcctgagagcactaaaaagagacagcggcgtgtcccagggtggggcttagccatgcaggcatggcagaaggcccaggcggtgtggagtctgtgtggtatcgcgggcaacattgccatgactgtagtcaagcctggtgttaaagggtgagagtgatggggaggatccagtgaggacaaatgttgggtcctctgaaagagcaggagggatcatagaaagggaggctctggccagagtcatggagcatctgagctcagcacccaggagtggaagcaattctatgccgtgcaagggcaggatgtggccctcccaataataagagctgtgggggagaggacgtcctggagttaaggatgctgagtcagacgcattgtcaatgtggatgatgactgcagtgccatctgacttatattaaaggcgaatttgggacaattcagggaaatactattttacacagcaggtagtaaacatatggcactctttcctctaagaagaggggagaggctgaaaatacaaatggctctcaagaagttcaaatatgtctcaaataatgacaaatgcaaactgagtaactaggggaaaaaaggagtttggggtttgtctctaattctgaacctgaaaagcacgaaggaaaatcatggtctcccagaaggtttgtcttggagtcctgggtggagaaagtatctggggttgcatgaacttcagttcctacccagtggatctgttctgatggtctcatgttccttaccagccttctctccctcctcgctcttcttcaagaatccgctcaacctgaggtaggaattgtgcctcattggaacaacaacagtggagacaaccaggaagccttccgagtgtgctgtgcatagagaagccagagcccccagctgttctcagagttctttggagattgtgaagatcggtagcagggaggcattggccacagtgaaccggcctagggtgtggaccagcaccatggcaccaaggcatctgggctcctgatggcaccgaggcacccgggctcctggcttgcgtcctctcactgcaggagcacctttccagcccagaaccctgggccacctcccaggaggcaaagaggtcctatcattaacgccaaggtgtgcaaagggagcagaaagaaccaaggcgttcagacgtcacagagttctcacctcagctccccatgggcatggagttttccctggcctccagacaaaagccgctgagcagtgtcctccccttcgcaaggagtggagcctgcctgacatggaacttagccatttggcggttgcttgtcaaaagtgccagcctttaaaagcggatgaggttttgatccccatgaacctaaaattctgctcacaatcccggaggatagcaacaatagcaacaaaatcagtcttcaagtgtggtgcccaggcttatccatccagacctgtaacaaagcagacaagaaggctctgtccatttcgtgctcagaatgtgcccggatgccacagaaggacctgtagtccacgactgtgcttgaagcaggacctcctttcccagcacccccagcgccaatcctgcttcccagggtcatttcccttggagacgaacactcaggattaggtttccccagaggggagcttttcagagcccacttgcacttgtgacccgcttgcactgtgagcaagacaacgcctcatggcaaagggccggtggtcgtcatcaaggggcaccccagacaggactactgaggtgtttctgaaagaaggcctgggaccaggctaggcttggagtcagagtgacaaggctgaagtccatggtcacccacttgagcttatggttaacagcaaggggagacaaccacccaaaagcagcctgggaagacactgaaggtctggggctcagcatggccccgctggagaagagagcacctaggctccccagcacccaattagcagctgggaaacatttgtttgctggttaaactgtggctgtaaataacaatgctgccctgggctcccagtccccctcccacacgctgttaacctgtgattaagccctccagccctcacaggcagtctttgcgggtgggatgaggttattagctaaccgttcggagcagtaaaggcgcttggctcagactcgcagtgccccagagatgtaattatctcatgcacgatggctttgccacctgtcacatcttctggcttaatttttttaataagaaataacgagaggggctggcgttttcttgctctgcgacacagctagctgtgtgccgcgctgggacgtcgcaggcctgcggcggttgcctcccagactcccttctcctgtttcctccccatgcctctccttgttgctccaccactgtctccatccctttcttcatctctaacttgcgttctgtccttctgcttctccatctgaacattgtcaccacctgcactatccccagcgttcatgcccttctcctagcaccaaagccaagctgacaggtgccttctaatggtctcaactgcttacattctctcactctccctgtctctctctctttggctcagccttctctcctccacacttctcttttacagtctgtccctcctgccctcttctccagcctcctgcctcccctggactcttccctacatgacctagggagcctcaggacttccttgaaggttctgcctttccatggaacctcctccctgttccatgacccttccaggcagccaccctcacacccaccctgagcttctgcccagaggtccccaggtcttcagggctgcgtgtgaccgtcagcatcctgggtttctcctcggagtctggggctggcgccttaggcctcctctgcagctcttgggtgggggctgttgtggcccctccatttctggctggctccttttgctggtcttcccttcataaccctactctagctgggctctggcagacagctgtgaggtctgtgccgacctgttcttgcctgtgatttttctgctgttggggtcctcttgtcatcaggagaggccttttctttctctgcagcttgtctcaagatacagctcttcctaacctgacctcatagaagtttctaggcagaccctgaggacctgctactctccctctgcagcaaggattgtctatacttagaagatgctagccaggccagacctcagtctccacattcaaatacataaatagggttctttctctcccaagatgttctagttcacaccatgcctccttccagcacccacacgaaattacctggggaacatcaaatttccctgggactgttgaccgtcttttaaatgcacgtgtgtgtccatcctttggtaacatttcctttttctttttcagccaccggatctccaagtcaaagttcaggtgagtgagactcacgctgctcttccttccttctgccaccagctctgtcttcagccaccctgttgggtggcccaaggtaatacctacaagttgccagtagtgtaagggctgttcttctaagggggtaactactttctgtatggccatcaagaaaaagcttatggctcagatcagacaaataatccagcggttgatatttgttgaatgatcttggactgtccatctttttggcagcacagtccctaggaagttgtcagaccaaatgtgttttcctcccttctaagatgaagtccagttaaaagaaacataaagtgagcccttgtgactgtcatgacctacttcatgtttatagaacatggtgagatgtaacctttgatgatgatggaaagcacgtaggattatgacacccgtctgtgtcactgctcttgacaatgacagaacctacaaaaggatccagggtcctcagcccccatctgcctcccagcctcacttcctgcacttccatgaaaataacctttgttccccctacaaggaacttcttgcagttatccaaatgttccctgtcctggtgcacactgaggcccctgcatggagccaatccttcacttaaatcactatgcccccatgccttcatctggagaactcacacttctgttcagaccctcagatgtgactgcttccgtgttactgctttctctgccatttcactgggcctggaaaataccttctgcaaactccagggagagttactcagctcccccttccctggtgctttgctgatgcctctgtcacagcactcagcacatgacactcggattactggctcacagtcccctgcttccaaaggctctgcctgcatgcctccaggggttatttccagagcacccagctcagtgcctgtccagtggtgaacgtccatacatgtgtgttgaatgaatgagtggacagatgtgtgcagggagaatgtgaattcactcccacaaagcttgtatgtgccaaaaaatattggttatttttcataattgagctaatcttgtttccctagccctatctcctacatggcaggagcatagagaaatttttatccagctgagtaaatgtagcccagtgctgtattttaaacagtcccttaaggtaaagtgatttgtctctcagattgcctctctcccagctcctctcttggacggagctggacacatggcggagagggactttgagatcccaggaagcagggaatgatgagggctggtcctagaagccacgcgagccctctggatgcttgctcatctctgctgcatggggctaggctgaactgctgtctgaactggtacctgctgaggtccatctggttagggcatccactgctggagtccatgcccttagggcatccactgctggagtccatgccctctacttgcctccggccttgaaatctccacctctgctctctgacccttgagttctgttggcccactgactttagcacctctatacctcagctgaggacatggacacttccaggtccctcacactccgtgaaggagctagaggagacagcagccctatgacaggctcattggcctaccggtgtcccatcacaacctctgtaacagccaggataagcttcaagccaagggctgaccttctcccagggtctgccgaggcactccaccagccccagtgttgctgggcttccccgtggccatctgggtgtttctaaagcaactccccaccaacctcttgggctgtggtgaccaagggctaaaaattaagtggggaccctggtgtctgacttttgctccacttctgataccttctttctctcccgtttcactaggactggaaaatacaggcttttttcccaatccttgtttctctcaaaccaagacctcatctacataaaacatctagggtcaggcccatccactctagctcttattacagagcaagagctccagaaatattaaaaaaaaaaaatttctctctctcagtaatgcttggctgttactgcttaatctccagcatctggagaagtggctggtacataacaagaacctaataaatatttgctgggtgagtgagtaattaataaatgaatgatcttgccccagtaagacaatagacttgacacagattcaaacaaaatatctaatttgacagtcaaagctgaaaaagcatgttgtgctttaacagttccaaagcccccacacaataagagtaaagggattaaaaatacacttgaaaatatttccaaaatatcattctcagttcatgcaagtgagtaaatcataaattaataaatgaatgaatgaatgaatgaatatgatctggaggatggaagggaaaattacatacttgtgtctcgagttagagattgcctggaacactctgggaacattattttcatccagtgatctatggtgcaaactgtgcttttcaacaagagggaaagagcagtggtgcctgtaaacctctggagtctccctcggccctgaggctttgctatgtgctggccattcagccctgatcatctgcctctgggaaggccttctccttctgcagccacccctcaatacaccgcagtaatgcggacggcagattttgttctcctaaaggcttacagctagtagattggcactatcattgaaactcatttccagatgaggatcctgaggctttgagaggcccaggtcacagggctctagtatggctgagtcagagctcatacccaggggctctgctgccaatcactgtgccatccttgtgatgaggttctgcccgggaatagtaaaccctgttcctgtatagctagtgtgtccgcagagtgtgtaactctagagccatgctattcaacagaaatatagtgcaagccacatatgtacttttaaaaatgttctagtaggcaggttaaaaaataaaaagaaacaggaaatttctttgatttaaaccagtatctctaaaacattactatttcaatatgtaattcacataaaaattattaatgacatattttgcattcatccttttgtgccaagtctttgaaattcagtgtgtgtttttcccttactgcccatctcagtctggactgaccatgtttcccatgcacggtagctgcatgttgctagcggctgccacgcaaggccacgtggccctggaggtttcacacatgagcaggtatcacacagcagccgtctaatctagattcagcagttcactgatggtgtctgcttagggaatatcaaaggttacaaatagattgaaaatgccaccaacgttttcaaagtattcctgatcattttctcaagttaggtgaaacagtttaacaattacagataatggaatttgagtctcaaactggccttttcctttgcaaaacagaatgatccaaagtcacggtttctttaaagaactgtaagaatggagtctctagggaaaatgtggccggttagtggattacagccatagtggaggattcccttggtaatccaggttttcacttagaggaattagttaaaataagagatttgtgacatttggagctcactgttcagaataaatgtaaacagttatgaaacaaatgattcaggaagtcttttgtaacctgaagggattgattacacaagttggagtttctggatctcaactttacggagttctgaagtgaacctcacggggttctgaaattgggaggactagcttgcccagtcttcagtgaaatgtgcttccaatgttctcttcacttctgccataccatcagcaacaaggcacaaatccaaatttgccccaatctctaatagtcctttgtaaagttacttatttacaagagaattaaacttaatgattttctgtggtgtttgttgttggttctggtaaaaaaaaaaaaaaaaaaaaaaagtggaaacttactctagccactagaaggagcctgcagggcccatcattttgatgttgtcgacgattccagatgcctgtgcaccattgcatgtcaagcaaactattttaggagcactgtccgctcctcacctccaccctcagccctggttcacaagagctccgggaatcttcaagccttgtcttccagagggaggtagtacatttgcgtagagttcgtctctgctgctcaaccgtgccatcagccaggggttcccgtgcaggatggactgtgctgagtcccatgggtctgtaaccaagtgtaagacacaacccgattccttcgtgggtcttgtgagctccgcggagaggcaggaaccatacaaatgaaacgtaactgacagtacaaggaaatgggaactcatttcctctggggacccttctcgcctaaggtgtcctttcgtgtgctccctggtggacccgcccagcactcaggccctgctgtgactgctcacttagtggtctgtgtctccgtgtagcttttacgcagaggaggcctgtgagcgctgtgctagctactgagtatctggtgcctagcccgtggtcagtgtttagtaactatttcttggatgtgtaactaaaatgagtaatgcagacagtaagcgctgaagagtgccaaggctgagaagactagaagcatgcatcgtggagaagctgggactcagtgtgagccccacaggaggggcaggacagacaggatgaagcaacggtggagtttccggtagctgggaggacttgccttgcagctggacaggcaagaggaaggcccagtgtagggagaagggcaggtggagctggggctgcgagagcagaagtttagaagcagtgatcccgaagtttagagacatagatgagacccattcgtatccatccctctctcctgtgtctacatatggaaggttctatttctagagaaaatgacttccagttagtgtgaagggaatatgaatagcaggcaaatttctcctccctattttatcatttaatttctgtatcctccatgcatatgtaaacataaataaatttacacattctaataaaccattacatttattatacagtaggaagtgttgccaggaaaccagttgtcaagcaaagctatattttgaagagtgggaggtgcataattatctttaaatactttctctggatagtaattaccccacccccaccccagcccaaatccatgtgactctcccaaatgggtctgctcaggagcaccccagttgaaagggacaccgtcctgtccactccggccactcctcaggggtctgtgcagagcagctccagacccatgggaccagcctgaccacacagcacccatatccactactcccaagcatgaggaaaaaggggcataatcaagctctcatattaaacccactccaagacagctctacataccgcaaagaaagcaaccttgattgccttggactctgaataacaattatcagtgatttctggaacttgagactgtatctatttaaaacatgttctttgcaaacttcactgtcagctctttaagatcagatatgagtttgtcctgaaaattcattttttaggggaataaactacttgccaaatttctgtacagtattaataatcacaatcacaggaaaaaagcagaggcatgccctgcaagataagactgtttagtatcaagatctggcaaacttcagaggtcgcctctcaagaggaccatctgggactcattgtctcatttctttgtccctctgtccaccctccaccatcctccctcggatccagggcagtatgtctgggggtgcaagaatcccaaagtgcatttagaaatcataacgttttaaattgttaatgtttatgggcactaatgggtgtatatatttatgaggtgcatgtgatgttttgatccaggtgtacaatgtgcaaaaatcaaaccagggttatcagggtgttcctcacatcaagcacttatcatttctttgtattacgaacattccaattccagtcttttagtttattttaaaatatgcaataaattatcatgactgtagtcaccatccttctctcctatgttgtatgatcaaatattacatcatatttattctatttaactatattttttcacctatttaccatctccactaccctttccagcttctggtaaccatcattctactctctgtatccatgagttcaattgctttaatttttagctcccacatatgagtgagaatatgtacaatttgtctttctgtgcctggcttatttcacttaatataatggcctccagttccatccatgttgttgcaaatgacagaatttcattcttttttatagctgaacaatattccattgtgtacatgtaccacattttcttcattcatttgctgatgggcgcttaggttgattctgtatcttggctattgtaaatagtgccgcagtgaacataggagaacataggagtgcagatatctcttcagtatacagattggaaaccatgttttccacctggtggcctgcttccctgtgtagtggattttcccccaagtggtaggccagtgtcgcatgttaaggtgtggccctcactggagatggccttcaagctagagcagaacactgcctggattaatcctttttcccctccctgctcctcaagccaaaaactaagttctccctgcagtcctgaagaaagagtacccttctttgattactcttcactctcctaacctcatcttagatttagcaaagtcttggtaacaggattttctgcagatcatagatagaaaaatgacagagtagaaaggtggatgaagtcaggctactccaagaggcaattttgggggtatgtgcagggatccgtaacagcccaggttggcatcttggagtttgctgatgtttggaggggcttctgccctggaagtagaggaccaaggctgagggcagtgcacacagcacggagctgtccctgccccctggggcacacccacatgtggtgctgctacatgcccgggggctaggaaggaataggccattcacagaccagtgagttcacacagatggggcttgctgttccaccaccagcataacttgacccaggaggtgacgctgaggcttgatggtcatctctggcaggaagattggagaaacggactcatgccatggactgtgatttagaatggaggacctcatttcagcttccttgcgctgaagtggagggccggttttcacatccagacttagtatgccacacacagacacacacacaccggaaacaaagttttatgtaaaaatatttttgcttactgcttactttaaaaagcagtttccttacgatatgatacgcactgtgatattttccactctattcctttattcagtgccaggcatgacctactcaatagatttcatgacccactaatgggctgcagtgtgaggtttgaaacctctgcccagaggcagattctgcatgcttatttagaggaatgtctgtctagacgagagagattcatagaaaggagatcattttatggaaaaatacagatattcatggactttatcaccaggattctactttgtttctcctcctgccttcattacccaggcaggagctgtatcttcaatgcctcgtgggtctgcgtacaagccctacaggtgccccaaagccatgtgcagagctaagcaccccatttttctcataactgacccctctgcctggagctctactcccgctcctctggccctcctctgtgctgccctcccaaatcgccccagctaaaaatgttggcagtcccttccatacctgtctttcttattctgcacatccgctcatctcaagggactattgattctgcctctaaaattgctgccagctctgtgtcatcttttccattaatatagctattgccttcatcatctctaacctggagaacaggaagagaattcctcatactctccctggtctagaaggtgacagaggggctgtttttgtggggtgttccaatccaacctgatcatgtcctttccccctccccaagccctcagcatggcccctgcagtctcctcctcagcacctctccagctatggttcttctctccttgcacagtgcagccatttattaaccatgtcgtctactgaattcaaccaaacagagctgtatattttctctgtatcaggaaaatgaaaacgcctccaccatagaatcttaaaatgtgtttctttaggatcatcttagccactggttctcaaccatcattacacattagaaccacctggggagccttaaaaatacccaaccccggccgggcgcggtggctcacgcctgtaatcccagcactttgggaggccgaggcgggtggatcatgaggtcaggagatcgagaccatcctggctaacaaggtgaaacccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaatacccaacccctagagaatcagacttaattggtttggtgttggggcttgcggaccagtggggttttggggagggttccctaggtaattctgtgtgtagccaggtttgagaatcactgacaaaggctcctaaaccaagatacggggaagagtccatggagcatggatgagctttgaggggtctgtgtgctgtgtgggctctcaagtaaaggtgtgtgtgtgggcatgtgcccatttttctgaaaggcagatctaaacattcatcagattctggaaagattctataacccagaaaaacaaagagcctgtgctccagatgaaccccttctaccatatggatgtggcacacacagtcagggccaagaggctgggcagaaaactacggatggctctgcctgctgtgatattggtcgagtactcaacctccccagccctgagttttctcctccacaaaaatcaggataatgcgtgctttgcagagttactgaaagaattggagagaaggcatgagaagtgcctgatgtggtactgggcccctcctccactgttactaataatgctcttattgcttacaacactatttctaagaatgctgtttcacaaaaattaaaaaaacttccatttattgagcatcttcaacttcaaagcagccagatgcattataaggtatttgatccatccccacaataaccccatgaggtcggccctcttcccgggagaactgaagcttggaggagttcaggggcatccccaaggcggcagggcctggttagctggatgagaagctgggctccttgccaccagattgggctgctctagcaaggccagatcagtgaggggcgagaagagccatggtgctgcatcttgggttggaggaaacctgaattcacagccaaccccacccttctctccctgtcccctttccagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaaggtgagcggcggccccagctctgctctggtttcctcctggtaactcagccccaaggcccaggggagggcataaccacaggcagaaggtggaggggaaagcagccaatggtcggggctcttggcaggtgctgtgctggagacaccaagggcctggcagttccaaagccccacaataaaatgcgctaccttgttaaaaacagacacggctctcctgactgggcccacaccatcagcctgccccaaagtcactgttggacccaggtgatgaggaaaggggctgcagcttgtttgcctatctcagactcctggctgccaactccccagcatggattttaaatacctgggggccttcctacagccctgaggtggccttaaccagaacacatgaggatggaatgagcaaaaaggcagagaagagaatagggcctgagcacaaggaaccgtcttcaatgggtcgttcattctcattatccttccttgggcccctagacgagggtcccactagccaggcctcagcatcattgctgggcagtcaagaagacctggccccatcctccacagctgctttccagagtcctgggaggcagggggtctagtggcggagaagtcagactcagacagtgcggctccaactgttggctgtttggcctgcacaggctactcacctctttgaacctcctttctcatctctgaaaatgggcatgacgatggtggtaccatccccacaggcctgctatgaggaggagagattgtgtgtgctgagcctatggtgcatgggagatgctcagtaaatgtctgttatgattgtgacgagagagccctttcccattggcttggccccaacttctgttctggccgaggtggatgggagaggtgtcatgggggatcttttttccaatggagataattactgtatttcctttccctgcctccctctctgcctcctctggccctgctcggatctcatccctctcctgggcctgccagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactgggctccccctctcactttgaagaggggactcaggaagaagttcttccagagggcaagggaggtggcaaggcctgggtgggaggggggctgttcttcctcaaagggtgtctctgaagttcacatgcaatgggggtagtttgtgttcatttagatggcacatcatttggaaattcctctggctgctaataccagagactcaactcagtaatgtaagcaagctagggacttattcagccatggaaaaaaagtccagaggcagctagctgaggtgccttcaagaagagggtcagggactcaatctcttctcctgtgcttcaccagccttggtgctgattcttctccagggtcataagatgacttctggagactgagccatcacattcaaattggaggtgggaagaagagaaaggagcaaaagggccgaccaccccggccaagtcagcttctccactcccagaagtcactcccagacacacccattaggactgctgctgtcaaaaaaaactgaaaatcataagggttggcaatgacatggagaaattggaacccttgtgcactatgggtgggagtgtaaaatggtgcagccaccgtgggaaatggtatggcagttcctaaaaacgttaatgataggattaccctctcatccatcaattccacttctgggtatatgcccaaaataattgaaagtaggatctcaaagagatatttgcacacccaagtgccttagacagatgaatgtatttttaaaatgtggtctacacatacagttcaatattattcagtcttaaaaaggaaggaaatcctgacacatgctacaaagtagatgaaacttaaggacattatgctaagtgaaataagccagtcacagaaagacaaatactgtatgattccatttatatgtggctcttagagtagtcagattcacagagacagaaagcagaatggtgggcgcccagggctggagggagggggcagtggggagttagtgtttaatgggttctggagatggaggatggtggtggtttcacaacagcgtgaatgtatttagcaccactgaattctacagtttaaaaaaaaaggttaagatggtaaattttatgttatgtgtattttaacacagtgaaacaaattggaagaaatcttccagaagtctcagcaagggcttctgttcttgagcacctgagctgttagggaggctgagaaatgcagtattctagcaggacaagttctgctgaaaatgcgttcaagatctagccactgtaaagggctgtggacactgcactgcagatggtgttcaccctctgtccacatggccacccctccatatgtcagtccggcacctacccaaagcaggccatctccctcactgtctaggccaagcagtgactctcaagacaaggacagggctgaggggcaccatgctctaggacaatgattttcacctgacttatgaccactgggagtggtggaatccatttattggatcacaaccatcattttaaaacatactgaaatataattcatatcccatatatttaccccttacaatgtgtaacttaattgtttttttatattcatggttatgcaaccatcaccatgttctagttgtagaacattttcatcaccccagaaagaaactccatacccattccacatttcccccatcttccctcccagcaaccaaattcactttatgtctctatagagttgcctattttggaccattcatgtgagtgaaatcttataatatgtgtttttgtgatggcctctttgacttagaataatgttttcaagggccatccatgttgtagcatagatcagtactttgtttccttttatggtgaataatattccattgtagggatatactacattttgtgtattcatgtatcagtgatggacatttggttgttactatcttttggctcctatgaataatgctgctatgaacattcatgttcaagtcttcctatagatgtaggcttttgtttttcttggataggtacctcggagtggaatttctagattatttggtaacaatatgtttaagattttgaggaactgtcaaactgttttccaaagagactaaagcatcttacatttccaccagcaatgtataagggttccaatttcttcacattctcacaagcatcgtttttaaagaaagaatgaaatagaataggaaaacatcagagggtctcacatgaacgtaaacattgtttcataaaaagctgagatgcagacctgacttgcagtagaatacatatttcttaatgtgcgttatgatcaaccttagaagacatatgggaaacacctggaaggaattttcaacctgtgcccctctaaggtacaagtcccctgtccttaaaaatctgctttgggggctcccaaaatctctgctttggggaatctttgataacaggagcactaaaaccatccgttggattgtgatgggtaaaaagggatggaggttggtgtcttcagttcaggatctggagctgatggcatcttgctcagagcgtgtttctgagtgtccctaggtgttgctcttctcgtcacaattctcttggcaaccacccagagcatggtcacatggtgttgtggatggtccggggaggtagacatttaaagtgtttcatttagtgcacagaaaggactcaatatgcagaagcttttattattcatctaatattatgactgctattattagaaggaagaaagagaagagagctaatagtgacctacatattcacatactcttgttcttacttatttacccactacgtatatactgtgtattgagctcagagagatggaaaaaatcgaaaaataaggcgtatggcgtgaactaaatccaggagaaatgtatagtctggttggggagatggagtttgtgcacatgaagagattaaaggaaaatctatgacagaatataatgagctggcaaagtgtggtgggcgtgggaattacctgctgtgagaaattgggagcaggagatagctcctggagaaggttgaatctcagatgagggacttaacagacacccacgattaaaatccagaagtttaatgctcctaagcaacagccttctttccctctctgaccccatcgaaagagagctcttcctaagtgtcctgaatatgttggcattacagaaagtccttggtttacagtgaaagtggtagaaatccttatatcagcaatgattaccatgcaccagtgcttactctgtgccagatagggtgagcagaggcctacgaatgttagcttgagtgatcctcccaagtacctacatgaggatgaggataggctactactattattattcccactttgcagatgagagactgaggcttagagagttgtcagttgcccaaggtcacaaaactgctcagaggtaacactgggattaaaaggcaaggcaggtctgtggtctgacttgaggtgctatactcctaaccactgccatgcactgcagagctgagagctgacctgtcttcttgtctaggtccctgagacaggacttaaaagatctttatgccctggttcttgttagataattgccgattctacttgctcctcctggggtctggtaaaactatttttaacttgcagttttcaatgcctcttaaataattctcaaaagtccctgttttgggcttttatgtatatatttctatagaaaagaaatcttgctgctatatattgttatgacatcttgaaaagatttaacattcattctatttttaatcaccaatttatttctaatctgaagatattgccaagaaaccatttttaaaaatctatcttaatcagagagcttcctgtagtccctccacaagaaggagtagtagtattttcagatctctatgaagtctataaacagaaaaaatcattgtctaattgaaagtgactgtggcaaaggccgtcatcttcctattttcaagtctccaaagcctctgggggctttcggaaagcaacaaagagactaattaggttgggggatcccataagtccgtctccagcgccagccttgggactgggtgacagtgaccaagaaaaatgcctaaaatatgggttgggagtggacattgtggtcccttcagctgaaccttgaaatgggtcatctgtgcatggtcctgccatcagacaagtgcatgccttcttcttttaaaatatcttggaaagtactttgcaatgtcttgctgctactcatatgtagaagaaatttcttctctttttttttttttttttttttacaatgtagtctgaaccagtaattgcaattcttaaacttagctgaacccatgaaggagttcattaaggagctcatctctagagattttggccagcaactcctggagagttccatgctagtggtccaatgaccgacctcacttgaagaaccactggcctaatttcctactgctgctcttggtctgctttcttctcctaaaatactgcccttcatatgcaatcggaaaacttgattattattcctcctcctcctcctcctcctcttcctcctccttctcttcttcctcctcctcctcctctcctcctccttctcctcttcctcctcttcctcctccttcttctcttcctcctcctcctgttcctcctcctcttcctcttcctgctccttctcctcttcctcctcctcctcttcctccttctcctcttcctcctcctcctcctctcctgctccttctcctcttcctccttcttcttctcttcctccttctcccctcctccttctcctctcctcctccttctcctctcctcctccttctcctctcctcctccttctcctcttcctcctcctcctctcctcctccttctcctcttcctcctcctctcttcctcctcttcctcctccttcttctcttcctccttctcctcttcctcctcctcttcctcctcctcttcctcttcctgctccttctcctcttcctcctccttcttctgttcctccttctcctctcctcctcctcctcctctcctccttctcctctcctcctcctcccctcctccttctcttcctcctcctcttcctcctcctcctccttctcttcttcttctcctctcctcctcttcttcctccttctcctcctcctcttcctcctcctcctctcctcctccttctcctcttcctcttcctcctctcctcctcctcctcctgtcctcttccttctcctccttcttctcctcctcctcctccttcttcttccttttcttcttcttcttctcttccctcttcttttttcaagacaggatctcactctgtcacctaggctggagtgtggtagcataatcatagctcactgtagcctcaaactcctgggctcaagtgatactccagcctcgtctcagcctcccaagtaactgggactataagtgccatgtctggctaatatttttattttttgtagagatggggtctcactatattgcccaggcaggtctggaactcctggacttaagagatcctctcacttggctgaccaccttgcccagccaaaaaacttgattcttacatctccactgtcttctccatactgtagtctctaattctgtcaagatggtacttttgatagtttttgactgagaaaacacatcaaggtaagaactactatgaattcagcaaagcttttaaatttaaattcctacacatctgtgtatgtttgaaaagtggtaatatgaatgcaagacaaggctgtttattcagagtagtataatgcttggtgtacacatggattcatggatccctttctagaattctagaattccaggctgctcttccctcacccaggacccatggtccaagggtcgggaacagggatctaaatcaatggttcttcaccctgaggtcatgacacagtggtacatccagagcagctggatagtgatagcaaataatttattactgagagctgaaattccaaagtttgtgaatagtttctttaaaaaataaaacaaattaatattgtccttgtaacataatagcatcactctgtcacttgcattacaaaatgcttctatgaatgggtgagatccgggtggacttacaactcatccatgatgcctgaagggagcagatgtctttgatatatcattatgaggaaaatgaattatttacatactgacattttttgtgttttgtcaaaatctgagaacaccttagggagtatgctacatgtatgaagatcattcatcctcttgttgagaacaccttagggaatgtgctacatgtatgaatatcattcatcctattgtttcaagacaaaaaaaaggccaggaagcctgtactagactgtaagaaaattactttatagaaaagattgaggaagacaagattcctgctcattgaaaacagtggggcacacgcatggccggaatctttgtcatctttgagtaaatgccccagtacggtgggccttccagcctcatgatggattgggttcttccacctgtggctcttggtgctgcccagattcaatatccagtttttctactctttgtcagcccagtctgacatattctgtggggtgggagaagggctccagacagattcaatccggacgtgataccagtttactgattgcatctcatttttgacacacttggttttcaagtgcagtgaggcccctctagcacttgctgtttcccctctcacaccttcaatccctctttatttctcctgctgctcctcccctgcagctcccttcccaggccttgaaatgggagctggggctgattcagcacagacagattggctcataaatcttggccacatatgggccccacagagctccaggtgagagccgttagcacatctcccaggctcgaaatgtctccatgtccctaccagcatctggccttgagcagcagatccagccccacaccttcccagctcttccatcaccttctagcccccactcttctcaggccccctggagcctctgagctcattgagggccattattaaggaagtctgtttggcagatgcccagttccctggcaggggtctgtggcaaaggtagctcagactccagagcctgcaatgtggctgtcaacacaatgggtggttctcctttggtatgggaatggactggtgtcacctactaggagaaagattaaaaagatgcaggtgaggatgactccctagccctgacacaactgtggttggaggggccaactaggtgacactgagtagccccgtggcccagaagctcagagaagcatgctgctaaggccatccccaggtccaggccagaccaccttgcccgcttgaccaggttacactccccatgcaggttccgttcttaatgtgaccgagacatctgctgcaaacagagaagacaagacctttgaacttgttaactaagtcagcccttgcctcaaaagtgaaaccacaaaatggtcttcccagcctgctagaatggacgggagcaggggcaggtaccagtagaaactgaaccggtagttgaggccttggggcccaggttgtcccagaccaaaatactctagaattctgcttgactcctcctggcccagcccagcatatacggttctgcctctgggcatcctaatccctcccagctctattgtgtcttaaggggctggggctcaatttgacggaagctctgctctgaggacaccccctcctgtgctcacttgctggatggattctacctgcttccccaggtggcctcagccaattctcactcctcttcactccattgcctcccatgaagccccagccacacagattcaccacaggggactgctttataactgctcttttaacaatagatcacttgccaccgaaactaagaatttttttttagccttcaggatgagaacattttgggcaggtatcaaactcagttatgaccttctctggaacacagagagaatagggtggaacatttgcagagcatccgaaagtggtgggtactgttattttgaagatctcttatttatggcaagctcaatgctctgctctatacctagaataaaggtaaaggacctggccctgagctctttgaagcaaaaggttcatgagatgaaagttccagttcaaggaaggctcgggtcactttatattatagaagaggaggaagaattccacagagccccaaacccagagacagacctagagacggggaaacaaatggagataaaaggatttctgaacagatggtggtaacttaaatcaggagaggcagagggaaaaggtaacagaagtgacatggtggtcggcaagtgagagagcttaaagggaggctgggagtaggaaggtagagggaaggagagaatttaggtggcagagaacttgatgtgatgaaaagccctcagatgtgctgtacttttaaggataaaacagggagccgagtgggtcagatgggggatggggtgagcagggacgcacagtttggagagaatgattccagcagctggagaatgggaaaggaaagttgatgccaatgatggcgacgcaggcagagtgtctggggggtgatctagagctggacaccggcacccgggtgctgtagagcccacagtactgaatgtgagcttgtgggcatgtgtgtgcactgctctgatgagagagtgcttcatttttatgcttttccatgaggcctgtgaccaaaagacatgaagtgctttgctctgctgctgctcgcttctctccaaagctcttgcctttttggtgtgtgagcgtgtgtatctcatatttttgaccaatgaggaaaaaagcttcagctgattgtgaatgtgccattaacccctctagtttaccaacagtgaatcttcctaaaaaagatggtgattctaggataggaggccatcatccaatcttcaggccatagctgtgcgagccatcagaccacattaagaggagggagtgtgaggacctgcaggaccgccagctgtttatttaagtggtttcacgtcaccctacccacctcaaaggctgccacctggacacctccaaatcccatccatatcagtgatagtgagcccccaccctcaacctgctaccagccaaggcctgccagtctccagaattcagcccatctcctctgaaccctatcagcattctttgccacatcatcatttcagcaattcctttgtctcatcttctagatgagcatataaaacatccctgataatttgcacgttaggaatggaagccttctgctcagcaagctgagcacccctcgtgatgccaggccctgggcagcagcctgccccctttatcctgctgcaaaggaaaggaaaggacaggtggcaggcctgcctcgggcccaaccccatctttctctctgttgaatgggaagcaacagtaggctgaagacaaacagcacaaacaaccatatctctgtctgtctgtctgtctgagccatgttttaactgtgttactggtccccaggacagtgtctttcccctcaggtgtttttcatgtagacagtaggctggtgccaattcatcttttaaacagaggctgacctgtgccctcaaaactgggaccagtgaatttgagaatgtgagttcttccccaaaggtgacacatgttcacagtgatctggaaatcctactcccaaggtttgctcaagccacagaaaccgttttctgtaggacatattgatacatattagtttgatgcatggtctggcaatggaacagtcaggaatctcagaaaatccctccccatggatgtagggaagctatgggaataggaaggctatgggagcaggggcaggcagccacttctcactgtttggcaaagtgtgttcaacttaagtgcacacgcacacaaacacacatgcacagaagcacccatgcacctccatggccccttgcctttccctccaggaagtaccaatgtgtcatatgaatagtaaggttcattcattcactgaacaaaatgtttgctcatcacctgctttgggccaggcactgttctaagctccaaggatataaatgtaacagatgggttccttctcccatggcctcacattctggcgagggcaagcagacaataagcaaagaagtaattattcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacacccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagaagtaattattctttgagagtaatgagggatagagcggtggccaggggagatgtgaggcctgaaggagctgaaggggtgagctccactgacgtctgccaaagaacctgcggacggacagcagcatggccttggtcaggcaggagcatgtgtaggagttggagaaagtgagggggcccgaggaaggggagtgcagctggctggtccctgaggctctgggcccagaatctacagcctctgctaggcctttgggaggactctggctttgacccagaggagaaggggaggtgactgaagcaagactgaggcttcgtgggcctcacctcatagcaacacccgctgctgctgcagcttggacatcagctgcccggagcgggggtccaggcagtgaggatgaggaggcggtgggaagtggccaaagtcaggactcattttgaagatggcgcagaaggatttgctgatgcagagtgtgagagagccaggaagatgactccgaggactttgccttgagccaaaagctatggttctcatttccttgagacggggaaggtgatgggtgggaagcaggagctccatcagagcacgaacccggtgttgtgcagcttggactttcccagacgccccaggggttgagggaggcaggggcggcagggagagtgggcagagggtgctcctccagacacagctctgtgtccctgcccacgtccttgcctttggccttcgctctaggagatccctgctagtttccatgctccatctctgccttcccaggagtgttctcccctcttagagactggatctgttcctgggccacagcctcctcctccctggagccccaagcattctgaggggctcccaggtcaggagggcccccccacctcaccatccctctctgctcctcatctggggcctcccccagactttcttgctgacggcacctggccctctccctctgcagccatgacctgcttgtcaggctcccgttggtccccatggctgtcagacatacctgggtctcaggtataatcccagttgcagttatttcccacatgcctctttacttcatgaaaacgaaggctccaaccttccatgaccattaaggcttttccagaatcttccatgacagttgagcgcacagaggatctctagaggatttgtgacttcagtgcacatgcggacactcttccctcggatacagctggaaattcttgttataaatatgcttaaagttgctggttcccaactcccagtgtattggcaggtgttggactggtcgcctgaggattaccccagccccagagtcagccccagagtcagagattagggtttcatggtgcaagggagggacctgggaatcaggatttaggaaatgctaacacacccctactggtattgttgttgttctattattaattaattaattaatattttaggacagggtctcactccgtcacccaggatgaagggcaatggtgcaaacatagctcactgcagcctcaaactcctgggctcaagtgatccttccatctcagtctccccagtaggtgggactacaggcatgcaccaccacacccagctaattttttaattttttaaagatgaggtctcacactgctgcccaagctggtctcaaactcctggcctcaagcagtcctcctgccttgacctcctaaagtgacaatcctcccaaagggggttataggcatgagccaccaccatgcccagccacctctactgatgttgatcaccgggcaggcttgggaaaactgctttagctgtaagaggggagggtgttctacccccagagaggttctcttactttttcctttaagcagatcactacagcctctagcctgcaggggctccaggcagtccatcacacatactgggttgtacagaatttatataaggacagagttgggaagctggagggggacaaaaccctgcaatcttctgccgtctaaaatttagagcctattttggtgagacaagactgtatagaacagatacaaatagatgtatattaatattctgcaacagagggggtatggctggcaggcaaaatagaagtaaggaaaagctggatttgtggaggccaaaggtgccctcgaggctgcaggttggtaaagagttcatgttgccatccaaactatgacccctctgcttctgtcccttggtgtggaaccattctctgcagagatgagcccaggctgtggctgcaatgggagtggcttgcatgtcactcactgaagcagcaaaagcaatccactgtctggattggtgatgagctgggaatctctcaagggagtgacctaggaggcaggtgggccagagggggccagagggaaatgagattgttctgttcttgctcttgctccctcagggccatgtccttttgccatggtgcacttcctggtcctgagctgaccctcacacaggtgcccaccctgcatccagcagtcattagtaggttccccctcccactttgtcatgagaaagggattttcccaggatcgctgtatttatagtggagagaggccccaggactgtaaggagtggggacctcctccccaggaatcccactgaaagcccatgtcccctcaggaccgagctcctgcccactcagaggactcgtgctttgagctgccccagtgggtgtgacaggtttgctataatctaggatttcccagactcacctgctgatcagaatcctgtaggatgcttgttagaaacaaagatatctgggccccaaactacagctaatgaatcacaatctcaagaggaaaggcccttaaagaaacaattcttaggacagcgtaaacttgggaaaccaccaagccatgaactctctcttacccgtgggtgacctaattcctgcctctgctagaaggctgctgcctataggctgagctcagactggcattcatggtgggggaaaaaaagctttctttctgtttagagaccaacagtgacaacaatgattaccaacctttatcaactatgtgccaggcactctacagggggctctttggggaaaggtggatcatgtcacgcaatcctgccatagcctaatgaagcaagggctacaacaatctccatttttttgatggggatgcagaaggcagggaagtgaaatgtcttgcccagaggcacatgcagcaggtagccggcagagctaggtcgcgggcttctgaccactgtccccctctcttccccaacagattaatcatcttgagaccttgaattaactccctccagggtggcaactcacaccaccaccaacacgcatcccccacgggcagggaaaaagagcatagagtggcagctcctctgagaacctgcagtgggcagttgtgagaatgaggcacgatggggaggacagcaaggggcagagtgctgacctccctcctgttggctctcaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcaggtatggactcttctctgctgggattcggactcggggtggttgagtggcggggtggtgggaggagtgtgggaagctgcacccttttaccgggcagccacagccatcctagatcagccctggagagcccatgcccgggagagtcttgagttttttctgtagtttccctgtccccatctgccatggaattccactagtgggtggaccattaggggaaacaatataagtggtttaaaaatgccttctcaggagaatctcttgaacccaggaggcagaggttgcagtgagccaagattgcaccactgcacactctagcctaggtgacggagcaagactccgtctcaaataaaaaaaaaaaaaatcgttcttatccatggaatcctttacttaaattctccatgaaagcccaaaacataaagaaaagcagactgctcttactgggggaggggagggtgacgaaaccctggctttcctaccatgcttgtctcttgaaaaaaatattactagcccatcaaatttgtgatttcatagatattttggcttagggcaaactcaaagtggcatctatttaagtttaaaagcagatcgattgagaggtaaaaatgaatcacatgtagatgttgtcaaagtcttgaagatgatgccccagtgacgaatgtttggggaaagctggtgtagcctgtggctgtctcagcaaacacacaactgcaaaagggtcctgacgccttacccccaggaatggctgacggtcagctcaagcatgtgtggggaaagtcagagatctttgggccaaaaagcccttttagtcacccttcaaataatattatgccaatagccaggcattttgtctaaggacagttcaatagctcagagcccctggggaggagaattgggggccaggaggagggaaagaagtgaaagggaaattttggacaattttgttgacgtagtggggcagggcagggtggttttgggtttgctgttggtctaacgctgtgtcccttattggtgggaatgtgtcattcagatcctgaccggggaggactggaattcggtgatgtatgatgggatcatggcttatggcggcccctcttttccagggatgttagtctgtatttacttcatcatcctcttcatctgtggaaactgtatcctttgctgctgccccccacccctgcggcccccagcccccagcctgcagcacagtgccaaacgggcacgcccctcaggtccgggcggtcctgctcgggctcacaccacccagcctagaaccccatggcggcggaggtgggtctgggtggaaacctgcagctttggcatgggtgaggttcaccttcctgaaccctccgggcccgcagcggcgccgcgctccgggcgggctgtcgccgtaatctgggtgagcggcgccccctggcgttgcggcgtgtgcggccactcacaccgcctgcgatagggacgcgcgggagcgggccggctgccctggggccgcggcgtctgctcagaggcgggacgctccgggagggaggatgagccgttgtccttcaagtgaccttcagctctcctcctgctttttggtcagcagccctctctctgatgctgctctccaggactttagtcacgggcagagctgcacagacttcaaacagccccaaaagctccttcctgatcccggctggggcaggtttccagggcacaagccacgggtgctgcttctcttccccagctcataaccccgagagagtcacgtccagagccaggggtaacataggaacagctctgggccaagtcccagctaaggcagtgcagaaaacacagtcatggaagcctgcagacaaggtttcctcttttcccagctggatgacctcttgcagattgaaggtcctctacctcagtgtctgtaaaatgtggcaatggaatcatagaacctactacataaagggtcgttgggagttttcatgggatcatgcatgcaaggcctctgccacattcagaagccaccctggacaaagcccctcttccccagcctgggttgctgcggcttccctgtgtgtgaaatgatatgaatgtctgggtgcctggggccgggggtcagacttcacagacttaaagcccccttccagctatgctttcgttgattctgcagttctctgacccacagtgtttctgttggtggagtggggaggagaaagggcaaagaactgtctccactgggaactcccaagccttggctggctccagatggaccctccaagggtcttcgtgggtgcaggctcacattaagagttggcagagataccaagccaccccctcagcgcccagttataataaaccgctcttaagagcgttctgcatcctgctagagacaatgctgtttataatgtcaattacagccagtcatctcagcagggaaagcaatcatgaaacccagcaattaaagtgcaaggcagggcttgctgcctccctcccgcctgctccagtgtgcaggctagcctgttctcatccctcttgatagctccaggtagctaggagggtgatggggaggaaggggaggggaggaacactgttggggtctgactccctcaaattgcttccccctcaagctctctctgctgaggagctctaccctgcacgccccacatcccccgtgcccctgtgcccaccaaaaccccaaaccaagggtcattttctttaagaatggacacaaacagatatcctactgaatgtgttcttggccattgctgtggacaacctggctgatgctgagagcctcacatctgcccaaaaggaggaggaagaggagaaggagagaaagaagctggccaggtaaccctctaagcttgcccaggcctggggctccagggctcccattgtggaatgtcttcccactggtggcagagagaggcttgactgctagcctctgttggctctccctcctaggaggactctgggtttggggcttcctaagttgggcctctctcctaattcctaagcatcactctggtagggaccatcatgaattataataatctctgcaatggtgtcatattctccacctgctgggattatcttttgagaagctgtgataggtggcaggagtgtagggtggggagagagaaaggtaaccactcagttgggaaacgcagctccagcttacagagggagtcctcctcactactttataattcatctccagtgttaggaaggcaagacggggccctatgttgtatcctatcattatctagacgggacagttccaggccacacagctgccgggcactgagcagagctcctccaggagccaatcctagatgagatccaccatccttttctgctttggcgacccaggcatctctggagctgcaagaggccaattgcgtgtcaggcagagcaggtgtagctcagccccatagcacttgtgactgagctgcacacgagaagcgtcctggagaaaggaagatggactcagacccaggggatctgtcccctctggccccaacaggccacagggcggttccctcctacactgttccctatcactccagtaaacagccatttatttttttctgctgctgactggccaggactgccagcccagagaagaaacaagagttggtggagaagccggcagtgggggaatccaaggaggagaagattgagctgaaatccatcacggctgacggagagtctccacccgccaccaaggtgaggagctgtctccttcctggagctgtgaggccggtgctggggagggagggccacagccttcccaggccagaaccctgtggagaagaggagagaaagaaagacacccagtggaaagaaagccagtggggatgaacaggagagctgggagggggaagataaggcagattggctggatcccagccatctgctgatgtcttgaaggagatatgcaaagtgacaagtacctatttttgagctaagtcactgactaaaatgcaacttcaaggctactgcaagcctcttaacttggggacgtatctaactattcttcccccttctcccctgtgactgtctagatcaacatggatgacctccagcccaatgaaaatgaggataagagcccctaccccaacccagaaactacaggtaccagtcccactgcctaacctgggattgggagattgggggcagagatctaaattctaaagccacgtgggagtggccatatattagggaccatggttccagtgtccctctgtaagtaccttccactgctgagtgtcttctatctctatatttaagcatcatcagtcagcatctgggaggcaggtttgtttctggtttcctcataatgagatcacatttgagcagtgcttttgtgtcctttccaagttggattcagtgtacatttaaatttttgttacattacatgttgtaaaatcatcattaatttatataatgtattagtatggcatatgttgcaacattatgctcacttaatattaatagtcaatcccaagtctgccttgcccctactcaggaggcagtgccgagtgcagggacagctgccaccacagatgtcccacttgttgctttaggcaatgatttcaggtctcattataaaaggcgcgcttactgactccatctttttatgcttctatctgatacctaaattggcaggcagtctgcttctcaagagctttaatgtcagagatcagaggtcctccctccaggcttcacttccctgctccctgaaatcccataccctgtgcaaggcctgggcttgccttcctctgacctaggattgcagatattatcgccagtttcaagcttgaagtcaataacatgctatcaagggactgttgattttactgacatttccttgttcctgtaggttaggctatatttgggttgttcaccaagttaggtggctgagaacctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaatggggacagagaagataaatggaacaagattagcaaaatgtccaaagttgttgaagctggttatatatatgaggtttagtatgtgagactgtactcttgtgtaaatctttaaggtttaaaatgaaagacagtaataaaacaaattccttagagccctgagaagagccctcccatggggccagcctccaggatgggcctccctgcacacacaacagggcagatctagcatgagggtcttttcacacaggcacccagctgcagccaggcctgtacggcagatacacctcttgcatcttcaacaaaaatctcaaattctattaatctatactcttggcttttcttttctttgttgctctaatgaaatcaaagagaagaatgttaattttaaaaaaaaagggctaatgaggattttgtcaccaggtcggccatcctagaaatgcctctcacgtagctacccagtggctctgaggactgggggatgcttacgctttccagctgaaaagctcttcccaccctctgctgaggcctcaggattcttgagatttttgagtgtacggcccgctccccgtcatttctgttggttacatgtgtctctttactttcgtgttgagacctctggtccataccctgaggctgccctgactgccccaccacgtacaccagccaccactccggcctctgaagccagccccaagcatgcccatttgtgcactatccctggtttccaggtcctcatccaggaggtccaaagggcagcatgctcttaaagctggtggccccacacatcactctgcccccaaaggctaagttagcttgtgcttcccagctcttcctgccttcccatttcctcccttccctgcctccacagtcagctcctggatcctttagtgccaggtgcagcagaagttcccagagactcctccgaagatcacgtggcctgttgtctctgttctggtcaatctctggttccttcctgcttcttgttctcccgaaccacgaatggcaaagatcctgatctaccattgtgctcccaaccgctgccccttccaggccgctggcccctgccatgcctggttcatgcaggtaccccttagcaggcagcactggtgagtgtccctcctgctctgccttcagccagaccactagggagaaagggccggtgtcagggagcacactgccatgctctcctgctccctccctgtctctctcttgccctgtctcctaggcttgccccctgccctctccctctctcctgggctgtccagattgcacccaaagtgatgtatcagagtggccaagtgggagctggactccagagtgcactctgctggctgcagcttcaattaccctcgcatgaccgcgaatactcagaggaggggcctgtttctaattcaacaaggggccatcgaggccagccatggccctagaatccttccctctctgtttcatctgaaaagctcgccagctgctttcaacctcccagatcggtataccctaattatagagaaaaacccaactcactgaaaaggaaagcattgtgcccagatgagtggaagctaattctacttttgtttaatttattaatttatttgagtgagcatgcagatgtttgcaagagccactaaggacttaaagttaacaggtacacactaaaaaaaaaggagtgccaccagacactgagtagtcagcaccgcctgtgctgggggaggctttcattgctgcagagggttcaaggacaaggagagccatgaggtggtggagtctgggggcttcatgcagaagggtggtcttgactgagctttgagtcagggagttggagaggctgaaggagttttttcaggatcgtacaatcatcagagatgctgagagttgggaggaaccttgtagatattcatgaactactcatgaagcatttaatgtgtgccaggcactgtgctaggtaccagggacatgggggtccttgttgtgggcaaacagggaagacccccaccctcctggaactgacatatcagtggggagacaggcagcagacaaaccaaccaaaaaggtgacatcacatgatgtgaagatagtaaaatcaaggattgtgttaggggatactcaggggtcaggctgctttgactgtgtggtcagcaaaggcttctctgaggacacagcatttgactggaacctgaaggattcaaaagaactagacatggaatcggagcgaagagctctctaggtggagaccctgagtgcagagtctcttacagggatgcacttggctgtggggactccaaagagggccagtgtgcctgcagcagagagaaccaagggatagtgccctgaggcgagaggccggggcagggcaggagggcagggcagaaggcgcagggccatgcgggaggctgggtctgatccagtgccctagagggccaccagaacgtctgagcagaggaggccctgacctgatgtccgactcaccctttcagagattccctctgagcggtgtgaataaagagcagtggtgttcgagagcagaatgggggcagggaggatacttgcgcagtatccaggcagagaggatggcagcttggacaggggatggtgccggagatgcagagaagtggtcaggcttggggtacattttgcaggtaggaccagctggattcactcacagcttagatgttggagagagggaaagagaaatgtagggtgattctgaggttttctaattgagccagcgaagagaaaatccccaatgcagaaactgtatccaccacctgtgctccttgtgccccaaggcactgctccgggtgtctggcccttaccaaccaggcactcccttcagctggtagcagactcttgcgccctgctagaaactaagctccttgaggacaagaaccatggctttgtcttctcagccttgggctcaatactctgtaggcactagatcctacaaatgtctttactttatgtggccaagagcaaaatcacagaagtgaggatgagcatcagatggaggggggcaagggttgccaaggaccaagggtggggctttgagtgctaccctggttttactttggaatcctctgacctgccttctgaaatgcagcagcaactccagcgtgcagcagcacctcacttccgatgcttttttccaaacctccaagaacaaaaattagaaaagaaagatccctaatgtattctactggcatttgggagtaggaggctaggtggttcagttgccaaccccaaaatgagccttgcctgactttccctgatctgtcagcatccctcctcatccataatacctgctaagcatcacgtgctgtcaaagttgtgttcctttacaaatctgagtttgtccttcagaaatcgtttcctcttaagtactgtgcctgaggttcagctgctgtgtgtctgaatggaccagctaacttgcttctccccaggaatggagctcagcatggagcttcataaacgggggggagctcgtgcagatgtaagagcctgcaccgttttccattaggaagttcgaatggcacaaagctatagtaaatatgggtttctgtaaacacaaatgattaaaataagcataaaattacctgttatcaaattatcatgaagaagaaagtgttgggtcatttcgagcaaaactgaaaagaatacaaacacctaggcaggaatttaagatccttctcaattaaatttcacttgaaataccatgatttaggccaattctggttttacttattcgactttaagtagaagacttttcttttacataccaagggttgggtgtcacaagaactccaactcttgtcctgtagacagtttttcatcttgggcctctcttctgctgaaaaaatattaattgtcttgctggtcagctctaattaccctagggaaagaatctgattgatgtctgtatggtactggccctccaaaaaagccttgggtccctaaatgcttgaatgctttttgcttgataaagaattgctttctgtgccaggcattttttttttctttgcagtacctggctttgtttgaaccagaagagggagaacatgcagaggcacagctgtgtccatgagacgagcatcccataactatctttctccagccagactagtatccccttcaccttcatcttatacagagtccccttccttctgaccggtgtggaagttcaatcatcatcaagaaataagggcttctagtgccaggcaaagcttttctttccagggttttcagcacatagggagaagggacagacatttaaaatcagtcatcaaggtactggaggcagaggttctgctgggatccatggaaaggtcattccctggagcgtgagtactcaggaaagttggaaggaggatgctatctggattgggggtccttgtgtgctctgcagagagggagatgaagcgcagctcaaacagagagagagagagcatgaggaaggacggagcacacagtgagcttgtcagctcactagggctgccataaccagtgaccacacactgggcagcttaaacagcagaaatgcatccttttacagttctagaggctggaagtccaaaatcaaggggtctgcagggccaagcgccttctgaaaggctcttgggaagaatcctcacttgcctctcctaacttcttgtggttgccggcagtccttggcttgtagatgcatccctccaatctctgcctctgtcttcacatggccttcttccctaagtgtgtttttgtgtctctgtgcctgtcttgatgaggataacagtcattacatttagggcccatcctagcgcagaataacttcttcataaccaattacatctgcaaaggccatatttccaaataaggtcacattgcaaagttctaggtaggcatgagtttgcgggggaaactgttcaacccactgtagtgaagtgctcagaaaatagtttcgtgtgagtggacagtttgttagggaataataggtggtaaggatctgactgagaaagatgttgagcattaatttacaggcttcgagtctgtcccataggtagaggttgtaataaaagcagcaaacacttacttacagagcggctgctatgtgccaggcaccgttctgaggtatagaggtactgttattattattccaccttagatggagaaactgaggcacagagagactcaataaaatgcccacggctagaaagaaacagagccaggattctggtccaggcgattggctggagagtctgctcttcactcccatgttgttactttcccctctgagcatcttcaacacatttgagcagcccaggatgggcagtgcttcccgtcatgagcgttgtgctggcaagcacaggaataagctgtctgactttggtccacattaaatgtggccactggctgggagaacgaaggcgcttctttaattggtgtcagtgtctaaacctttgcatgaagggcctgctgtggtcagtagtattgccctgttatctcgacagcacatgaatttttttttttttttttttttagttgcagaaattgggaaagtgttggtttctaattcctggaacttccaagagtgaggttatttgcaagggattccacaagccaactcagccataccctttccccaacctgcggcctagatagatgagtaacacctggcagtgccctgtcctacctggtcaccttttttcataccttacaactaggatgaccaacgaccccagtttgcccagaactagggggtttcctgggatgtgggaattttagttttaaaaccagaacaagttggtcgccctacttacaatcccccttattgtgcactgccagatacgacttctccagcagagatgagctgcagcagcacccacagggagacagcagaatgtctgtcttggttggtaccctacattttcagagccataatcatgtctgccagtaggaaggtctctgaaagtggtaaaataagtgggagtgctggagttatttagaatggtgctgttcttcttacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtgtgcagcaatggtggggaaggtggggtcctgctctctctagtaccagcctggcagttgcctgtattttacctgaacctctggatggagactgagactctcccagctccttgcaaattgtataaacaggcactcatttagggaagagtcctggattttgaatcagaagacttgtgtttatttttctctccactttttgaaatgtttaaactctatttctattctttgggtgattacccttgataatttactaattctatttaacttaacaaaatgtgatgttaaacaatatcaagaacctcctcctgtataatagagtgaccttagactattttaactcactcatctgctccttacttacatggaattgtcgttagtattttagtccaacttttatttttaatccaacaagttagtgagtcttactgttatatagatactgtgtgtttggatatatgtacaccttaccattttatttgttcaccatttttttactcatttcagtccatcctttagctagcattttctttcttcctaaagtacattctttagaggctcctttagttccgtaatggcaaattcagtgggcctctacttacctataactgtttcacttcttgctcttgaaagatagttttgctgtgtacacgattttagacagacaatttttgtcctgcagcacaagaaaggtgttattccactgtaaagtcagctgtcattccaactatggtttctttgtgagtaacctaacgtttatttgtagctgcttttaacatattctgttgcctttgtggttgtacagatttactaccatgtgtcaaggtgtggatttctttccatttgtcttgcttagaatacattctgcttcctaagcctatgtatttagatttttattcagttattgaaaaagtacagccataatgtttaaatattgcttctttttaattctatatttcttccttctgacactccaattggacatctgttagacattttcattctgtcctccctgtttcttagagggtcttacatatctttcatctccttgtctttctgtattctgggaaatttcttcaactgtatcttccagtttcttaattctattttcaacttaatctatattactgtttaaaccaattttttatcttgaccattatatgtttttgtttcagtcagttccatttgttgcttgattttccagatccatctctaaatctagtagtttctatcaattcctcatctttgtgatttagtcctttatttcattaaatatttcaaatatagttgttttatagtctatatctaatatttccaatacctccagtctttggaatctaaatcacttatccagtgtttcttcagatttcccatcttaggggcttgtccttttgtgcatctgatgatctttgattgtgaccccaacacttcctcttcatttgtgagagtcctgaagacctaaagtaggtctggggagactttcttccagatgccccttggaggtgttggcttggcctaaaattcccaggctttcctgccccacctcaagactggcttaacctgcaatttcttgacagcactgctgttattggcttccatcttcaagcaattctgccctcctggctggctctctctccatacgtagcctcagctcagtggaggttggtgggaggggttgttggtttgaagcagatgattcttacagccatctcctaactcttataaaccagaattgtctgagagagtttggcccttcgagggtttggtgcttctgcagcaggagggcttctcagagcatttagtcaaccataatgccaggagcagaagtctgaaggcctgggttgaagccctgactctcccacactaaggctgtgtttctgggcaagcctctcctacttgggtttcagtgttcttacctgtgaaatgaagatgatgacacccatcccttccttcctacattgctgtcaagatgagatggtgtacaagacactttggcatttaggaacctagcatttttggtgctatcactgagtgcctagaagctcagttgggtaattgtgctggggcatggaagtgaattgcacatttaaagctattacacaggagcagatcacctacagagagccggtttggctggcctctcagcatacccagctccgggtagtcctattgtgccttatgcataagcatagagttgatctcataaagtgatttcttttcaatgatagggaaaataagtccccaaacaaaagccagttatgaatgtcagagcaggatttgggaattcagagattctcaaaggtctcagatgtaaccttctaaaatatcaaagatgatatgtgcaccatgggggtgagcagttgtcattaccaagcagcagtaagacttcagaatgaagaggtcacttcaggccaacaagcacctgttgccagctgctggggagagctgaggagaggggctcccaagagccgactggtgcttccccttgtctgccttgacttgtctctcctcctgtcccctctcccgtacaggtttcgcctccagtgccaccgcattgtcaatgacacgatcttcaccaacctgatcctcttcttcattctgctcagcagcatttccctggctgctgaggacccggtccagcacacctccttcaggaaccatgtatgcatcgcctgtgtcttctgcactccttccccctggggctgtgccaggcccacagcttctgttgctgacatcattgttcaatcaggagcccaattctaggtgtcataattagatccacaactaacatttcattaagagagtagggctttgatagaaaaccaccctaggaccacaagcaaataaaagagcatgtacccaaatgctcaggctggtttgataattggcaaagatcaggactttcattgcctgtggatgttccccaggaagctctagttccctgcaaacttagtaaaatgtggccactgactacatgccctcccttgctcccagcatgctctgaccagaaggggagcattggcaaataggtgccaatgatatggctgaccttacctaaaagagagtcttggtacctttggtagagtagaaccaaatgtgaggacccacccaaggctctggtgaacaatattaaaggccagtttaagaattgctctatctcaaaacctcaaaactttgtcaagtcccaaccaagtgggcatgaagacagcccgctgatctaaagccatacccatgccaaaccactctgcgctcctggggcctgcttggtccagggctgtcttaccgaggttagcaggtgttggccccatccctgatccatcacctgaaatataataagtatgcagtcctggagccggtcctcagcctgtgcagacctcacctgaaggatgcacctcccttgccccagaggacataacccaggaatagatgtccaccatcacaggaagctggccagctcagtcccaccaacgtgagcgaagcattttgaatctccctgcaaaaagacaaaccccattctctgtccttttgacaagtatcttagtggtctgatttgggtttgtaagtaaattggattaatgggaaaagcatccaaccagatgctgctcagatccagtaccagctgaggcatgccctggaagctcacctcacttatctgggggcttcaagggaagccgctgtgctgcctgaggctagccccgcctcaggatgtctgtgtgtgtgccgcttgccccccatgtccatctgtgtccctgtgcaaaggcttaagtgccaggcatctcattttgaagtgtggccccttttctggtgaacatccactgacctctcttcccgtcctgcttttctcccttccccatcccatccccaccctgttcctttttgttttgcagattctgttttattttgatattgtttttaccaccattttcaccattgaaattgctctgaaggtaaagcccccatccccttctgctcctcctgtcccccttgtgccagcaccaggtctctgccgctgtctgtcgctaacacacatgctccttcctgttggtgtggggttcactctcagagccactaatccaattatgcttatttttcagatcctaggcaatgcagactatgtcttcactagtatctttacattagaaattatccttaaggtaatgcaacctgggcaatgcatcctctgtcgctttctttgtctatctctgctctgtgtggctggatcttttgtcttttctgtttctttcactctctcttttctttactcccaagcctgaaattggaaaaatgagtgcccctcactttgtgtgatgcactttgcccagacttagaagccaggagcagcctaccccaccacagctcctccctccagccacccctaagcagtccgtggcctggaagggacacgtgttggctgtgccaacattaaggctgccatttcactggttggggctgcagccgtcagcagcgccagacatacatgcccacatgcaccagctccggttaactgatacctgagcccacgtaggactctccttccctcctcctgcttcatacactctgaaagtgggaaacctcctggggcgtgaaagaatcacttgagctactctctttggatgcccatccttagcaccttcctcagtacttgcagcagatattgggtctaagctggagttggggctgtgtcacagtgatcacaggcctactgtgagatgtggagctggtctcccagctgagggcttttagcagggccattacagactactgccgaccctcagtcacctgctgcaaagctttgtcacagtgccccttgccctgagcgtgggggagggagaattgtgctggagagctgagtacagcaggatgagagcaggtgccgcaaggaacctgagcacccagcccccagcccccagcccttgcctgctgctggcccagctcagttctgctaagggaactgctgcaacattgctaccctcagaacaggcagagcccacctcagggcaacactgggatgagagaaagagtattcctccatttttcgggtatatttctgagtctctaaaccaatgcgtggcaagccagttcatctgagagtcagggtgtgagttccatgacctcagggaacgtgtgctcctctctgagcaagggggtagattctaccctttccccaaacagaaggactaaggctctgaagcccatgcttcagctttagcttcttcctgggagactagcctgggactccccctcccaaggagtccaggctcccttgtcatcctatcgctgtggccaatgcaagctgaagtccacacctaaccgatgccactgccagctgcaggcctctccttccctgatgagactccctcatcatggcccagcctgttgatggacaggacagttcagtcacatccagatacaaattgaatggggcagtttttatgtgccttcccctgtgtccttgtccccaggacactcaggtgcccccagctgccatccctggttcctgctaaccaagtatgtggctcagatttttcttttctgctcgtggagagtagatctgaccaggccttggttcctggaggtcgggagagggaaccgaaagttgcgtggctgcactaagatgcaccgcggcaaaacctgctttccatggtgagctgctttgcttcccggacttcagatgcagggaggcacacagaccccagagttctttcccaggacaagagacgctctgaggcccaattctcagtgcccttctacagagctgcccttgtggatttcaatggtgctatttctccttcgggattgccatacaagctgaagtgaaaggtctctttgcaagcattgtcatggcaaggtccttccatcccctccctcttctactttcttctatgctcagcatgcttctgaatagaaaccccaatgccggaacactcccctgtacctccttcccactgggtccctcttcccggcctaaggcccggtgtcatgtcatggcacagatgaccgtggctgtccaagggggacatttagcacaaggaacagtggaagggcctggaaatgtttggccttaaaaaggaaaggcttgtaggctcacaacagttggcctgagtcatacaaaggaccgtcacatagaagaggaagaaggcagaatcaagaccaatgagtagaaatcacaaaaaaagacaggtttcatagctagaagagctgcctggagaggcagggatggcccgtggttgaacagagagctttcctacccttccaggcagagctagcgagccacgtcccattcctttccttcctcaggatggaaacaccccagcaagggccccttcccaagtaatggtgtagaattaggaaagcaggaccgaggtggctggcaatcagaaaaaaagggtcaaagaggaacaattagcactgggtacctgagtctggcttttcctgatgccctgaacaccacagatgactttcaagtaaatgctacgttttccccatgtccatttgccctttcttgtacagccactcttcctctggccctgcctggatgcatgttcccaccgcccccacatgcacacacatgcacttgctcaagtgttggtctcatttgagggtccctaaacaaaacaggagcccaaaaccagaggacagagttggcactctgagccttattagtccacccatctgaggaatgcagagtgttctgttagagctcagtagtagcctcagaagatccaagccaggagcaagaagggatcagacccagtgccttcctaacactaaaagcaaggtggctggggaagtactgggctttctgcaggcacaattaatatgaattatgggagcctcctgagtccagtctgtgggggtcccagctcttcaccaagaggcagggaggcaaggcttccagatggtgggccttctagaactatactcccttgcatcttttatgtaatctacccacttctaaaaaccattgcccaacacaggtgcctgagtcctttgggaccccctgctgcaagagataaatggaaagaattaggttgcaagagctatttttgcccatttccctctgtgtttgcttttgaatggctctgcggacactctgccctgggcatgctctgattccaaagagatgaactggaccccagatgaccggggagccttgctccacctctccactgtcggctccacattttccctttggccgatgcttcctgtccgctgcctgtcacagcccttatcctggataaccactggcccttacgcaagtcggcaaaatgagaaaggctgtaaaggtgatttgttgagcacctgcagtgcgcagctttacaccaggctcagagggtggtaataatggccaagtcctgtagcagtcatcgtcatcttgtgtgttctctttttaaaagtttccaaagggctttcacaaagccaggggatagtttcctcaccttttgatgagaaaacagaacttttctcatccaggaagcatccagaattcaaatccaggctgtagtgacagctcacccttttatggggctcaccgtgtgcagggtggcatcctaagtattttacatagaggtacccacttgatgcttacaaccctgtagggtagaccttatcctcatttttccaatgaggaaacagaggcactaagagaatttgagtttcttgctccaggccacaaaaataaaataccacaggtctgggattccagcccaggccgtctggcctcagagcctgtgctcttagccactgagcctcatagcccctctgatcacacaacttttgcccttaaagaactccagatgtagtctagaagcaggacagtagaattgagtttagaatatttggcatcaataataagcaccctttgaggccaggaaggggaggtatgctaattgccagggtcaccactggaacttctcaccaggcaccagggtgaccagctggcctagtttgcctaagactgaggagttttctgggatgcaggatttctgatgataaagcaaatctgggcaaaccaggatggctggtcaccctgctgggcatgccccgccccccaacccacccactcacggcagatgtctggtgctctcagctggcctaaggactcaagcatttggagaggcagtcgggatgtgtgctcccaacccgacagcatcaggaaaggaccctgcaggcccaaagccatggacttgggatgtggaacagtgcgaaattagagtgggatggtggggcccacttgaaagggctttgaatggaggactaaagagcctggcttggcctggcaggtgcaaggagccacccagcagtcctgggctgcgagagtcttgggtggttgtgtgcatggtagcagaactcttttcttggcaccatagcgccgtctttgtccttcctgttccccatggatggtgcttgggacttgcccaagggatgctgtgggaggaaggggtggtgtgaggggtctctgggctagggctagggccactcacactggtgttcctttgtccctccctgcagatgactgcttatggggctttcttgcacaagggttctttctgccggaactacttcaacatcctggacctgctggtggtcagcgtgtccctcatctcctttggcatccagtgagtgggagcccctcagcccacgatgggccatgcagctagcaaggggtgccagagaggacaaccagaccctggagggcctgcctgcagggccaccgcagtgtgatgagagtggggtggggcctccaaagctgtgcatggtggctttgggttcttggttctgtgtcctcagtggtctgatacttggggcacgttgatcaggtgagaatatgtttaattatctgggttttgccatgacaggcagggccaggctcagctattaagaaacggttgtctccaggaccttcctgcctcctccaccacggccccagtgccctaggctgaccttcagcaacccacagtctgccactgccgtgacctcccctgacctggaccctccttctccctttctctcccctctctctccagccaaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtcttgtgtgtgtgtgtgtgtgtgtgtgtgtgtgtgtgtgtgtgagtttttcatttcactggtctggggtacagtctgggtgtgagttctaagagctttccaggtgactcccctgtacagccaagcttgcagtcctcgttcaggtgtggaggatctgattaccagtttctaccaagttctaacagctgatagtgtgaatcctacactttaactttcaaagcacttccacatacacattcttctgtggtcctcacacacacaaaacgatgggggagacggggcaagtgttatcatgattgtatagatgggaaatttggagttcaggacatcatgacacttgctcaaggtcacacctgtggtagagaaaggcctaagtcccagcgttcctgggtctctcctcccaagagtgttttcatggttggctgagatcatgcagggaccaggaccttgggagagacccttttctgtgatcatcagttatattaccccatattttctgcctgggagcctacaagtccagatttgaatcccagcatggccactcagtcactatttaaccttgaatgaggaattcctcctctttagcctgtgtttttcccatctgacctttaaatcccttccattgtgattcggtgcaaactgactccctcccagagagactgtaggagagacacagtgatagataggaatggcctttgcatctcttggaataaaagagtcatgcaccagagaaatcggatctttccaccagccccttgagcacatcatcctgaccacacaaagcatgaaatcagcgcttgctggcctgtcattcattgtttaggtcccaagacaagtatgaggctctccaaaagcttgagaggctatctcaggtagttagcccgtgagggttaggatgtgctccatagctgctcaccaaggtggtatggttaatgagccccacctgggtaggatggacagctccaaaaaccatccaggcatcttgcttagggacctgtctcctgctgtctccattgcactagggaaaagccgtagcccgagactccgagaagctctggcttggcctcagcatcccaggtgtatggaacctgtagtgccacgtaggagccaaagggactggccttctgaagggtcactgaaaaatcaactgacaaaagaaaggttaattggagacaaagcattcacatttatttaacgtgtatacacagagcctatagaatgcagacccaaagatacaggggaaactgaccatttttctgcttaggttcaaaaaagtatggacagccatgtagaaatgtgattggacaagaagcgtaggatctaacgtgaatggaccgagtggggaacccagcaaggcctgtctctaggttcttcttgtgctctctgtgaagctttccctccttctgggtcggggcaggatcccgtctgcaacaggagtctgaggatctacactcccacatggtggatctggtcattttttatggccagtttttatacagaaaaggagagggaaattttgaataatattttaggttgtgtggctggctttgaggaaacggggttctgggttctggtttctgtgacccatcttggggaagagggattctagtgtctatggctagcctgagaggagaaggggactgagacaggagggcaagagaaggtcagagaaaaacttttgcttctgagactgcttctaaggccgtcgtttcggggtgttgtttcctgagccccaacagcgaagcccatccttccttggagtcctgagtgtgctctgggtgggttttatgtttaggtgtcaggggcaatatgtgtttggagataaacactaagaaatctcctccccatgacatcacctccagccacaaggcccgagatcccaccgttagtacggcattcctttaagtgtagtaacgtcttcagcaggcctcatgagcaggtaccattcaggcagtttctcaagcacatggctgggtgatttacatagaattcttatttaacccttgcaaagaccttctgagctgattacagacccattttacagataaagaaactagagctcagaaaatttaggaaatttgtcctcagtgccttggctagcaagtgcctgcactggggtctgaattcccatggccttgctctgaatttctttctgtgacactgtgaatgcccctgtgagtagcacagtacattgctaatgacctgccatgagccaccttgcatattatttagtcacccacaggaaagccccagggttacaggcaagctccaggctctcacgggatgggagacaggagtagagagtggtcccagaatgcgaacatccccaagatgggctttatgttttctcaggtttgcctcggattcacctgtcaggacattcccttaccacattatttttgctccccccagaaacaggaggagcttactaccctgcctgtttccctctcccaggtccagtgcaatcaatgtcgtgaagatcttgcgagtcctgcgagtactcaggcccctgagggccatcaacagggccaaggggctaaaggtgagttgagggcttgggtagggagtctccagccagcccattggggagtgggagctccacagaggtgaggggtgggttggaaggagatgatggtcagaccaagtggctgccatgtggggtcccggacactggtcccactgcatgtcccggttccgtaatgaacagaatagtaacagaggcagccatcccaagtgtctgccctaagcagaatgtgccaaagggagatcccacacaaaccctgtgcccctgtggtgccaccatccctatattccttccactgtaagatgggaggttggcaggacttttgtccttgtagtcacggagagtccagtgggggcctttgcatcccattagggtccatcacttcccatgtgactttgggagcgtggctttgcccctctcagcccaattactccccgttgtggcaaacgggctgcccctgctacctcctggaaaggctcctggcatctcctgaagccacgtccctctccccgtcccttcccactgcagcatgtggttcagtgtgtgtttgtcgccatccggaccatcgggaacatcgtgattgtcaccaccctgctgcagttcatgtttgcctgcatcggggtccagctcttcaaggtaaagtctgggctccgttgtggtcctcctacctcccctcccatcagcattcctggggaagggaactggcagatatagtacaaacgagacagtgtcctgagccagacttggcttggatataacctccacctgcagcccgactcaaccttcagaccagggtagggaggcgctagaaggaggcatcgggccaccaggccagaggcccctcaccctctccacttcacctgcccttgaggtcactgcccttccttctagaaagagagagagagggactttcatcctgtggaacctctgtgtcagtcagttgcttaaagcctgcagcggtgacctattatcaacagcatcacgtccccactgcaccacccagctttcagagccctgcacctgtcaaagtcagctcctgctgcttcctgcagcacccctcgtgtcctccttggattctggtcttttttgccctcacccttttagttctgctattctcccacctagagcattcgcccccgctcccctccactgtgtaaacgcccatctaattcatccctctgagcccagctccacttctccctccctggcgagacctccccggagagtacagctcccatggacccgagctcctgtttttgcattgcagtgctacttgcagcactggcgtctgtattcgccaccgttctgtgcgtgtgagtcaggtcctgcccatctggattctgcactttttatcccactgtccctagcacagtgctgggctatggagatgctcactaattgcttttggattgactcattgattactgaacatctctgatactctgttctctgccttccagggaaagctgtacacctgttcagacagttccaagcagacagaggcggaatgcaagtgagtagaggtgggagggcagccagggccacggccggtcagccccaggaggctggaggcttgaccagaaaggagggacagctcattttctaagactgcagtggcacctgcgctctgcctgtgtgtcatctggcctcacggacacaatgtgtagcattttttgttcctgaagtttctgcccactgaagctcctcccatggctagaacggtgaagttcaagccaggcagtcccatcccacccagcattcaaggtcactggcaggccaggcgtgaaggaagatgggagatcccagagtaaactccttctcctcctctctcaggggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagtgagtatgcaaagcaaggccccacgagccctgacattcaagggccagtactgactttccagcccatccccaagttttgttaatgtcccgcactccctctggaggtcatatttacctgggtcctccccaggcagtgaggtgtatttctagaacttacagtccactgtcactgctgaaaccgactcttctttctctagaaggtgtcaagaaactcccaccaaaagtgacctttttttagccctctttccaacctcagcatgagccacgatgtcagagatctctgtcattacccttatggcatctgggagttgggtgtggggagagcttctccaggtgtgggccctgtggtcaccataggattcaagattgccactcccagcatgcccttcattgggtaaagatggctgagatgtctttgttttatttgactggatcccggtctccttagaaaaagccttgcctgtatttacagtggaaagtaggaaagggatggaagcccgggccccacttcctctgcagaggcaatgcgtttgtgcgtagagcagcccgtgggccttgcacgctgcatcacctctaccaggcagcttcccatcagatccttatatctttgtatagatacctgcttttcccccaatatgtattccagtgaaattagaatctgaaagtcagaaaattctaaatgtttctaagtcaacagcaatgcatggatcttaggtaagagtcacattattatgtggtaagatataggtgatagctggagaataaccaagtgctgtgcagggctacagaggaaggggaagagataatccctgtccatgaaaaataacaagcttcatggggcacacagcccaggctcaaatgaatggcatatgtatgtaaactgcttatgtctaaaaccaggccattggtgatgatcggagtagcatgggtcatgtgagtgtttttatctaagtggatatttgctctcggagagatttattttacattccttctaacattctctgagctcatgccagtttgcaaagctgtctcaatatttaccaatatttccagtgttttaaatcaatgtccatgactcatgttacatttaaatagctcttcacagtttcaaaacaccttcctatacattattctaactaccctgcaaggtaggaaagtcaggaattattgtctccaatttacagatgaagaatctgagtctcagagaggttaaacgctttgcccaaggtcacacagccagtaagaggccgagctgggactccagcccagagctgtctcctgcaccctgatccctgggatccctggagcagtggtgccgtccttccgcagaggggaccctgcttctccagttccctctgtgggacctgtctcctcctgcaggctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccaggtagcttcctaggaaggagcggagggaagcggggcccacggagggaatggcagcctgcggcccaccccgcagaggggctgcgacagggagaggccgtgcagatactgagatcgtctctctattcctcaaccagagtgggctgtcagtctttttgagggacctgtgcaaaagaaatgcaaattcctgcaaaccccagatctggcaaatgtactcagccaacaaatatctatgaagcttctacttaaggatactctatgataggttttgtcaaatctcatgccctatatagaagttaacaagttagagggacccaagtgggtcggcaccatgatacggaggagagaaactagaactgtgagggagtgagggcttttggggtggggaacagaacggcttcaggaaaccactcttacatggtttcttaagtaaaacccagaggcttgtgtgggaggtgggggcaggaaagaggcttaagtgggagtgagatggtgatgccaagtatcgtgacaggttctgttagccgtgaagagctggcagtgccgtggctgagtcaggaagctgtcgtggtgggaggtagatgtagtgcctcaggtctgttccctagctcggctcccactgggaggagtccgtggggaaacacatccctgtctgtgaataaggagtgcccacgggcaggagcgcagcgtggtgtgctccttgtgaccctcgccaggccagccagtcccctgtgggttttcaagtctacatctcaggcatagactcactctgctggctgctgtgtggaccctggattgaaagaagacaggaaagagaggaggccagttagaaagtggaaatgagagaggattagaccccgatctagtatccggttaatgatggtagcgatggaaagaataggaggaggtaaaagcgttaagactcaggcgttggacaccggggctgagggtttgagaagaagctggggacattccccagttcctgatctggaagcctgggcaaagtacagagaaatggactggctctttgccagagtcccaagaatctagttagcccagaatctccttccctctcagtgaactgtgtttttccatcttatggacactggcaaataagaaagattgatttagttggccaggcacagtggctcatgcctgtaatcccagcactttgggaggccaaggtgggcggatcacttgaggccaggagtttgagaccagcctggccaacatggtgaaaccccgtctctactaaaaatacaaaaaattagctgggcgttgtggcgtgtgcctgtaatcacagctacttgggaggctgaggcaggagaatcgcttgagcccaggagatggaggttgcagtgagccaagatcacaccactgcactccagcctgctggatttaggacaggaaagaaaaactgaggagagaagtacccaaggagggtctgtggcatgggaagtaatcagtgagaagcacagctgtcagtcggtcaggaagcacattcttagcgatgccgactccctgccgaggcacatgccaggcatcaccagggtgaggaaaggaggtgtatggtccctgcctaggaccttgttacggggatttgacaagaaggggctctctccttgattaagggggccatggaaaaatcaagacattttccaaataacacctcccacctgtaagtgagccggagcggccaatgatttctcagacttccggagaaccccaccccacagtgtgtggtctcatcacatcccacacttctctgccagctccccccacaccctccagttaactaaccccactctccccatcctccaccaccctcccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcaggtcagtcccaggaggagcacagccatggtgctgcagaagggagtgtgccatggggatggaaagtgtaacggagcggcaggcagctcagtgcatcgctttcctggtcaccaagggaggcatttggagaaagacgagtgttctctgtcaaggatgtgctcctctctgggccttacggaagaatccatggcaccctgggttgatcaatggagagaggggaggagatggagaagggagggttgagctgaatgcattcattgttggttgatcaatggagagaggggaggagatggagaacggagggatgagctggatgtgttcgttgttggttgatcaatggagagaggggaggagatggaggagggagggatgagctggatgcattccttgttggttgatcaatggagagaggggaggagatggagaagggagggatgagctggatgcgttcgtttttggttgatcaatggggagaggggaggagatggagaagggagggatgagctggatgcattccttgttggttgatcaatggagagaggggaggagatggagaagggagggatgagctggatgcgttcatttttggttgatcaatggagagaggggaggagatggagaacggagggatgagctggatgtgttcgttgttggttgatcaatggagaggggaggagatggaggagggagggatgagctggatgcattccttgttggttgatcaatggggagaggggaggagatggagaagggaggggaggagatggagaagggagggatgagctggatgcattcattgttggttgataagtggggagaggggaggagatggagaagggagggatgagctggacgcattcgttgtcggtaaggtgtggcgtgtggagggaggtgggttctgcatccacctgtcttcagggacagagcttgttcccaagctctcttgagtgccagagtctccataaagttgtcacggccaaccagggaaatgaacacagatgtgttcagagatggcagagcagggaagatcttggaggttctcctgagtcctcctgactgcccacggagaggtgggcggccctctgggggtttggttcaaggaaggtcttgctgaggcgagggccttcgagaaggctgggcaaaaggtggggaggaggagcgacctccctgccccgtgttcacagctcctcccctctcctgatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaacctctgagcctctcctaggagaggcaggtgatggtctttctcctatgtcccatcctctagtacataacctgttaatagaagaaactatgctcatagactggcagaccaaacctctccaggcccagccccccagatccactcaggcctctgttccaccctcctcccatttcatcagccacacagaccaacctcatataaaacattcagccagggctggatttgctcagggctcaggactgagggctccagcccatgggcactcctgttccctgcctaagaggctatggcattgctccttacatgctctggggcaggaagaacaattaccagcaaatttctctgctttgttccttgtgtaagggcaagaagattaggcctgctgctgaatgaggcagggtcagaattcctgttctttggatcatctgtgcccttcctagccagtcacccccattgtcctcagtggtggaggagcagacactggtatgagccacaccttccaccctgggcctctgtagatgggtcagaatcacgggtatccactggccgggattcaccaccaggacagctgcttctgagggaggctataagagcaactgagcagcccccaggctaccataacaccttttggagaaggatgagaaggaacgagttctaggagcatcatgcagttacagacttgagacaatctctccagcttactgagccttcccctccctcctttggtagttttcccagaggcaacacagatcaacaggaggccaagagcaagaatccctggccatatcttctattttcattcaagtttttactggtctcaagattaattgggggtgggggagggtccagctcggcctttgaatccatgttcattgaggagatatccacagccttctttgaatgaatattcactcacactttggattccatatcatgtgctacatgtatatcatcgcacgtcattctcaaaacgtccctttaaagtaggtattagcatccctctgtggagaagggggaagggaggctcaaacaattaagtgcccaggattaattgatccactgctaagaactggcagaacggagactggaatccggcacctctgacttcactgtattttccaccacactgaggttaactatcattttcccatgtcaagtgttctgcgggtattttttagcaagagggaaacaaccttggagggacttaaaagataagacaatattcctacaatgcagattcttctgtcactcaaagaatgcctggggatcccagctgattttcatagaggaagtctcctaagggacatcctttggtgatagaacggtggtttcctgccttctccagagaagcaagtacactctttttcaccttcctgtacaagtcccatttaggaggacagatcttgtcctgacctagagaggacccctgcgttgccctgacaccttccttagggtacacggtgtctgtgcccacacatggtcctattccaagccctgcagcccaggagctctgacagttcgccacccacagcagcatgaccagctgaggccaggagtgcagtcactgcctagccgagcctcagtctcggatgactcctctcagtggggaaactggcatcattttcatacagtgtcacgagacatatggtttaaatatttcaaagccttgagtcattccacagttgactcagatgtgtttctgacgatgtctgaggcagtctggagagcctgcagtggactttctgaatcatgcctcctgagcacgggagacatacagacaaccttccctgggaagtgcatgaaattgacacctgcaggagcctccgtcctccgtctaaaagacactccacctaaatcctgccaatcaaggaacaagccagtttcctaggaagtaaccattgcgagtggtctaaactgtaaagtgcctcctaatttcctctgtccctggttttctattgtgagaagatggggcaagataacagagacttttacccaagaaggaagacagccatcctgggcccatttgcatttcacattccagggtacatctatggtgtaaagagaaaggaaaatggatctttccctgtgaatttccctaaaggggctctggcaagagggggataaaggtcaccacccagttaggagcatcatggagcacagctgagtccctggattcttactgagctatgttcttcattcacaaatagactccaggtaaagcagctccaaaattttcaggcagaaaaccaaactggaaaaacttgaagctctggaagaatatccagctggatctggcccaagaaccagtggcttctaaccatgacctgaatccatgacaactttcatttcccaccattaagtaggactctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgttcccaatttcttcatttctgtgtgttctcctcaccactccatggaaaataaatttactcaagtaagtccctgccttaaatctaaccatcccactccttaaattcatactctgttcaaaaaaaaaaaaaaaatcacacaaagaaactaggaatcaacataaaccagtttagattgagtcggtccctgacaaagcctcaggaacctgcaggcatggtttgaagagagtgaggtggatcatgccagcattgatttgaacagtgaacagtgacccagaaggatctccttccctagaagtgagaggccatgacctggagataactggatggcccctgcaccccacacgaaggtgcaggaccaggctgggcagcacgaaaagtgctggctggaatattctgaaggtaattaaataactggatagtcctatcatgaactgaagcttgtcagcaaagacaggaaaataaattttgaagatactcttatagatttgataaactgaaaaatatgcaatgcctggggaaaaagtctaacagaaatggctaagatctctacagagaaaatgataaaattgaaaggaattcaagaaaagctgataactgaagacatctatcatgttcctgaattggaaagctcaatattattaggatatcatttctcctcaaactgatccataggctcaataccattccagttaaaactcccaattgcactttgctggaggtgaggatggcaggagagggagccacacgtaaatcctttacggccaacaggatgaggctgggtggtcctgaggcttcagccccttcgggcagctctgaggtcaccaaggagggaatgcacaggagcctggcgcgggaagcagtgtctgtctcagctactccagtgtcggctgctggtttggtagtgggagtgatgatgtcacttagttgcctgaggtttgctgtcgaggatgtctcagcaagggtactgggggggaggagctgcaggaggcgatgagtgagaggctgcgctccaagcttctcctcctcagtggaatgtggtatgccaggaaggcaggggttcaccccgtggaaggctcctaactcctcccctccacacaggctccacctgggccgcagaggggtgaagcagctgagactcacctctgcccctcagctgaagccatcccactcagggagtagccagtgatcacctccccaagaggaggacgctggaagggccttgaccctggcagctctctggaatccaagtctcggtctccctttttggctttcccccagcctgagaatggtccagaggggagaatggacccagagtgaaagcactcattggcccctctgaccccctgctttcttgaataagcagctgaaacctcgggaggcctggcccctttcccacacgttcccagtctccgctctctttctgtctgggcctcctcagcccagctgctccagcttcacaaagccagatggtttctctcatccccctaccctttcttctggtgattttcagccagaagttgacgcatatatagtggagcccctcttgactgggttagacagtctctcgccctggccgagtgagtttctcccactgtcagttgccccagccctccctggccttccccagccagtggcagctgcaagcacccagccctttccctgcagactctttcccacccagtcctgagctggccctaagaaggcagcaagcgcaggtgaggtctggagttagtcgctgctgcgagcccccatagggcgtgtcccgtgagccatggggcacccagacactcttttccacagtcgattggacttctgtctagacttccccatcagcattttattgccctagtgacagaaatctaacagccgtgagcccctctgggttcttagctgaccccctctggggtgcagagccttgtccagctgctggccagacttgccgcctcatggcctccatgccacttccgaagtggaggcagcctcctcaccacggctcctctccagacttcctgccggcgcccttgccctgcacgctggtctctgctgggcccgacaggccttaccacagccatctggggctgtggctcctgtctgccaccacacacaaaggacgtggctggcattttcagaggatcagctaagaatggggcagcagttcagttgccacagtcttgtctgctttgaagcccctgttatctttcaggaaagaggaaatgaaggcagtgaagccttggccttgtctgcttctcagagagtagagaggcagaaagaggagcggtttctccggtcccccacctgttgtcctgaggaatccatcaacgaggccctgggcacttcctttatcgagagtgagggatgagtcaggactagtcggtagcctggtgaatgagatgctaccagaaccagagctgctcgggaccctggaggtcaaatgctggctctctcttggggccactcttcatagcacagctctgggcccagccttgccccggtctcactgacacatatgccagctaagctatagggagggccagggggctctggaatggtcgtcctagtggcgagcacctggagttcgtgtgccaaaaccagcccactctgcatcgtgaaggctctgagctgacagaggctgttgctggccttggactttccacactcaggggcagccgtcctcgtatccagtgtgcccatgtgggggcagggatcctgtggcttccagagcagtcttttctctgcaggctctgctgttcttaggactggtttctgctcttacaaatgattcttggccctgacatgggtggccacaggccctgcggaggggagaaatctttggggataccctgaggatgtggctcaaatggaagggtcatcaccagctgccttgttttcactgggcttgtgtcgaaaggcacagatgagggctgagttggggctgtaggttcgcatatggatgggcagagggaaagttggaatgaggaggtgggtgcatggggaagttcacttgcttccatagagaaacaacagcccagtttctcatctactctgtcagctctgtccatgtctagaaacttctgtcctttagatttagcatctggcctctttgggcaaatagctttcgtcacatgacccgaagatactgtggtccctcctccagccagcttggggttctccaggggcatccatgccctgtgcagatgcaaggggactttggaggctgagggtccggattgctcaggtgtggacctgctgttttaggtgttggagtctgtggcgccaggagtgagctgctcccaggaaagggaccagattctgacattcccctggcaggtggagaagttgggagggcaccctcagcagacaactcagcccccaagtcaaaggtcagatctgcttgtctgagcaagggaagagaaaccacctttacgaactgtgggccaggcctctttcccacccaggccagggtgtcagtctggatggtaatcagacatgttctctgcccccgggaggaggcaagtggacggcacaccaaagaacaggctcctgaaggttgccaatggtgacagaaacagccacaggagaagagagtgcatgagcctgtgtcagagcagcggctcatcagcctaaggagaggtgtggcaaaggccacgaggccccaaactgccccaccggtgccctggggcagccagggctgaggcagtgggaagaatgccagggccagaattcctctaaagacaccaatgtggccacctgaggggccaggggaaccctgcaagctaaatccatcaggcctgagctgagcctgccccggaggcaggagagactccgatgtccacagactcttccatggactgttgagagacatttcagaacgtgttcttaaaagctcagtcaaggaccaggagaaggaaggggaagtgggatggccaggaggaaaggatgcacactggagcccgttcctctttttgaaagcggagaatcttctaggaacttggtttgtttttcagtcatgttttcggcagcaatgacattgctggctgaaatgtactttctctccaacttgacctctgcctccacctgcaccgctcaccaggaatcatcctcttccaactgttttaaattagccatgcacttctgtatgatgcagtaatttttgtgaagttttaatttttacaaagcaaattttgctttatgtcttcgcttcatcatccactgaccccagatcccacccagagaggaaattctggtagattgagacccaggaagcctagatcccacctcagcatcaccttgaaccagccagggctgagcagacgggacaggaagagcttcctacaagcacttgttccttccatgtctgtttctctgtaaagtaggaagactgccttagcatactgtggtgagactgagtgaggtcatatctacagaggaatgaaggcttcagggaaagtgccattcagatgaaactcagccggatccctacgcctggggagtttgcgcccagccctctaactcagcaccaaaggaacttcacctccagcctgggtgtgccctcttgtctgtgaccattttaaatgggcccttttgcaatattggtattctgtcgtctttcatcctgagcccatgtattctatcccttcagtctgatttctgtctcacaccatgaaataactttaaggctcatcttaatgcatccttgaagttgggttgtgcaagcatcaacgacgctaccagcatctaaactatcactcccctttcctgtggctaatgcaacccattagtcggcttttcaagccttcagctcagtttttcaccattccctctctttctcggtgcctaggccttgccattcttcgtattctttatttcaagaactctttgtttgtgtgacttgcttagtgttttgctgcaggctaaagttcaccaacaacccccaaaatattttgttgagcagctcacgtgctaggcggtaggcttggtaccagggactcaatcatgaatacaagcaggtaggtaaggccacacttgcctggggcgactttggcccactcttgagacttgtagcatccccagttcaccctctcatttgtcactaggaaaactcctgtcagctggcattcatatttcaacttaaaagaagcagtcgataatcaatgcctacacctgagatcaagtaacatttagaagcactggagggaagcaaacaacatatattgtcaatgaagaaccagacatgaagctggatattttacttgccttatctcattcaatccataagacgaatattatggcctcccattttacatctgaagaaactggaggtcagaaaaaggctaagtccagagctggctttttgttgttattgtcagtttgtaacaaacaccatcctgcttagtatgcaccctaatactgctctaagcaccttaataggaatgcatttaatcattgtaaaaatcctgggattctattgcaggcttaggtgactcaaaagccactctttccacgacaaccctattaaaacaagaaatgtgaataagccatgttgttgctatgcgcttagtgagtcctcagtaaatgttagctgtcttccttctaagatccgagacagaaagaaagaaagccattctcgagtcaccaccctctggaatggaaagtgttcactccactcctgtgtcctgccaccttctctgaggccccttgccgtccttccctctcattcagccattctgtctgtggcccctgcattccctagattgctttggacctttgaattttgtttccaaatctgagttgacaagcactttcaggagaggggtagtcagctgacaggtgggctcaggaaagtgaaaccgaagcctactacacactcatctgcatgtgtttccacacacacatgcacacacatttgcaatgggaagacttacacattggggacacaaaaattgccaaattcatcaatggcgggagctgtttcatgttcatctctgtgccatgagaggcattcagtgaaagtttgatgcatgcatgcatgaatggatgaatgagaattgtgagcccggaaaagaaagtcggaatattagtgtcagaaaggattgagaccattgagcttccatcagtgcagaaatctctacacagtcctactttctgccatacaagtctccttgtttctagaggtagctctgttggaaatccttctttatactgaattaaaatgcacccctctgtaacttccacttatccgtacttccttttccatcttttctttctataagtagttcttgagcgcctcagtgatgatgttgaagcatggtaccatctttatagggctcacagagtagtgcgggagacaccaatacacaacaaacaaaggtttcagatggggtaagggctggggtggggaaactaaagagtgtgagtgaagaggcacctgtttaaaataaggaggtcaggaaggcaccatttctgctgagccctggagggtgaaaaggagccagaagaggagcatttcaggcagaaggaagagcaaagaccccgaggcaggggcaagctcagctcgctctggaaactgagagtggcgcgtgaaaaggactgtgccagagcgcacaggcccttcaggatcacggtgaggggtgtgcacttcctctgactgtccttggaaaccgcagggatgggccattcagtggggaggattatataatctgattttcattttttaaccagcatgctggctgctcattgacaaatgactggtgtggtgagatggggagcagcaaggagcctgatgctgggaaggcaggtggcagtggaagagatggagcgaggggggcagagtcatgacatcactggatggcgaattggatgtgagggtgaggaacaggaatcagagacggctccggggttcctggctttccctgagtggatggaagagtggtgtcatttgctgaaatagagaagaacaggaagaaaccagtttaaagtgagaatgtggggatatattaggttagaaaatgtcacgtaggctgtgaaaatctggaattcagacaggcgatctgggctggagatgtattttaggagtcagcgccatctattccctctgaagatagaaactccaagaatcctgtccagaagccttcaagtcctgggagaagagttggagaacatgcagaatcacaaggaaactgggagagaagagaggaaggagaaggaaaggggtctggaggccaagagccaggaaggctgaaatgaggggtggagaagaaaatatcattccccaggataagagtagggatgagttaagccagctgcggagaagaaagaaacggtcctccaggccttctagaaactgaggacaggcagagggaggccagaatgctgccctgctgtccagagggtgacatgaaaagggccggacagaggccagtgtgtgcaggcccttcaggaccacagtgaggagtgtggacttcctctgactgtccttggaaaccacagggatgggtcattcagtgggggaactgcataatctgatctggggtcttcagtgtgcacctttaccctcacccacgtcctcccatactgagcatcacagaggtccctgactctgcccctccttctcccatactagaaatccttgccctggaggagctcaaaagccaggccttcccagaccttgctggacatgtttgcgacagaaccagggccctttccttttcccagctgtgcagaattgaatttgcagtcctcatgattccataaaaggagtttccaagacagaccttctgcacttctctttggctaagaggttctttgctataaaaaacacaggataatgggggagtgtaccccgcccccagcccaatgctgaagctagggacaggcgttctcatacagctctcttctttccttcacaatctttcctctctcctcgctctgcccaccacccaccacctcacctgtgttccgcccctacaatggtcagggcagcctgaggctcataagtctggccggctcagttttccatctcctggtggccttctgtggggcctcaggacagatcttcagggccagtggctgttctcagcctcgtggggataaccctgaccacagcaagaaatgccctgctcttggagtcacttttgaggaagacgttttcatctctatgtagtctttcgatgtacagggaaatgccttaaaatcttttgcaggagcccaggccttcgtcgttcactgctctgtgttcagccctgctctttgggaaggtattcaagaacagtctaagatgttgcctgaagaaaaaaaagtggcagtctagtgggacaagggtttaggatttgggatgaaaggaaagtggctgtgattgggtcacgttcaaacatcgagactgttggttcctgcctggcattctccctcccatccctcccctgccgtagcctctctgggtccctgcagaagcttcgctgttcctcgtggttctgcttggtcctgagtgcccccacgagcctctccatggttccccattgtccacagaggaagctgctctggccggccccgtcctccagcccttgtctccttttcagagccacccatgctctcaccttttccgtgtaataaataataaacacctctagtgctgcatccttcaagctgcctcccgagatcagcctggctagaagtggtctccaccacctctgagcttccagagcacccttttccctcttttctggtacttaatcagagctcttgatggaaatgtctcatccttccagcaggactggaaagtctttgagcaggactgtctcttggtggcatccacactgacctccttccaaatgctagcccaggaatgccgtgtgcctgtcatctctgtcagtgtcagctgaatgaaggccaacggaagacaagacaggcagcttcctctggggtgcccctcctcgcaaaagtgactccagcccctggctcacaagctccggcatccagcaaggacacccccttcagttctccacccaccacaggagcttgtcactctctggggtggtctgccggaagagaaagcagagatggaaggcaaagacagtggctccggagccgccatccgtgccgtgctcagcaggacttagcagcatggccacccaggtcagggaaattctggctcaagtgtgctcagacagttcagtgcagaactcagggccagtgagaggtgctgggccctgagactacctcaggccaaagttctgaaattcaaccctcccaggctcattggaggatggggtccttgtttgggggtttgttttgtgtcattggttttttgtaacgccgatgaacacttccacagacctagtgttctacagaacacagttctggaaatctgtagggcgtcaccatgattcggggaggtaaaactgacatttagtgtttagcgggtgggactgaggatgctgaaagtcccacaacgtgtgagagggttctgcccagtgaaggagcatccttgggccctgtggaatgtttgggaaatacttatccaaggagcacccttcatgggtgatgttcagtgacactgatagtgggggagtcttcagtggctggccaggggccgaggctcagcaaggataacactgccactagaaatatgaccgtatcttggattgtatgactgcatttcctcactaacctggaatattcacattgaagaacttgaagagcaagcaagaattttatttcaaaaatcgtacggaaacctagacattctcttgggctaggtcttcaatcctttctggacccagtgctcttctttttggaatagtctccgcacccactgtatactccatgtccctacagagctccacagcgccccgtggtggccagtgtcaccccctctctaagaacccacacatagcctcaggctggctgactcagcgtcttagtgacttttagatgaaacctgtttatccaatctattgagaaactgcagtgtctgccaccgtccacagaaatccctaggtagagaaatgcattaaaaggagtagaaaagggaccgggaaagaagggcagcagctgcggatgaaatgcggcaactcttgccccagccttcgccatcggcacagaattcagaggccaaagctgtgtgggccaagctcccgcattcccctgattattatttatttgcagagtgcccacggggcaccgggtgccacgcagtgctccttagacaggcaggccccagctttgccaggaggaccttcccccgctccccccgccccccatggctctgcactcagggatttgcattttgttacaacactgtgacaggtttctttccggccttgtgctggagagcttaaaagtcactatgaagcataaaaaataattatatgacttgcataaagccttcatgtgggaaggctagtattagctattacatttaattatttaatgtagaaaattattcacacggtgtaaaaaagcccggtgggaaagtacactgtggtttccgtctctggccctgccacagggaaggaaactggaacacaccggtctggtaggaagaagagggattcccagacctacagggtgcgtcggcgataacccgacccaccaaagcccgaggtgctgccagtgcttccggccctgcgctgggtcagcctgccttaggggcaggaaggaccttctgtgacacaggctgcgggcagtacaggaaggtagcctctcagcaagaaccccaccaacaacagcaatagtagcaactgtagcaatcagtgagcacgttctcggtgccagacagggcaggtgtgaacttatatcattctcacaaagccctataaggggccaggcacagtggctcacacctgtaatcccagcactttaggaggccgaggccaaagggccgtttgagcccaggagttcaagaccaccctgggcaagaccccatctctaaaaaaaaaaaaaaaaaattctatttttaaattagacagatatagtggcacacacctgtagtcccagctccttgggaggctgagacgagaggatctcttgtgcccaggagatggaggctgcaatgaaatattattgcaacactgcactccagcctggatgacagagttaaaccctgtctctaaaaataaaataaaataaaaaccctacaagggcaagtactctggttattcccatgttgcaggtagggaagctgaggcacagagaagttaggtaacctgcctgcacaacccgaggctcattgtgggaagtgaaggcggtctatcattttattcacatcttgttcaagagtgtgggtgcaggttgccggccagatgccctggccatgcctggagctgggcatggctccctcccccacagccacctctgcccagcgccctgcctggcgtacctgtgctctctccaggagcactcgcccactaggttagagagggcacaaggcaggagtgacaggatgggctgtgggagctttctgagagtgctgagcaggaagggacctctctgtttggggtttggaaagctctctccatggccttggtcctgtggattggactggaaggggttctaggcaggcaggcggttttgaaggctgccacagattcaagccctcccatagcaaaggagagattgctcctccttgttccagccacatctgatgctgcttgtttcctgccttcccttcttcagagtgcatggtgctgttcatttgagcttaaagttgcctgtgtgcatggccatgtgtctgcctagccttatccctctccaaggaggcattgattcagcaccctagtcctggaggcacctttgcagaaaacggctcatttattccagcatgagtagtgtgaagcagctattgggatcccccaatctacccaggtacaaactgaggcagaaaaagagcctcctgagacccccaaatggagcttaacccataaccccaaattttcatctgctctcagtggggaagatggcaggcttcaggagggctgattcatattcgtatgcccaagccttgcatagttacaggcctctagtaagtgcttattatgtgttgatgagataaataaatgaatgagtaaataaatggacgaaggccttcaaaaatgtcctggggaggataagccttaattccaaagaaaaatgggagcagaaagtgtccagttaaaagtgtgcattctaaggagtgtgtgttcctcctgcaactaggagagcagcccccctcgcctccacccgcctggggtcctctcacgaggcaagcacccagccccctgcccactcctgccctttgtccaagcagtcctcaagctagctgtgcagcgtgtgtcttggggtgcttctgaattaacacatcacaggatgggagctgacagaggagggcagaaatccccacctcctcccaggctgctggcagctgtgtgctccagttatgccttctccattaggtgccactaatttccatgattactgttatgtctaaatggcatcctggtgtaatacaatttatattatctctgcttggtgtcggttaccattgttttcatgatattcaatgggatcaactctgcatagacacacagacacgcactgagacttcaccaccaccgccgccagctgccagtgggacccagctcctctccccggttcattcggctctcatcatttctgggacccagaaaagatcagtgtttccaggagctgggcacagctccctcccccacagccacctctgcccagcgccctgcctggcgcacctgtgctctctccagtgcttgctcactcaagcaggacctctgctctcttgcagggacccccttccctaggtccggtgaagccatctgttgcccctccctccctcagcgccaccccaccgtggcagcctccagctgcttcctgactgatgttcctacccctgtctccaagggcccttcagaggacccgttgtccttttccactctctgtctcaatctcagcagccccacttctaatccagccccgaagtcctgcagcccctccagccagcacgctccgtgacccatgtgtcctaggaggggaaaccacgtgttcagagtcagcttccccacagggccggggaactcaggagctggctgcctcccctgtgtttcttggggcagataaggaaggcaggcaggaaggaacagagaagagaaagaaatgagtcatggcagtgacagcacctctgccctccaaatgcctaagactgacagcaccaccccaggcaaggagtgaaaggtgtgcggacttcgtcgtggacgccttcttgccaccagcctgactgaaagctggtgcggcctctgctctgggcagagaaggagcgaaggactcggaattgaagggcaaaggcatgcacccgtcaccccttccacagcagtcccctcgcagctctcctgtaacagacagaaaatgggcccctgccaccacccctctcgataaaagaagagtggcttctaagaacctagcagttaactgtctacatgaactcgagtcttacaaaatgcagccgtgacaacctgcaccctgtcgccaatcccaaacagcgtcagccagatttcattcaggagagtttgaatactagtgacctggaggatgggcagaaaagacctgagagacagactaaaggagaactcaagattccagaaccttcagcttcctccttcctcctttcacacacctaggctttgtttccctgctgttcagtcccacacccaaaatagaacctgtgactcctacgtcactaggcagagcaacgctggtaaataatgacagtggctgaccgggcgcagtggctcacacctgtaatcctaacactttgcagggcggagacaggaggatcacttgagaccaggagttccagaccagcctgggcaacatagcaagacctcatctctacaaaaaaaaattaaacaattagaggggcgtagtacttgggaggctgaggagcttgagaccacagtgagctatgatcacaccactgcactccagctggggcaacagagagagaccctgtctttaaagtgaacattttttttaaaggtagaaattcagagattttggtcatcatcctctgtctggaacattcacacatccagaacacctattcctgaggaggccggatagagtcggtataaagaataggcatctcttggatttttttaaaatacttccctaggtattggtcctcacattaaccctatgcaagacataggactggtgcttgtatggataataatcagattatgattacctcccctcagaaagctcaatctccagccgactagaataaagacaacggtgatgacgagattcttgaaattgcacttgaaggtgtaatgaggtggaagcctctggactctggttgctttttgttttaagcgattgcacacagagggcttgggaagtgttcctccagttggcaggaggcccatgatttcttacataggtagtcatcccatcccttttcccactgggagatgggcatgtcttgtctccaaaaagcagaggacccgggaggtaggcattttacagccaggaagtaccactggaccatggccccacagttaagacacagtatctgggaccagaagaaagcaataaaagatcaggacacatgtgccttgtggatgggagcagaagaaatggcaagttctgagtgctttggatgcatggtctcctttcaccctcacctcaactctgtgctttatcccatgttctaggtgtggaaacagtggtatagggaagttaagttatttgttcaaggctacccagctagtcagtggcagaggtagtgtctgaatccagatctgcctccagagatcaagcttttcaccagtatgctgcctctttcaacttggtatatctccaacgatggagccaaatcagggcatggacaaccaaaatggaagaaaatccacaattctcgtgcatgtgaaatgcatcctatgatgcttttgcagcagttgttccttcccagcaatgattttctgatgtcaataacaatttggtgaccattttctcagcccacccctatcagtgagtggaggtgctctggcactcaggcctaggtactgggacctgccctgagatggccagaggagaggcccatcttatgaacacatctccagagtggggagttggaagggggaaatccactcagcctgtgggattgggggatggcgagggcaaggcttccagctgcaaaaacgctttcccttctgggcagcccgccctgcgtggctctgaggagctggacagtagaggtttggtttgccacttcaaggagagccaggaaaaccctttctccaaccccttacttctcaaccatttgggacacagtcaccagagaaataaggggcaacaggtataaccagactccaggtcagactgatttcgtaagacgtgtatgatttttttcccaccctcccttctccattacacccttaaaacccctattactaatggtttccagcaaccgagggggcgggcaaaaacagagagaagagagatgagacagcatcaagcccttccactcccgagagtgttgggaaaagtattcctcctaggacccaaccacctggggacttggggaccagcaggaaggacctgggccttgtttctgggcagggtgtggtccaagtgggaggaaggggctgttgaaatagtgggaggaggggacaaaggggcaatggggatggaggcctgaaagctggccctgaaattgtcttcatggtccagctggaggactgaggggctctgggcaccaaaggcaggacggtgggaggatgggtcagggtgaagagctgcctcttaaagggaccctgtttgtgcccagacatgtaccctcacccactgcattccagctctgtggaaatcccccagggctggggcacaggagctctcagcgacaaggaacctggttggtttctgcagctcccaggtagtgtgccaccaaacagatgtcagtctaaagcctggagtagcacagcctgctgaggacaagtgtgaggcacaaggccttaactccaacagagcccagccagtgccaatccagtgagagccagcgtggagccatgggaggagggggctcccatggtcaagaaagagggggctgtgccttctgtctgcacatatacaaagaaatctgggagaaagggtgaccaggggtgcacagccaggcggttaacagggttcctttaggtctcagcccttcaccctggtgtgcccgctgattaactgtgtgtgtttctctggttttcaacaccaaacctttgctctgttctgtccatttcttccttttcctttctccatcttagaggtgttgcagaccaaggccaacttacccattttgtttcaggtctctctggtggatgaagattccaactcatcctcctttcttgagcactgacactcacaccttcctctctctcctcctcctcccacaccgaaataatgttttcttgcacgctttctaggctgatgcagagaattcctggattctgctcttgttcttgtttgtctcccttctcttccttgacttccctgcccttcccttctgaaatagctctaccccacaaagacagtattcatatcgagagggtcacccagtgttttccaaaatctaattttaagtcttatgcatagctgtagttcatctggggtcttcacttcttatttccctctccccaaaatcactattctccttttgccctgtgaatgatatctgagaacctgagagcgaattggttatttcctgctcatagcatgtgacttaaatgggagaaagaagtctctctgcctcataggctccactatattcagaaaaataccctgggaagccaacaagaaagccctgatttgaagctgaccctcacctcacccacgccctggtcagctaatctctgcttcacccatcctggctgtccagtctccggggtggcgtttctgttttctttcggcagaaatgcctgggaaccgaaaggcccctttccctgtgacctgacctcccacgctaagaataacagccccaggacagcatgtctttcggtccctctggaaagagggcatggctgggaagtgggaagttaagggagctggatagagctgggaggaaagggaagaacacagattcttggctttgtgagtaaaaaatgaagaggaaaagttggcagccttcaagtgagctggggagagatctggggaacctctcggaggacgcttcatgctttcataccccactccgacctcagaattccacctcctggaagcccagagggcaggcaaatactggtcccactgaaaaaatgtggccagccctgtcttgtccccttcgcagaccatttctaaactaaaggcgtgaatgttttttcttaaagaagacaaatctctgtagtactcggtccttccccctccacccatggggaatatgaccgcctgtagctgggggtgtatggggactatgaccgcctgtagctgggggtgtatggggaatatgatcgcctgtagctgggggtgtatgcacccattcagtcacagaacatcgctgtgcaggcccctacacctcctacacccaagaaatccatctgctaaagagtccactcatccaggacacctggggtcctatagggcctctgggacagcccattccttggttgacctgttgtccaagtacatgaaaaaagtcttttaagaacattcgtcccttctcttctccaaacatggtgaaaaataaacaaaatccatagctacagaatcaagtggtaaagtcaggatactggtcttccccttctgtgccagaatctctccttcagggcaccactgtcttcatccccttctaggcagccagcctcccccaacctaccagcctatccctagcaaacccatcctcaggaaacgctttgatcaccgcgtgccctctgcgcggcgtctgcattcagcaggaccctacctccaaatgaccatgaaagaacctggggaggggcttagaaagcctcagaaagccctgtcaagagccacataacacactcccggagtaggagcccagccttgcctctgtctcctttcccttaggaaagtctttgccagggttggaactgcccctggaaacactggggcacccagtgcaggaactagggtaccctgatttgatctgcaagagttgcacttattatggatcttgttttaacaatttggtccttcttttatttttgagctttatatgagtcaccagtgagcccagataacctgccaccctgcggcccacattgatggctgtggttttcaaagcctttttcattcccagcttcacccataggaccgagcccgctaccctctgaggggtcacacacctgtgttccctccctccagacaggcccttctgctggaagaggactgggggtgcaggagatgctcagcgtggactgagaagagagcatagtagccacatcctgccgcctggcgatttgcaccacccacgccccccacacccactcctgcccctggtgggacgtggacagggcctctgtggagaaggggtagggtgggtggatctgtaggatgggggccacgtgaccgagggaatgcgggcagtagggttagagtgtcgcctccctgctgctccttccttgctggtgctcctgggctcctggccatggtgagggcgtccggaactccagaggcaacacggaggtgcctggacgatgattctgatggtggtgttgctctgttcttgtctgtctaatattcctttttaatccccatcctgcctgccctcccttatgtagggttactttagtgatccctggaatgtttttgacttcctcatcgtaattggcagcataattgacgtcattctcagtgagactaatgtgagtattactctgccctccccaggaaacctcctcattcctcctcctctgcctcgtctatttctctctctctcactctctctgtttaccttcttttatgttttttttaatttcctgtttttacccgcctccagtcatgccttttattgaacctgccgtcgtcctgtgggggaaaaaaagtgggagcttctcctcctttttttccatttacctcagctctgcccggcgctgccgggctggggcgtggagctgagcagagggagtggcggtgcaggggacacaccgcccggctccccggggcggccacagccccacgccacctttgaactaacccagcttttgtcaggcctctgcaccctgcgaaaaccaggttatccaggtttgagctgccagaactgtagagtggtaagagagtgtttaatatgcccacgtaacctctttcttttctcattttttttctcttctctccctttttccatacctttttttttttttttttcatttttcctcttcccttttgttttgttttgtcctttcttgttggttcttcttctctctctccccggctgctctgccccatgcagcactatttctgtgatgcatggaatacatttgacgccttgattgttgtgggtagcattgttgatatagcaatcaccgaggtaaacgtaagtacatggcgtctgtccctaaccgtccgtgcctgctctaacactcatttgccttttcccggtttgtttccttcattttattttctctccccaccttcttattttttttttttaatttgtttgtttgaattggtttgaaggtttttttttccttgttgctttattttgaaatctttttttttttttaactttggaacgcattaggccttccccttttctgttaagttctgattgctgcatcttttctctctcccatacaatcagcctggcatgactcacactgtatcggaggaagcagctctgggagctgtggagtgagaacatgaggggatgtttgccactctgggcagctgctggggcagggacccaaacctcttctgacctccaccttctcctccagccactgccttccctactctctcctttgcatccccacagcatctcagaagggagctctctcaaagtggaacaccctgagataaggctaagactcagcctacaccgtcagccatagcccaccctcgcccaaggaccacccatgatctcgggttgaatgggctctgttttcatttaacatcagcagcccatgcaggcatccaggtccctgcaggctcatttggaagaggaacgagaaggggaggatcagtcatgtctgaactcttctctagaggtggtgggtgacgtactgagagctgctctgggtggacctttcctcctagttgctgtggaagcaggccccatgtgagcgcctcactcccacatgcacctgccacccctgccctcgacccctgacctctcacacccctgcctctggctcccgagcctcagacagcaccccagcctctgcaaggcctcctgccacctccttctcccaagaggtgcctcctcctatacagttcctaccagttcctgcacatgtcttttctgttacctggcatgtttaaatctctctttatctataggcaagccttcttgcggtctttaacatgtgttgtttaattttttcgttattatttttccttaattaagagacttggtaatgtttgcatagacttttgatgcactgaactattgaataacagcacagagcagatgctttagagttttgatctaagatgtttggaactacccagcccaccacccccagctcctccatgcacccttactcccctctccactccatcttttgctctcagtcagttacactgccgtgttatcttgcctgccagattcttccagattagagacccctgtctgctcctcttttagcagatggactatggaaagcggttgtcacacttgtcatatgtcccccgctgtagtctggtgccccaaccctgctcaccctatagctccagagaccatggcccctctgtctccctgtgtctctgagaactgtctttgtccggtgtgtgtgtatgtgtatgtgtgtatatgtgagtgcatgtctgtgtgtgtgtgagcatgtgtgcatgtgtgtatgtgtgtgagtgtatgtgtgtatgtgcactctctcttaacttctcccagtaaatcctcagatcatttttttaaaattagtcttcctactcgtgctctgagactcctctcccctttctgaatggaccccagttttgcagctggatgagccccaagttgctgttcccactcatacacataaaggccagagcttctgtgcccagagcttgtgccatgcagtgctcagccgtgggagacactgcagggagagaaacaggaaagacagggcagcagtgggctctgccctcaggaggtttcctttccagacagcagtgcagagccacattaaaatctatgcagaggggccgagagccccacagcaggaaaacgcagaaaggtgaccgcaagctgcccccctgtacagtggcccactgcagctctgggggtcctatgggttcttcctacagtcaccaaggccccatcgctcagtctgcaattttctcccaaactattcatgtctttaaagaaaaagaaaaaacaacaaaaaagcattttctaggatataaaatttatacagaaaagggggctctgttggggatagggagggggcctgaacccgtccagcagctcctgacattggaatagtggttttctatttacaagtcactttgcatttatctgacaactctaaactaccctttaaatttgacaggtaagaattctcatccccaatttgctgatgctaaaggtgatgatggagagattaagtacctttccagtgcctcagagtcagcctagccctcctggggccagctcacttcctgctaggccagaattcctggtttctgtactccacagtgccttttggtaaagagaaacctcacctgtccctcctggtgtactgccactagccacgacttactcagaacttacattctgtaattgatatcttaaataagcacagggttttttccactttctaaataagcaataatcagccaccctgagagttccgctgcccctgtgtcctcccatactgagatgctccgggctgaggcatttgtggctttgaagtcccactgaaggattgtcgggggacagggtggcaactgtgcatgtgactgacagcaagaggaggtgtcctgagacccaacacctatttcagagccactttctccctctcccacacaactgatggcttccgaaccaaaagaacaaacataacatcccccaaggcaggaaggcggtttgggagaggagaaagctggacttgaagtcagaaaactggcagattgttgagtcttgctgctgcttcctgtcaaagcgttaccaacatgcccagagactctgttttttcatctgtcagaggaatgtggtatttacagcagtgtgttttgaagctcaaataagagcatctatttaaaaactctatataaactggtaaagcactgtggaatgggaggaactgtggcacccaggcaaatgacattccttccaaagttactgctggtgtcactcggagggcctagtctccaaccaagaccttttggttagtctaattataacttacaacccacagtcgaaagccctgtttcccagatatgcttagacccatagagatggccaacaggtacaaccagatcaaagccagcacacacacacttaccacggcccataactctgggccttgaggggcctgctctgaaagcacagtccggcttgaccctgggctcacatcgcagccagtgtgagggacagcagcttaattgagcaaggtcgctccctcccactagattctgcctccagggcattagcagcgtatgggcggccccagcattttcttccaatcccatgggatccttcagaaaatcctgcatccctgggccctgctccgggccttcccaggtatttttagtcatcctctcatcacaagacatatattcccagggatatggtctatttggaaagagtctacattgttagcctcagtgtgatccatgagggcgtttcacctgtaacctgccatctttaactcctaaacccctccccagatgccttatccaccctaactttcctccaaatattccccacatttaaactcgtctcaccttttctcttttccgggctatggggccctccctctcaggaaccatcattcattcaatccacagcatttagagtctcacttcctatacgtcaggcaccgtttgaggcacctgggatccatcagctggcaaaccaaaagcccctgccttcacagatttgcattgtagaagggaataatcagacaattcacaatgcaatgaggacagaaaataaggaactcatacggtgtgttagaagatgatagacgttttaggaaaaaaagtagtgccagataagggggctccaaggtgctggggagcagtgatggcaggcattggtttaaataagatgggcttccttaaggaggtgacagttgaacaaagcaaaggcatgaaggaattgaggattctccatgtggagatcgggagaagaggtagcagggcaggaggagccaacctggctggtgcggactgagctgggaaaggagaggtgagggtagcagaggggtaactaacaggttccacttttgggcttttactctgagcaagaaggggacatactggtggctttgagcagaggtgtcacgtgacccgactggtttttaaagagaccactctggctggctgtaggagtcaagggtggaatctggaagatcatttagaaggcaaatgcagtcatccaggtggaagatgcatagcgtggagcaaagttgtggcagtagaagcggtggaaaatggccagcccgtcactctgttttgcaagcaaaattaacagtgtttcctgacagactgcatgggggcaggaggagaattgcccaggaggactgggaggtttggcctaaatcagaggaggatggagcaggtaggcaaggaggcgggctggaggcggggcctgtgtgagttaggaaatgccagagcacagttttgacgtatctgttagcccttggaggggagatgtcaggtggacacacaggtcagaggcctggggatggagtcattcacaacaagatggtacccaaagccccggcactagagaagaagaagcgacaagaggcagaggagcggagaggcctgggccagggcctctggcgcgaggagatcgggacccgcaaacttctgttcatctgggagatgccgctgaacaactgccaggtgtcacaagaggaccgtcttcaggccccctcgtgcggtcatgctgaattcagcctcagtatctgagccatgggccccggcccttctcctgccaatgcatcacctgggtctaaatccgagcttttcttcctctgtgagccggggaggtaagagtgcgatgtcctgctgctctagggaagcctcttgctcttcctcagtgcttgggtctgaaatcatattttcctgtgattgttcgtgaaagttactacagcaccagaaactgctccctaaacatcccaaactggaattaatttgactgcttgggccaacagcctttcccgacacacttctttttcattttgtattttaaaatatactgaacaatagaaagtgctgggcagcctgaattcctgcattatggacatagagaaacattcccaagttgtcaatgaagaagccttgattatgcttccagctctggtgacttagagcaatgaactccattctctgggcctcaatttccttgaatgcaaaagtgaggagtgagaggtttaggatggtctcttgcaactctagcctgcagtgattctgacttgggcattttctgacagctggaggtggatgcttcattgcccccattgccttgctgggttctgaggtggtgtttcctgtcatcaggcgcccatggtgtcatggggatgcttcctccagggaatcatctgcatagagataatccctgaagccacagtgctgaagggcagcaagggaggacaggctcccttggctttggtggagctcacctggagattctccagagaaaaggagcaggagaaagaccttcggggagcagagcaggcacagggaggggaaagaacactggccctggagcttctgggcacagctctcaggaggaattgctggaggctttgcacgatgcacaggagtgtccagagcagggaaataaagctaagcgaaggtggcactggctgtgaacatgagaagaggaccgacatgaggatgacctgatgagcacggatcaggcatcatgctgaggacaccatacacatgatcggatgaaacccgtgtgcttactctccacatgaggaaatcaaggctcagacaggacgaacatctgcccaaggccacacggtgaatgggaggcaaatcttggattcaaactcatttctgtccaagaattggctcttgcatttcacagtgcccgctggctaaatccctgggccaggctggcctgggcatcactgaagggcagggcccagtggctcctgcactcctcattcagtgcctcctggcaacgggacttggggcggagctgcctgacttgacttctctgtgtcggttgatgctgcggatgctggatccacaaagcctgggatccccctgggatgctcagacagaatgcaggctacacacccggatccgtgtctctggttacagggaacagaaggcaaacgccaggaggcgcagagcagcaccactccctttgcccagttggcatctgcatctgcagctgaagaaagagactgggaggaggggggccagaaggagcaagcagcgacaaggcagggcagagagtgtccagggatcagcatgtcgggatactggtcccaagtcttccccaccttcaggccctgaaagcctttctaccttagtatctttccaccataggcccccaggcacaacttcctataactgtcactcactactctccacaacaatcacaagcaagccgggctcctctctggctctgggtcctggaaggatggaggaaaagcagtcagtcctgagtcatagagagagctacttgctgcacgtccaccccctcaggggtgagtcagctcagcctgcacgactccagccctctctctcggcctgcaacccacagtgcttgcgttggacagtgggcctggctgtctctgtctgcctttgtggctgtaaccacgcctcctgccccctgccatggcagagaaggggccagaatgggcacaagaaaggcaaggctgagtgccccccactgcccatagctgtgatgaggaaggagggtagagagatgtggtcagaaagcagatttgtccaaggacattagggtgtacacaccttagagaccacctagcccaaacccttatttgtttattcctcaaaggtaccttgagcacccgctgtgtgatgttgcttgaggatatacaaattttctagatgaggacacaaaaggccagaggcaggaaacagcttgctcattttcacaggtttttcacagcaagctgaccggaactcccggtcagtagggggctccagtgggtgctgttgccaaccattgtctagatgacattggtgggtgtggcctgagctggttctaggacacatagattaaatcaagttccgtggtctcaggacagctgggtggggcagaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcaggtgagcctttagcaacgtgacccctgagtggggagattacttttgtgaggtccctccccatccccccacaaaggctgttttctactctgcttaagagtatggctggcccttgagagagttagcagagccaccctcattcctagaagtgggatgaagcatctgaccatcagcagtcccctgggaggaggccgaatgccccggatctcaaggtctagggcgaggcttgttgtgtgaactggtgtgatgtggggttgagggggtgcagacagagagacgggcctgagaagtggcctggtgcagcaagtcttctcaaaagcttttgccttgagaagtaccctgcaggtttgacccgaaaggtcatgggaacctgtttttttataggcatccaatttgggttgttaattcagctgtgtgagattgccgaggtcctgatgcggctctgacccatccaggctccccttgccctctgccttctgccccaaactgtgtcactttttgtttccctcaaatgctctttcctttcctgttctcatcttatcaacccacatacggccctctgttcccttcccctccgtgtaagggtgggaggaagttgcctagcacaccttttgttgtggccagacaactgattgtacctggccagtgtctgacacttcagttcctacaggctcagcaacctgctgctggggttctttccagaaagctcgtaaagcaaaggcacctagaagatgccatgagctggtagtgaggagacacaggaaggctcaaagatacgtagggtgcctcgagaagcatggccacttctgttgatgcccacttactctcatatttggtgctcccacccagggaatcatctgtttgtttcctttttgagtctctgccccgccctgcctcacccactctgtttctctgcctttcttctctatcttgtgacctctccctctggcataaggaattctttgatgtagttagtactactggcaccttgatttcattcgtttattcttcatgggctttttgttggtggaggttggttggtttgtttgaatgactagacgctgggctgtccttcccaggggaagatgaaactcccaggcaattctgtgatcagtcttgtttagtgtgtgtttctggcaggtaataacaccttgggagccatcaggctgcacatgataacagtgagaccctgaggcttcagccacttccagccagcaaactggtcactgcagccagtagcacagggcatagctctcagccatccacagcttcacacacaaagcaggaagagcaaaagagggccaggagctgcagccccacgctgggagcccggctgccagtccccttggggccaaagacccctcgaggggagttctgaaggggcatttcaactcagtgtctgtaactccaaacacacaagaaaggcaagaagggccctctccttctagctggaattccactttggagaaacacaaaagcccgtgggtttccgacctgggggtggtggcccgggacagagtcctttccatggtccctgtccatctttagctttatcctggtgcgttccctgccctttgtttgtcttcttctgctcagttcttctcctccatcacttctgtctctccactcacaccaaaccaaaatgggaattctgcttagaattgctttcaactacgcatacctcattcatttgctcttctgtctgaaagccatggcctctaccctcagcttctgtctatcccagctaacgtttgtttaaccttcgcctctcttagcaagtacctgttcattcagctttagaaggcttgcagcttaaaacatgtttgcctttggcctccttaaaatgtcttgccccgctgccatacccagtggctccaagattcagcacctcccgactcctcctgagatgtgcatttctcctggtgggaaggggagataaaaggatcgtgaggatccccccacacacacccttaacctacacctgctggctcctggccatgaagttggcgtcagatgtctccagcagcccctgacccctgccattcccagctctctctctgcaccagcctgaccacctcctcccaacctagatcacctccgaggtctctccctcaaagccccaccccttggtcttcctccacaccatgacaccccccaacagaaccagctgttgtgtcttgcaggtcaaattgagattggaggtagtacaagcggagaagcggagcatggggagggggtactggctggatggagaccttcaggtggcttggaatgaaatttatatcagatccacctccctaagttctggacaagacattttaaaaaatatagcaagggttctgtagcaggaccactatttagagactcacactcccatgacattacttttgacatctgtttcagaggtgcgtggaatcttagtgacactgaggtcatagcattgtctcaatggcagccattggaattgggcagccgttttctgtagggctaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactttttttcgtatggtgaagagctatttttcaactaccttttaagtctccagagagaccatgtaatgtggcaaccaggaaacacatcctgcggcctcccacaccatcctggtgggaaaatcctccacctgggaggatcctgtctctgctggcctctggcattccctgagtatcgcccctcagcatcctaaatgtggcctagacctggcactccaatgaaaataagtgcatagtgagtgccttccagaaacaaagacttcatccactgaggtgttacttctcatttgaccctgaacttaattcagaaagacagctttccagagacctccctctcattagctgccctgcaccactcccctcctcactgccagttctgccaaaacaaggcaatctgcataagcatattgaaggaaggaaatcgtctttcctttctgtttgccctgagcctgttatctggaaccactaaccagagctcgctgtctctgaaaatgcccgacctctgcctcagatacggaataataacctcatttcatttatatcaattacgtgaacaaattaagttaattgccccaatatcatgaaatcattgaaaattaccagatcattagaaaacaaggatgaaagaattggctgctcagaaatttctccacgcctaccattagtggagacagtgccatatgaaaaatcagccagaatgttcaggttatgtaagcagctctgttggctgccctaaaaggggaatgcagtctccaggcttgggggtgtatgtcttcagggaatcctacggcccctttcttccccaagaaagaccacagatgggagaaactacaaactaactcagggcaccggcagcaaatctgggaaggggtcagagattaatggcccaagtattgatggctaccaacaaattctgaatttacatccaaaggtagaactgatgctttgtagtttctcaaggggctgtacttggtatttaaagagagtggcaaaccacagaaactaaaagtgctgatcctgggataccacagatgtccaactccagcaagtccaatctctccttccatctcagcaggggattcatttgccaaggcgaaagggtaccaaagactctaaggatgacgtgggatcatgtaggaaacgcccagggcatcagtagacctcgggggccttgggggcaggggctgtggcttaggctgcttcctattgttaccatgtagaaatcactcagggattgctctctgatttcatcgcgagtggttattcatttatgagaccacggaccttgtaaacagctcctcatgtggaaacaggtgtgagcggtggtagaggcaacagtgtcctagctactcaaaaatgccctgtgaacagcatggcttaaggctcaagaaaaacttaatctttgagtctctagattcttccaaagttggtctctttggagagttgtcattaccggggcaggagaatgccacacagacatctcagagcgtcctcattcttcctctttctactgtcctcatagctgctcctgactttctcttgtctgccattatagagacatgccataggaaatgttaaatcaatacatgttactaaaatacaaaatactatcaagattatctgaacagatccaaagtcaagtcttgaagtgaaatatgacttaaataaatgaggtcttaaatgggagctataaaatgcaacaagaaaaaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatccaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagaaagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagctgagatctagagatccagatttagagtgttctgtaaagcctagagaagtgtccctttctttctcctccctcacctcaccctatatctccaccatcccctaaaagggcatcctaccaactagctatgaaaaaaaaaagaatttgctgagaaatctgttacccaagaaatattttcaggctgcaagcaaatgtctagttgtgcacatttccatccttcaaaaattccataacacattttccttgtttgtaccttaaaaacagaaatacaagagcaaccatctgaaagtggagagtaaaagccaagtcctgactttctagaaagagttagcagctcagatggtcaagatcagtcggggctgagccctctgtgctggagcccaaaacgtaagggcaccttcccagatccaggctccaggaactcggggagagggctggccctgggatactcaccagaggccagtttcctcagctcctacccccaaatgagttcagcagtcagacccgtgagaacagcttcctggggtgttagtgtcctaaattgtgtgcagggctttcaagtttagaaaacaattcaacagtcattatttcatgccaacggtcagggctcgccgcacctatagaccaacagctaagcaaggccatctcctgcctgagcctgagctttcagaacaagccccattatggagtgggttgaggccacctctggaggccctcctcagtgttgacttgaagtcggtctcccctaaacctgagaggccactgcccttgctttgtttaaatatatgtgggcaaggataggctctggggtcagcaaggcctctgtccttcagctggccctgcctggggtaagctaaagtgcacaaagcctaagtcctcataggttaacaatggctaataaaaaacaaattaaaacaggcttggcacagtggcttacaccggtaatcccagtactttgggaggccaaggcaggaggatcgcttgaggccagcccacgagtttgagaccagcctgggcagtatagtgagaccctgtctctaaaaaaattaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttatctaataatattatgaatgtgagttatttaaagggcataggtaggagaatgcctgtgggtccttgattgacatgagacccagcaacacagaccccacactcatggggacgccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagtccctgggagccctgcctggctctcactgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggtagggctccagggtaaggagggaagacaggtgctctaggcaggagatggaagggtggacgatgattcctgttaatcagtgtctgtggctcctagcttccctgtgcttcaagtgaaaggccaccataaaaggtttcagctgggatttgttactgagcgcgtgattgaatttccagtcactccaaccttgctatcccttgcatttttctaaattcctgaagtccgttaaaattaggctgcagccactgttccgcagcaagctggaagcagaaaaacaagctccgttgattggaccactcctgttgtaggagtctctgattcgcgttggttgaagtgataaaagagacgccattcagtgtgaccttgaagcctccttggcccagccgcctccaaaaggctgccgttatgcatttctaaccgggccaagtatgagtttttagaaggaccagtggggttgattgaccaagccaccaagtctgcaggccgaggcaagcttgggtgggttgatgtgttccccagtgcagcctggcgctgcctggccacaaggctgccacaggaaaggctgagcccgggtgctctaccccgcttcctggggactctgcttctgggatcagccatctggatctgcctcctttttgcattgttatttggtttattagagcaaattggtgcatccgaatggcagtgagtttattctccttctcgagcagcattaggaaactgcagccacaggggagggctctgaacagtggaatggaattcacgctgcaagcttggtgtttggcgttttttgggtttttttgtttgtttattttgtttttttaactgagcagatccagatgcccctgtggcaccaacttctcaaactcttgacacttgcagctaaagttctccacttaagcttgttcttttttttctcctttctcgaacacggtggaactgacagctgagttataaaatcctaagcctcctctgcatactcctctggggaaacacaacctccttttaaggagtgaaaatagaagttcaagcagatacacaggtgatagaaatacagagattaaggtcatcaaaggcttcagaacacacaggcagggaagagcccagggcaggacagggctgctgcctgcagctcttgacccagcccctcaggtacccgtgcagcaggtcccgagtcccacctgtctgtcccctgccttgaggggaacgggagccttaggaggaactgaggcagctctaattttgaaatataagaaatatttttgctcttctcctgtttggaagatctggaaagcaggagaggtctctggcttgcttctgggcagagtggtggctgccttcgggtctccctgcttccctcataatctcctgtcctgcatagtgaggggagcggcctctgacgcctcatcagggtgggccagagcaggcagcgcagttagaagggctttagcgctggatattgccagtgagagtctgacctagaaataattaaagataaaaggcaaggtaaagcaaggagtggggagggcccaggtggccctagtaacaacctgagccctcccacctcgcgggaggtgtggacgggaccagtaacaggaagccccgagggtccattctctcccggtgcccgcaggtctgggtgagctgcactagctccggatttggcagtggcttcctcctgggttcctgctcaccaggccgatgtgggcaggaggagggccaagtggggagtcagctcatgttctcaggtttggaggcagaggaccgcagggcagcccgtcctgccccctgagccctggccaggcatgtgcccaagcccccaggctcccccaggtccaacagcagcagcccaagcacctccagtcaccttggcctgcactccacccttcctccccttcaccttccctctccccttccccagggcccctgagggagaccatctgcagaagcctcacttgcaagggaggcctcccctcccttacgctgcccctctcccttccagggtcttgtacagcctgaagggttggagcctcctagaggccccagggcagaggggagtaggagggcaacagcttcggagcaagggctgcaaaccagaccctctccagcactgagtagcacccgtaatccctccctttgggacaggggctgtggaaagtagaaggaggtgatacaaggaaagtgctggagtcccaagcagctggggcatgaggtccttcagggggcagcccaccaggacccccaaatccacgcatacctacagctgggagagaggccagccaccaacccacatcctcggagagtgctgggctccacttaggacacaggactgtctgcccagacaaacgggagacaggctaggactgcttcctcagcagtgcagaggaggggttcccagggcagctggctctgggcctagaagattccaaagcctatggtagttcctgatggagtcgtctgtcctccatccagggcattaagaactaggaatgaaggggaatcggggagaataaaaacacaggaccacagcccagcggcctgggcacagtctagctctgcagagaccatggggctgggctgtccactcattaaagtgggcggccgccctcccatcggagggggaagtctagtgcagcaaaccctggcctgccttccgccactgccactgaggtctgtatttctcggaggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggtagccgcccctcatgtcctgcggcccggggaatcgcagggctgccgcgtggcccagaacacagctgacacaaggaggagccctccactctggggccctgctccttcctctgtgtggcagaactcggccgctctgcctggctccctgtttccgcaccgagaggcctagacgaagcatgtggtttccaaggcaggctcagagccccagaaggccaggtggtaaaggagggatgggagctaaggggaggcagaaagggtctgccttacttttaaccatcgtttatgtctttctgcacaagaatttactggacaaaggggttttgtggtaaggaacaaacctgaaaaacacgggcctggacaacctggtgaccgctatggcccttcgagttcagcatttccagaatctggccatcgccctcctccccgtaggcgtttcagcagcatctgctgacagcacctgtcatgtcctcggccagagtcgcaggaccctggtgtcctccgctcggctagagaggcccttcgaatgggcccaggactgcctggccatgtgatcagttcctccgctcagccattgttttcccattaaaacagagtgacaatcagcccctgccagctcggaggagtctttgtaggtttgaagttaaggagaagcaaagcgcttgggtcacttgacttcccccagatgagcgcagaacccgtgaaggcggtttcatgcttccctgggctggcggaacgcaggcttctctccccccatggaggggccgctctcagcctttccaagacgagaatctgtcagggaagatggtctttgtgtgccccaccctggccagtccctgcccggggacagggcatgcctgggcctggtccaggtgaggaaagatgcccgtccccgctctgcccccagcagcctcctgccagggactgaccatccaaggctctcgagggagctcccaatggccaggctgacccctgcctagtgatgagctggggctcctgcactctgagcccagctcagcccaggctctggggattcggaatagtagacaccagcggaagcaggactgccgctgactctgtacttgggtgcacgcggaacccacggctgtgagttgccatactctccctgcccccccgacatctcctggggctgggaagaggcacagaccgggtgactgcgagggcctgatggcggcgcaggcgttcgggccaggcagctggcgcctgctctgacggcaccctctagtgaccggtggccacggctgaagcggcgcccgggaacacgggctgggcctcccatcctggggaccatggcctgtccccagaagtcacgggggctctggaaaattagttgtctgagttgccaggcagataatgcatggagcgaatagagcgtatggaacccagctctgcaaggcattgcactaagcactttataagccttaaatcttttcaaccacaaaaccgctgagaggtattattattgtttccatttttctgatgaggagactgaagttcagagaagttaagtgccccaaccctcacagatagaaagtggcagaaacaggatttgaacccatgatctttcttttaaatttttccttattaaatgtttccattgcaatagtaatacccgctcactacaactagtgggatggaattaagctgtgtaaagaaagggtgtaacttgccaccaccccactcctccacaggtaaccacagtcagcggggtgctgtcctccacgatttctcctgcctcgtacagacacaccgcacatgtgtagtcggaggaggttttgctcgttcttgattgttttgcccaggtagtgtcgcactatatcgttactctgcggcctgctttgaaaaccaagctgaaatgggaagtcagttccggtttctcagaccttctcgcaggttccccgtagtcctgtgggactcttggaagtgtcccccggcccaaaccgggcaatagctgatggctgcagagacagggatgcggcgctccctgggaaggggcccagctggcctctgcactccagcctcatgggagtctcctgcacttccttccaggccctgccctatgtggccctcctgatcgtgatgctgttcttcatctacgcggtgatcgggatgcaggtagggaggctcccaccacggggctcctggcctcccgctctgtctctccccagttcccagcaccacattccctaacgccttcctccctcccttctccctttcattcctgactgtccctctccctcctcttccattttctgaggcccaaaaagccacaggaattggaactttccccaaatggatctcctgtaggtagcaggagaatgtcccggtacagaatacacagcccagagagcctccctccccgaggcctgggttctgctcttggtagaggaaagacactctccagttatgcaaggggcctcgggacagacacagccccttctcaagaaacagcagcaaggtgtgtctgtttgtgtccagcacccctgtttgtgtccaggtctgatgggcctgagagttaccccaaccagattcatttgaagctaatggctgagagggagggagggaagaaggaagcaaggaagggccaaatcaacacaaggttcaccgcatcaaatgtgcagcagttttctggggcctcccctcccaggtgcccactgcaccattcaccgcaaacctagggctctccattcccgtcttggggctccagcttgagtcccaaggccaaacttggcagggcgcccacactagcccaaagcgcttcctcggccgctccttcaggaagtcccctacttgctcatcgcagaaagacccaagattcagttgccaaaaccttttgagactaaaagagctaccttgatacctgataaaggtggcagtttctaagataagcacagctttaaaagaccaggaagaaaagggatttcaggaatgcattaagcttgccctagcctcagatcactcactccacatcactccaaaatgcaagaactaaatttgaaagagtgcttggacatgcagaactgaaatagcaaagaaaataacgcagtgcgtcctgtgtcctgtcagaagcaggatcccggtcccagcatccaccgctctcagccccagctcccactgggctgcagggaccttcctgaggctgtgggcactttgattctcatgcttgtccagtgtagggatttgggctcaggggctgggtggggcagcaggtgcctgccaggttgcatgggaagactgttcagcttgtggcagccagttccagggacacctgagacccctgaagagaccattgaacaatggtgggaaattaggaccctatctgtccacaaatcactgaacacctcttccttctctctcctaggtgtttgggaaaattgccctgaatgataccacagagatcaaccggaacaacaactttcagaccttcccccaggccgtgctgctcctcttcaggtgggtccctgaagacataggtgcacagatacacacacacctgcatggtgccacactgtggcctggtggtagaatgaaagggaactgcttcccggggagtaggaagggagaggatgtgttgcttgctctctgcctgacaaggaggccagtgggtccattgtcatttatgataactttccacagagcaacccactatgcactggcacacctgctggaaaccagacaaaaccattaggggagcaaaagtcacatgctaaaagcagcctggcttggaatctgaacaggcccaaagccaacctgccgacacgctttgtgaccttgagtgagatatctaacttctctgaacctcagttttcttgtccaataagtacagatatctatcactataccagcacctgtgccatttgccgtgctgggcgcttatgtccacatgcactgggcgtcatcctcacttaatcctcaacacaatactagcaaactgaatccaatagtacatgagaaagatgatacatcatgatcaagtgggtttcattccaggggtggttcaacatatgcacatcaataaatgtaagacaccatattaacagaatgaaggaaaaaagacccacatgatcatctcaatagatgcagaaaaagcatttgacaaaattcaacatcctttcatgataaaaactctcaacaaattaggcatagaaggatggtactgcaacacaataaaggccacgtatgacaaggccacagctaacatcatacttagtggtgaaaagttgaaagcttttcctttaagatgaggaacaagacaaagatgcccactctcaccacttctattcaacataataatactggaagtcctagccagagcaattaagcaagttttaaaaagttatccaaataggaaaggaagaagtgaaattttctctgtttgctgataacatgatcttatatatagaaaatcctaaagaccaccaaaatctattacaactgataaactaattcagtaaagttgcaggacacaaaatcaacccacaaaaatgagtagcatttatttacactaacaatgaactatctgaaagagaaattaagaaatcagtcccttttacaatagcatcaaaaaactaaaataaaatacttaggaataaatttaatgatctaaactgagaactcataaaacattgataaaagaaatagttggtgacacaaataaatggaaagatatcttgtgttcatggattggaataattaatattgttaaaatgaccatactacccaaagcaatctacaaattcaatgcaattgctatcaaaatgccaatgtcattttttatggaaatggaaaaaacaatcctaaaattcatatggaaccacaaaagaccctgaatagccaaagcaatcttgagcaagaagaacaaagctggaggcaccacaatgcatgatataaaaatctgttacaaagctacagtaaccaaaacagcatggtactggcataaaaacggacacatagagcaatggctcaggagagaaacctgagaaataaacccactcatttacagccagttgattttcgacaaaggtgccaagaacacacagtggagaaagaacagccttgttaataaatagtgttgccaaagaggaaaaagggaattactttcaaaatcatcattagcattagacttctcattaacaaaagtatatatgtaatagaagacaatggaataatatgttcaaaattatgaggaaaaatgtatttttgaatctggccctctaaatacagtctaatcagcattccagtagtcaagcaaaatagagacatttccaagtgtttaaggacccataaagtttactccccaacataagtcttccctggagcaattactcaggctgtacttccacagaatgaaaaatgaatcaaagaaatagaatgagcagagtaatgatatgagtaaaaaataatgaagtttatagttatgagttatgaacaaggacattataaagtttatataaagtctagatacttgttaaggggaaaatgtacaaaaccttaatgacaatttggaagtaatattttatgttatctctacaaggtaggaagtgaggtggtagaagaatgagaaacatgaaaccatgctaagattcttctcttgtttggggataagagtatatactgtttaattctgtacataactaagggaaaagtgtgtatacatatatatgttaaagatttaaaggtcaatcactaaaaaaatagaaatggaatgtatatattctaaaccactagaggaaaaaaatggatggataaaacttagcaatccatcaaaaggaagctaaagtaaaagtagaaaaataaataaaacatggaaattagaataataaaatgagatggcaggaataagaacaaagataataattgctaaacttattgaggtaaagttcactattaaaacatagatactctgatgttggctttaagaaatctagctctagcctgtttataacagctacagtaaaacaaaatggcctaaagaaaatgcaaataaaaggatggaaaaacgaataccatgtaaggctcacaatgtagacgtaataatagcagtagcagaagaaatagaattccaggtgaaaggcattaaacaagacaaagagggattttatattgataaaaggtataatccatcaaaaatatataatagtcataaaactacatgagcctaacaatatagtttggaaatgtatcaattacataccaatagaagtataaggagaacacacacacacacacacagtggaagatttaatacaggtagagcatgacagaccaaatagaccaaaatagaaaaaagggtaaagaatatctaaataatacaattaacagacttgaacttatcgagttatactcagtaaatggccaaaaaaaacacattctttttaaacacctcagaaacattcacaaaaattagccaagatttaagtcacaaagaatttaacaaattctacaactgcccctactttgatatagccaaattagaaattagccataaaaacaaaaacccctccaaaatctacttaaaaatttggcactcttcttagtaactcaaagctgaaactacaatctacagtcatgcaccacatgatgacatttcagccaatgacagactgcctaaaattaaaatggagctgaaaacttcctatcacccagtgacgctatagcatcaaaatgcagtgcagtgccttactcaggtgttcgtggtgctgccagtcatagataagtatggcccatacaattatgtacagtacataatatttgataatgagaataaatgactgtgtcaccggtttatgtctttactgcactatacttttatcattattttgcagtgtactgcttctacttatttttttttaagttaaccgtaaaacagccttaggcaggtcctgcaggaggtattccagaagaaggcattgttatcataggagatgacagctccatgcatgttagtgcccctgaagaccttccgataggacaagatgtggaggtggaagacagtgatgttgatgatcctgaccttgagtaggcctaggctaatgtgtgggtttgtgtctcagcttttaacaaaaagctaaaattaaaaaaaaaaagttcaatattaaaaaaacataaaataaggatatgaagaaaaatattctgcacagctgtacaatgtgtattttaagttgcgttattacaaaagagtccaaaagttaaaaaaaatttaaaagtttataaagtaaaaatgttacattaagctgaagttaatttattactgaagaaagaaaagtactttttataaatttgtgtagcctaagtttatagtgtttctagtctccagtggtgtacggtagcgtgcagtcatgtcctaggccctcacagtcactcaccactcactcactgccccacccagaacaactttcagtcctgcaagctccactcatggtatgtgccctctacaggtgcaccgtatttaaatattttttactgttccttttttactgttcctatttttactgttccttttcagtgtttagatatgtttagatacacaaatacttaccattgtgttccagtttcctgcaatattcagtacagtcacatgctgtataagcttgtagcctaggagcagtaggctgtaccacagagctgaggtgtgtaatagctacggcatctaggtttgtgtgagtccactctatgctgtttgcacaacagaattgcctaaccatgcatctccccactgttaagtgacacaggactgtacttagaaatgagggccagggcaccagatcttaaacgtatgagatgcatcaatcagcaccaaagaaaaaattcagagcctgaaatttatttatttatctaaaaagctgtatattaaataagctaatagatggggaaaagaatagtaaaataatcccagaatatgaaggaatgcatttttaaaaataaaagcataaattaataaaatatggattttatcaataaaccctaaagctgatcctttgaaaagaccaataaacagacaaaccatcaaatccaatttttttaaaaaaaaacacaacaacatcagaaatgcaaaaagcaacataattacagatgtggaagtgatttttagaatgataagagaatttcatgcctctgttttgtggcacttcagaggtgatcatctacttcaagatgaagcagaaagtctccttcccagccagtggctgccagaaactcattgaagtggacagtgaatgcaaaccataccttttatgagaagcatatggcctcagaagtcgctggtgccactctgggtgaagaatggaaggcttatgtgggtggaatcaatggtacaaatgacaagcgaggtttccctatgaagcagtgtgtcctgacctgtggttgtgtccacctgctactgcatacggggcattctgttatagaccaaggagaactgcagaaggaaagcacagattgttcagagttgcattgtgggtgccagtctgacttcttaatttggtttttgtacaaaaagatgggggggagagaaagatatttctagactgactgatactactgtgccttttcacctggggtccaaaagagatggcacggtccgataacttttcattctccataaagatgatgtccatcagtgagtaaacccctaaacaaaggatgtcaggaacccaggaccaaagcacccaagactcggcatcttcttactccacatgtcctgcaacacaaatgctgacgtattgctctgaagaaacagaacactaaaaaaaaaaataagtaaggcccggtgcggtggctcacacctgtaatcctagcactttggaaagccgaggcaggtggatcatgaggtcaggagttcgagaccagcctggccaagatggtgaaaccccatctctactaaaaatacaaaaattagccaggcacggtggcgggcacctgtaatcccagctactcgggaggctgaggcaggagaattgcttgaacccgggaggtggaggttgcagtgagccgagattgttccactacactctagcctgggcgacagagcaagactctgtctccaaataaataaatataaggaagaggttaaacaatatgctaaacttttggccaagagaatgaaggagaccaaagaaaaatgccaggaacagatttccaagacatggaggctatgctcactgagagcttctgagtctatcaaaaataagattttcaccaggcatggcagctcacacctgtaatctcaacaacttgggaggctgaggtgggaggatcagttaagaccaggagtatgagaccagcctgagcaacacagcaaaaccccatctctaaaaataaaaaataaaaatattagccaggtgtggtgccatgtgcctgtagtcccagctacttgagaagctgtagcgggaggatcacttgggcccaggagtttgaggttacagtgagctaagatggctccactgcactccagcctgggtgatgaagtgacatcccatctctaaacacatacacacacatacacacacacacacacacacacacacacacacacaagatttttctaagagtagcagacaaataatatcagacttttaaaaagaagacagagaacatcatgaacaaatatgcaaatatatttgaaaacctaaatgaagcagacgcttttatgtagaaaataagaattataaaattatcttaagaattaaaaaaaaacaactacaacagaaattgaaaaggtagttgaaaatttagcctttgaaaaggcccaaggttcaatatttttatttgtgaggtctaccagactatcaaggagtggatcattccaatgttatataaactttccaggaacagaaagatgtagaaaacctcttcacccactccataagactaatataaagctaatgccaatgagaaaaagagaaaaaagcaagcagttataaatatgaaaatatgtacacataattgtcattgtttgcagacaacaggctaattcaagtagaaaatccatgcaaattaactaaaaaccctttaggacaatagaattaataaagtggaagattaaaagattaacaaagaaaaataattgctttcctgtactggtaataactaattagtaaatgtaatagacaagatcttatgctatcactttttcaatgttattattttgtaactcttacccaataaaataagacaggaaaggccgggcgcagtggctcacgcctgtaatcccagcacttcgggaggccaaggcgggtggatcacgaggtcaggagatcgagaccatcctggctaacaccgtgaaaccccgtctctactaaaaatacaaaaaattagccgggcgtggtagcaggcgcctgtagtcccagctactcaggaggctaaggtgggagaatctcttgaacccaggagatggaggttgcagtgagccaagattgcgccactgcactgcagtctgggggacagagaaagaccccatctcaaaaaaaaaaaacaagacaggaaaaataaatcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtcaggattctgcaaatgaattgacatctcagtgcaattctaataagactcccaacaggattattcacagaggctgaaactgattctacagtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatttcaattaagtaggtgaagatgtactattcaataaatagtattaacaaaatgacttatctatgcagaaaaaataaaagcatatttctacctcatatcaaacatgaaaataaatttcaggtcaataagttattgcggaaaaacaaaactttagaacctttagaagaacacagaaaagaatgtctttatgacctaaaatagagaaagattttttaaacgtgatgcaaaaagcacagaacatagaggaaaaaactataaatttgacctcattgaaataaaaaacttagattcaccaaaatacaccgtaaataataccagagacaacccacaaattggaagaagatatttctgttgcatataactaacaaagggttaagaatagacacgaaaccaccatgagactccaccttcctcctgcaagaatggctgcaatttaaaaaataaaaaataatagatgttggcatggatgtggtggaaagggaacacttttaccccgctggtgggaatgtgaactagtacagccactatggaaaacagtatgaagattccttaaagaactaaaagtagacctaccattccatccagcagtcccactcctgggtatccacccagaggaaaagaagtcattatgtgaaagagacacctgcacacacacatttatagcagcaccatttgcaaaatgatgtaatggactttggggactcggagaagggcaggaggatggtagggatcaaagacgactgcttgggtgatgggtgcagcgaaatgtcagagatcaccactgaagggcttgtccgtgtaagcaaaaaccacctgttcccaaaaaactattggaaattttaaaaaagaatagagaatagagtatcttttttttttttttttttttttttgagacggagtctcgctctgtcgcccaggctggagtacagtggtgtgatctcggctcactgcaaactccgcctcccgggttcacgccattctcctgcctcagcttcccaagtagctgggactacaggcgcccaccaccgcgcccggctaatttttgtatttttagtagagacgaggcttcaccatgttagccaggatggtctccatctcctgacctcgtgatccgcccacctcggcctcccaaagtgctgggattacaggcgtgagccaccgcgcccggccagagaatagagtatcttaagcaccctacaaacgaacaagaagacaacctgaatcaaacaagcaaaaacatgaacatgcaatttaatggaagataaaatttaagttctcaacccactaatcattttataaccaaattaaaacagcagtgacatattatctcacacaaattatatgagcaacatttaaaacaattcactaatgaactgatgagtttgtacagtagtgttatttctcctacactggtaataggagtctaagttggacaaatccttggaggtcatggaatatctagtaaaaataaagatgcatgtagtttaactggcaattccacttctaagtggatacccaagatataaatctgcatgtttattgcagtgttatttgtactagtaaaagaaaaaatgaaaaacctaaatgttccttaacaggacagtggatttttttacggtaagttcatagagcatactcctgtacagcagttaaggtgaatgaactggaactaaaatacatccaaagggctaagtctcaaaaacatcacatggattgcaaaaacagcaagttttcggaaaaggtgcaatttgttactgtttatataaaattttaataatgctatgtgtttcatatttagcaaatatatcagagcattcagggaatgatgaacatcaagttcattttagtaactccctctggggaaggaggaaagggacaggtggggagggatgcagagggccctccttggcatctgtaggatgggctgcatgaacgtggctctccctcccctccaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctggtaagccaagggggaactcaacagccagcagccatgactgcccagttccagggcagtctgaaccgtccatctctgcagctcatggtcagggcaaccctatcagaggagctggcttgggaagactaagttggcaggagtgtccagccacatggagagaaaggcagaaagccctgggccagagtgagctccaccagcatcttgcttgtctgttcttggctgttgtcatggtggcattgtcccagaggacaacggggacatgtgggggcctagaaagaactgtacttttttggcatcttgctgaggagtgaggaaaaggggataaagtccccctctgtcctgcacagccctgcccagcagctcggtaggagggaagctgtccagcccacctgtgggttcatcacacacaactctcagggaaactgtgtcaagtttatgtccaagagacccaggttctcaggctggtaggatggatgactggtctttagaaatgttggcttctgccatcagtaggccccagctggcaagggggttccagaggcaggtgtgtaggaaggtcttctcacagcacctcattgtactgttccccacagatcatcaacctctttgtagctgtcatcatggacaactttgactacctgacaagggactggtccatccttggtccccaccacctggatgagtttaaaagaatctgggcagagtatgaccctgaagccaagtaagttcccagagggaaatcctgattccccaagctgagagagggtatagctgaccatacctgcaggaggggctcaaggttggccaacactgggtggatcaattagaaacactggattgtatcacaccctagggtgaaaggtcaagggccagcaggaggaggcccggcaccttcaattaagtcaagaatgtatctactaggttgggtggggtggctcacacctgtaatcccagcattttagaaggcaaaggtggttgaatcactcgaggccaggagttcaagaccagcctggccaacacagtgaaccccatctctactaaaaatacaaaaattagccggacatggtggcacatgcctataatcccagctactcaggaggccaaggcatgagaattgcctgaacctgggaggtggaggttgcagcgagctgagatcacaccactgcactccagcctgggcgacagagcaagactccatctaaaaaagaaaaagaaaataatatatctactatattcagttgaatggaaggataggaaattctagtatcaggaataactagtaagtgctcaagttaggataggtagggccggggaaaatcttgattccattcccgcttctggtctaaagatcaatcacattcggctgaccctcagtaaataccttttggtcagaaggttagttcattcaatcagcaagtatatattgagaattttgttgcactgctaaaatcccttccaccttgaacatagcatgggcagaaaatgattcattaaaatctaaacacgtgtatatgtatattggtttggggctgtgtcatgcaattctgcaactctgtactgagtgtgactaatagggctaccacactgtgcagtgttgcccatatgagtgggccctacccctcaggcgcatgcgtcctgggctgctggcagagaccgtggctctctgatgccctgtccctcctctccctcctcttctaggggtcgtatcaaacacctggatgtggtgaccctcctccggcggattcagccgccactaggttttgggaagctgtgccctcaccgcgtggcttgcaaagtaagagataacggggttcatgggagggagagggaaaataggggaagtgaagtgcccatttcttgtgatcctttaagggaatgaacatactagtttatgtgcctaaagattacattttaagggtccttccagctctaaattctcagactctatgagggaataacagagtgaatgcctcctgtcctactgagccagggacccagtcctggataaaggacttgttcagtccatcccactgcaccatccgggcatcctggggtgggagacttcccagcctaggctagaggggttcggcgttcttttcctggagttggaaggccattagaaagcccaggcattgacttcaggggtctttgagtcctaaaatttttcataaaatcactaaaatacaaagtttaccagggagaggatttctcactttaatcagattccttagtgagaccatgacccaaaaaaaaagtgtcgtttccttttctccctcccctccaccatggccactccacgctccttttctccctcctctccaccgtggccattccgtgctccttgttggggcaataatgagctgacagagagctgggggaagggagaccagagggctggagagaggaggaaactcagatggcaggaggattcggctctgtgagaatccactcatggaaaacgcagattgagggaacatagaaccttctacttgtgctctgtttactgagtttcttctcatttgtgcctccactttgctccaaaaacaaacaaacaacaacaacaacaaaaacagattttaagagatttccaagggcatagaaaatatcagaaaagagcataaaataaatgcaaggtacaaacaccatgcaaggcaagggtggggaggggtgcagcctggagggggctaaagtgcgtccgttgtggcctccggacgggcctgggcaggctgaagcctgggtgcgaaactttccggtggccaagatacagttcacaccgtccatgaggctcatcaagatctggtcactcaggagaagtgtaacccttctagacactgagattagcaggaggtcaccgtgtgagctgacaaatagccccccttgagcatgcccttggcatggacgctgtggtgagcttcacaccgcgcttgctcgtcatgacccattgcatgctgaaggccccacaccagagctccgtgccagggaagcctgttctgggggtgtgtgctgggaaagaagagggcaagacagcactatccagtgtcagcaagcttctgctccaacttgatgcagaagcatatttgtcaatacacagagaggacatgtagcatctcctgcaggcaaagctcctgtgatcctttctcttctctgggctgtggacgaatgctgcctggcaggtgggctcccagcacatgctggcgtacagccggtctttgctgccagtggagagcacacctgcacgcctgagcagactttcgagcagggcgcaaagttgggtggccttcacatccttttgtggaagtgaaggtctaatgaggacaaatttcatacctctcccactccacgaggagggtcaaaagtagttgtggcaaaggcaagattctccctggaatgcttcagggagcattcactccctgcccactccagcaacacccacacaagctgcgtgtcacccccagcatcctctgtgtattaggccatccttgcactgctgtaaagaaatacctgagactgggtaatttataagaaaacaggtttaattggcccacagttcagcaggctgtacaggaagcatggcactagcattctgcttctggggaggcctcaggaagcttccaatcaatcatggtggaaggcaaaggggaggcaggtacgtcacatggacagacagggagcaagagagaagggggagggaccacacacttacttaaacaagcagatctcatgagtactcactcaccaaggggatggtaccaaaccatttatgagaaatccaccccatgatgcaatcaccttccatcaggccccacctccaattctggggattacaattcaacatgagatttgggcgaggacacagagccaaaccatatcactctgccacggtgttctgcggtcccctaagcaccgcctgccatcatcaccagctttgcttctcttcgcctgcagcgcctggtctccatgaacatgcctctgaacagcgacgggacagtcatgttcaatgccaccctgtttgccctggtcaggacggccctgaggatcaaaacagaaggtaaggtcgcccgtgggcactgggagagacactcagaaggtctagcagacaatcagagaggagctcggcagcctgcaaagtgctcaagggaacttcctgccccagacagcatccgagctgggatacgggggtaacgtgcgctccaggacatcgcagggccccagcctgctcatgacttctttgctcctgaatggtctccctgcctctagctcaggggtttccaatcttttggcttctctgggccacattggaagaattgtcttgggccacacataaaatacactaacgatagctgatgaactgaaaaaaaaaattgcaaaatactcaatgttttaagaaagtttacgaatatgtgttgggccacattcaaagccgtcctgggccgcatgtggcccatgggctgcaggttagacaagcctgctctagcttattcattttgaactctagctttccatgaaactctgggactcattctgggtggtatcttgaagtcagagggtatagctcacaaaacagaaggagacgggtgttacctgaagcaggaccaacccctgtctaaaagaacttacactggctacaggtgggtgtctcaaatgctcaactcattaaattaataggactgtgctgggaagacgtgtgggaaaggggacacagtgacaagtggtggccgtggtggaggtcatcgcacacattgtgcgggctgagcctggcttaaggctcttagccagcggacaggtgaggattcagacctcacctgtgccacctagtcagaccgggctccctcagggctgcgtccacctggaggggcccttctagttttcacaaggcaccctaagggctagcagcagcctgagtgagataatctgcttgctttatgatggataagagtttgcgaaccactatgggaaaggctgtattaaacacacctaacaagataccatttctctccaagagtgtccagccttggagtgtctagtgtttcttagagcgtggtcaaaagaccaccgctgcagaatcagctttgggtacctgtttaagctactgagtcccaggcacccacacagacctgctgatgccaaatccctgagcatggggcccaggaatctgcatcttgaaccaactacagagatgattcaaacccactggtgtagtaattacagaaaacacagatgagacaagcagtatgcttccttccccttcctacacttccagcttaaagctcaggctgtccgtcagtgtgttcctcggggcaacagaaggagccccgggcaggtgggaggctcgaatccgagtccctgctctctcactaatgacatgagtatgagccatttactctctctctacttcagttgctccattggtagactagagaaaggtgatgacatctgggaatttaattcattgaataacccagacatgggccttctctccgttagatccttcaaaaacaataacagaaacatttcaaatgaagtgaaacaagaaccagtccaccaagacacaagtcaaaataattagctgatttttaaaaaataaaaataggggccaggcgtgctggctcgtgcctgtaattccagcactttgagaggcccagtcgggcagatcccgaggtcaggagattgagaccatcctggccaacatggtgaaacctcgtctctactaaaaatacaaaaattagccgggcgtggtggcacgtgcctgtaatcccagctactcaggaggctgaggcaggagaatcgcttgaacctgggaggcagaggttgcagtgagccgagatcaccccactctagcctgggcgacagagtgaggctccatctgaaaaaataaaataaaataataaaaataggacaagttctgctactaaattaaaaaaaaaaaaaagagcaaaggcttaaaaaatataccatcagtagccaatgcaatcactcaatctgaaatgggtgtaaataggcctatttctgactgccagaaaaccaaaacacactttttttttttttttaaatggaatctcgctctgtcgccaggctggagtgcagtggcacaatctcggcctgctgcaacctctgactccctagttcaagccattctcctgcctcagcctctcaagtagctgggattacaggcacgtgccaccacgcccggctaatttttgtatttttagtagagacagggtttcaccatgttggccaggatggtctcaatctcctgaccttgtgatctgcccgactgggcctcccaaagtgctgggatgacaggcatgagccaccgcgcccggccaaaacacacatttaattcacacatatgtgtgtataacaaggaagaaaactgggaaggaaatgtgttcgtatgctaacactgattatcatgagtagaaagatcagcagtgacatccaccttactcctttagtttttttactttccaaatgttctgcaaggaatgttactcccctatgttcagagggaaggagaggcgatataaatgactgccaggaggaatatgctgtaatacttaaagattgatgtaaattaaggatgtgagattttgttccctagaggaacaaaaggcagggaggtatggaagcaagaattcagcagggtcgaaggttcactgtcaaagccaaccacatgccaactaaggaagaccaatagctagtaacaatgcgaaagactgaccagtcaaatgcagggacccaattctgaggaaataagagttccagagaaaagaggagaagccagccatgtgggaactacaatcctgtcaagaattacagactatcttttaaacacaaagacatttcagaacagctaccaaagggcccgaaacgcccccacccaagggtgagccttcatcagacatgggccctccataaacttgttaaaatcgaaacgcccccacccaagggtgagccttcatcagacacgggccctccacaaacttgttaaaatcctaagaaagaaagacaaagtcaagtcttggaagcaactagaaagaaatgtgagaagacatctacatttgtgaagatgaggcttgcatcagtcctcacccttcagacttctcagcgtggaaggaattggggcgaaattaacacctacctcagagaagcagagctgtcatcccaagtccagtaccaagccaaagaagcttctctcttggaacgtagaaggaagagctctcatcccaagtccagtaccaagccaaacaagcttctctcttggaacataaaaggaagatagtgaaaaatacttagatgacatgaaacaattgtcggtgaacttcaacaattacatagaccatcatgagaataaattaaggctgataaaaaaaaatgaaaggtccttttggaaactatgttaatttcttaggtctgctgtaacaaatgatcacaaactgggcagctggaaacaagagaaagttctctcagtttaggagaccagagacctaaaactaaggtgtcagcagagttggttctttctggaggctctggggagagtctgttccaccctttctcccagattctgagggctgtggatgatgcctggtgtgcactggctcacagcacatcacgccatctgtgcctccatcttcaaatagcctccagggtcttgtgtcctctcctcttcttggaaggacaccagccacattggacttagggcccaccctcatccaggatgacctcaccttaactaattacattggtgaaaatcctatttccaactaaggccacattctgaggttctaggcagacatgaattttgggaggacactattcagcccagtaccgaagctaagtatatttgaataccatgtgtgttaggatcttgcactgcgtgtgtcagaaacctccagctacctctcccgtgatggggactgatcatctgtgcagctggaaggcccaggagtcgtcccctgccttcaggtcctgtttggatctggcatttggggagctcgggattccgtcaatccctctactgccacctctgcatgctctgccctgtggccccagaggtggatttgaacccaggcagtctgacacaagagccctcaaccacaatactggactgccggtcctatgcgagagcagtaaacatcccgtgttggtttcctactgctgcaaagcaaattactacaagcttttcagcttaaaaagacaccccgttggctgggcacggtggctcacacatgtaatcccagcactttgggaggctgaggcaggtagattacctgaggttgggagttcgagaccaacatggagaaaccccatctctactaaaaatataaaattagctgggcatggtggcccatgcctgtaatcccagctacttgggaggctgaggcaggagaatcacttgaacccaggaggtggaggttgcagtgagccaagatcgcgccattgcactccagcctgggcaacaagagcaaacttccgtctaaaaaaaaaaaaaaaaaaagacaccccgttagtagctcatggttttgcaggtcagaagtccagcagtggtgaagctgggctttcataaggcaaatccaggatattgatcaggccatggtctcttctggaggctctgggggagatcatgttgttggtggaattcatttgttgcaattgtaggcctgagatcctcactttcctgctggctgacagctggggaccccctctgctcctagaggctgcctctctcagttcagcccacatgactgtttgctttcttccaggccggctggagagaactctgcctttaaagggctcatgtgactaggtcaggcctgcctaacctccctgtcttaggtcataggtgccgtgtgccatataacctaatctcaggagtaaaatctatgatggtcaggggcccagggctttggcagcatgtgtaccctgatgaggagcatcttagaatcctgtcccctacatctgcccttacagctgtaaggctcagctttcctttttcatcactgtaaggctaggaccccagaggctgcataaggcaggcatctaagtaggggaactcgggacagagccctcatcgacagatgtaccctccaatcatccatgttccctgtgactgccgaaggaggtccatgagaaatgccacccatggggaccagccccccactgcccgtggcagggccatacgtgttccagctggtgagcgcatggccgccattgttcctgcccaggggctgggctcagtctacaaggaagagcactgagtgccggtggaggggccccctggctggcctgagccacaggcagggggaaggggacaggaatggcattggacggggcacaagagggaagggggaaggaaggaaggtggacagaggaaggggaagaggaaggaggtggaaaatgggaagactggggagaagtgaagcaagcaagaaagaaactgatgagtcagggttgcgtggggcagatgccaccatctgtggcttcctaccttacgcagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtggtgagtgctccctggactcccgcaccttggccactgcctggccgtgcccccctctgcctgcctctcctccagctgtggcacccttagaatgcggaagcatcccctgagacttgcttcttgagtcccctaggcttgctggaggtctgccttcagacccttcctgtggggctcagaggccctgttggttagaagggaggcaggtgcaacgccctgcacaaactcagaaacagaaagtcaggttggaaatctggtacaaccctgctttttacatagggtaacaggcaagtccctgatgcttaggggtttggcagaacttctaaagaaactccacaaagtataggtttcccataaacctgattgctgtaggattgctctaaggccctcaaacgagaatcccctgagattcctcccctcttggatgacattctttttgttcttccaagagcagtgtttcttgaccctatcaagcctcaaatccctttttatagcaaagagtttatattgcctttactatgatcctgaatgaaaattataggtaatataactttcctatacatataatttccaaaatattaatataatgccttcactctaacataaaatctattaaaagcagatgtttccaatatgtaaatactcaggcataactataccagcaggtacatttaattgatgagatcttctcatgcacccacttacaacacatacggctgggttcacaggaaacaagacaatactgaatactgtcaacactttgatttgccattttgaaataaggggtaaatcagtatattaaataagtgtgtgtataaatagccccccacacataaacacacacacatacttacacatatgcagaacaaccgtgatgtgacacttacggtgagtgacccacacaccctaaagagcattgccatcaggaatacagttttccaaaatgcgaacctctcttggccaagtttaaataatccaaagtatagttttcctcaatttacacagcagttgtattcctggaaattgtcaggtgtgttaaaaccatgcaaaacaatgtcctgtgttcatttgcaaaatgaaattatgttccgagcccagagactcctaagcagaatcatggatgtgtggcataagcttgagagccatgcagagtgcaaagctgtgattgcagaacatgcctgcactttaagggacaggtctggagctacttaatgctagtggcacccccacagtaccccgacaactaaaaaccaccccacacatttactgtgccctccttaagaggcgacaccacttgtgttgagaaccatttgccagagggaaagccggatttgggctaagcgaaaatctcgccagtgccatgtgatgtttacatacatcgttttattgaatcctgacaacatttctgtgaagtttgctcagggaactaaagttcttagaagctaagttgctggcccaaggttacctggagagtccacagcagattcaggattcaaacccaggccccagggaacctaggactccaggtaggactccaggcttgtcccaccatgcagttcttccttcctgactatgctggacaggggaccctgggtttttccctcccacgtggaaagggggtgcttgccagagaagggaggggtcatcactgctatggatgtggctattttggagggacaggtaggaggaggagaaccctcaccagcccctagatttaatccccagctgtctcttgggcccgtggcatctcttcacaaagaaccaggaggtagatccaaggggctcctccccaggcatgaaatgtttcctctaagaacttatggcttctccaccatcaggtttactcccaggaaagggactgatgatgtcacatataatcttgggtatccagcccagcagggatgcagccaagccacctggcacaaaaactcaatcgggtttgaaagaaaaatccaaacttccatgggaagaaagccctccttccaccagcccctccctccgagctaagctgaaccgttttgcacttgcacttggaagagtggccagttgatgagggacatttgaagctctggaatcaaatgtatcagttcagttaaaaaaaaaaaagcgggaaataattttgatggtaggctaccttttgcataaaaaaaacaggagataatatgtttgatgatttacataactaatttgcactaagaatctctgagaaaatactcaagaaactagatgatctacaggaggtggtgactaggcagataagggctgtggtgggagagacttttgaccataagcctttttatggttttttttctctctttttaagccatgtgaatgtattacctctccaaaaatattaaagttttaaaaagttttggatgctgaaaaaaaaaatgaatgaagttcaactgaattcccctgctcccctcttaccccctctcccctctccatacgtctcagatgatgaggtcaccgttggcaagttctacgccacgttcctgatccaggagtacttccggaagttcaagaagcgcaaagagcagggccttgtgggcaagccctcccagaggaacgcgctgtctctgcaggtgagggcctgggggcgggcccacactccaggaaggtcctggtcattgcctctgacctccagtcagggtcccggtccctccccagcaggctggaggccaggtccctgcagagggaacctttcagagagctccagacctttccaaagatggctgtgagaagggggtgatgtgcccttccctacctgccacccaccgactgccctccatggttctgcctgctgtcatagcccccagatctctcaaatacttcactgaggctcccgtgacagcccctgacccctggtgccccgtcctaatgagccttcatccctcctggatgggcgagtggattgttccatcagagggcagcccagcccccagttcacacacacacaaaccttccggagggtcgactggctgggtggaggatgccagggccctggagggacaggtcttggcccgaggctgtggctggctggggagcttggaggaaagggagcgtggtcctcaccatcctccccttggattccaggctggcttgcgcacactgcatgacatcgggcctgagatccgacgggccatctctggagatctcaccgctgaggaggagctggacaaggccatgaaggaggctgtgtccgctgcttctgaagatgacatcttcagggtgggtggtgccatggcgcactctcgacccctataaagttcagtttggagcaagaggttgggctggggttttgcggggaacgtccaggggaaggagctgcaccagaggaaagggctacttccaggctcttcctgatgagctgtctcctcacccctttgccttttccaagcctgactccatcccaaggcagggctccctggaaacagcagctctcagtgtcactggctctcagagaagcgggaaggaaccgccttcctaagggaaatgtttcctaggagaaacttctgcattagaagttgcagagtggtcacccctggggcacatctaatctgcaggcttgttttgtttgttaatatttgaaaatcaagacttctggcattctttggaaaagtcaggagacctggtaatattaagcttgcattcccacagggcagcagagggccggagcctagaggcggtggccctttgagatggagcatagcgtgtgttctccaggtctccaagacccctccagaactcccctttccctctcctttcctggagactgaagctgcccagcagttgcaatagtgaaaattaaaacggctgtaccagaataaggggcgtttatcactcatttgtgttgcctgcctcaccacgctggtgtttggttacaaatccttctatagcaagggagaagctgccagccataattgtgcaggaccctgctcacaccgctctctcccggccgcgggcccagttcccaggctgtggaacacacagggggcaagctgagcccatcctgcccctgctccgtctcttcctcatccttattcttgtcactgggagacattcgtcactgagtggcctcagggacatggcatggtggtgacacaacccgacaagacaccagaaaccaaagcctcagtcaccaaggcccagggatgctctgatgtcaagggttggaacaaccgtgcaaatagctacttgcccacttccccaggacaaggaaaagaatactggggaaaaacattggctcctggttttaaatctctctgagtccccgaggggaaaaagaccatcatgcaggaaattcttcattttcaaaaccgtttggccaaccagcttttagctctgtgagcacactgggtttccattttttaaatctggttagaatcttctggtcgctctcccagcccccgccctcacggtgtgctggctgctcttagggaccaccatcctagacgtgccctggaaactcactcccagccttcaggggcttcactggaaacctccagggcagctcgtaccagcggcagccccttgcccaatcccatccccactggtgggtgggttctcccagctgctgcagaggggagtccagagccttgagactccgggtccctccctctctggagcagccaggcatgaagaaggtcctcaggtgctcctggctcccagcagggctgtgcctacccgaaagaaggcagcccgccttcccaggccctgcacttccctgacctggctgtggaggctgctctctgggaggagtgggtgctaaggggcttctccacccacccctccttcttgcctacagagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtaagtgggaggctggccaccccaggcggcacacagggcccacgtgctgcaaccctcaggagacagtggaggagacggaggcctcggccagccacttgtccctcaagcttccaggaggttgctgccccagactccagcaagagcaggaggcactatgctgtctcccaagtcctgcccttgatcagacctggcaggctcagggcaagtcagcagtggcctgcggcgctggttctcccacagggccctctcctctcccacacttcctgagtggcagaatgtgatcatcagatgtttgtgttccggcttcacaacagaaaccatcccgtctgcccttccccgagtctctgcccaaacctggcctttctcccagccgagatgggaatggtgtttccattgcttccctggagcccctttgccagcctcccggagagggcatcccctgtgggaggcgccatctgtagcactggcccattctgcccagcacaggatcattcctggaggtcttgactgtacctcttactcctgactcactcttttctccttgtcctctcatccctgtgctctaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggttcttgacatgctcgccctccagctcagaaaataatagagaagtagcagcttccctctaaacccctggaaaagtgtccatccaaggagcaggcacacctgccgctggcctgcctgtccctgcagagggcccatttcaagagggctgcatgcaagcccatgggactcaggcatttaattgtgtcagacgacaggccagttaaaaggaccatctccctgtctgctttcctttctgcaaggttggctggtttagccacccagaagcagcactgggggcatccttcaattcatgaggcctgcactgctgccttctgtgtgcacagggcagtgtgctgggcactggattttatgtgccggcctgaagggctggctttgcataggagaggatctaatctaggcatctagtcttgggggcctgcacctgttgtgggggcctcatccttctctgcaacctcactccccttccacggcctttgaggacccaagtactgggtccccatacccccttctcccctctggcctcatgaagcttctgcttaaggagggctccacgtccgtctttagcatctcagggtgaactaattccccaccctctaagggcattttcatgtgaagctttgttctctgtgacataaggggagagggatgtttagaggagctgggggaggagaccccaggggatttccttgtccccacagatatatctctccacatagcaaaatacatgcaaagcacccggcacagtgcccagcacacagtcggtgctcatgaaatgtcggttccctctgcccactgcagatggtacaaacaacacacagggcatcaagcttcagcttggtgaagaggaggagcatagcccacgtcccagctcccttgtccccgtgtcacagctcaaggctaacggcagctctagtgccagcattgcttgtgctgaggatgggccagcacgtcctgtgcccggtggcccccaaaagtgctgctgcctgcctgctgctgctctgcgtctccagctcctccctccgtgcttcaccaaagcccactccacctccctcccctcccagtcctcctggagctcccacctctcatctttccttccactgcggggcgggtggcagtctgcagtcctcctcctcgagagagagaattgcttctaccctgcctgggatgctcagagccagggcactgatttagcactcggctctgagaggatggaccaggatctttctctgatgccctcaggggtctgaggataaagtgggcccagcatgcaaggtctatagaaagcaagacaaagggaggcactgagctgagctcagacaggaaaaggaagaggccttggtccagagctaaagatgacctgaccctgtcccagcagggaaaggcacgttccgatgtgtgaggatctggagctcaggagggattcaggctcagcagggactcaggctcactgccttctgctcaggaaagcaaacccctctaggtgaggcttcctctctgtgcctttaccccagggtgccagtgtcagaatcaagggcaccatcaaaataagaggccaaggacttctcagctatgccaaatgccaaagacccaggtgtcatagctggaggtgagtggggggcagcctctaagttaggcagggcatatgtcattccaatttcatagggaaactgaggcatgaggtggaccaagtgacttggaccagagggtaagtggattggggtcaggactcctggatccacagcagacatccttctcccaaatgggaccctcaccctaatctgaacacttctatggatccatcagcaatcacaggagaacaaagcaccagcaactgtatgcctgttcacgtgtgtgtgcttgtgtttgtgcacgtgtgtacacctgcatgtgtgtgcgtgtgtgatgctttacttgctgaaggaagtggaggaaggttggcagtttctgatgtttttcttcatcttggatattgtaggtgccactcccgggagagccaggcagccatggcgggtcaggaggagacgtctcaggatgagacctatgaagtgaagatgaaccatgacacggaggcctgcagtgagcccagcctgctctccacagagatgtgagctctgctgccctctgctgaggctgacccaagtgtgggaacaaatgtggggaggcagaggcaggtccctgagatccctcctctggggctgattgcaggaggagaggagatcacagagaaaacatctgcaccgcctctttcatctcctcagtgaaatgggagccccccaacacacaacacacacaaacacacacacaccacacacacacacagacacacacaacacacacatacacgatgccctttttagcttggggtttcctcgccaggaaaatttctgaacattgttttataaacattgtaggctgtaagacacagtcataaatatattttctggtgagactcagtatgcacatacatatatagataattaaacaagtgtttcaagacactgcttataatgaagctgcccagaagagggcactggtggcaaagccaggcctgagatttttgtccttgctgccattcttagagtatttttagctgcagttctagatcctttagaaggtggtgacatccatttggtcactaatgactagcccttaaaagcaggtgcagcacagcacaatatcagaaactatcagaatgcgtcaaacgtcacaaaggtaagcgctgtgctgggaaacacttgcttaattgccaacagatgtggctatctgggggtctccttgagaaacatctttatgactctgagtcacatccacagaagtttgagacacagagtgacatccacagaagtttgagacacagtgtttccgaagcttttctggctcttttcaccctcaaagccctgtctcatctgttactgtatacatgactcacaacaggcctctgagacagagagggcatatgtcatttcaattttgtagaaagggaaattgaggcatggggttttccccagggggtaatgcctgggtcccatgggcttgcgtgcagccacttgaaaatgggccctctggagggacaggcaggccagcggcaggtgtgcctgctccttggatggacacttttccaggggtttagagagaagctcccacttctctattattttctgagctggagggcaggcatgtcaagaacctgggatgctggggggctgtgccacctgctgggagccactgtcccactctggaacggcagcacagtgaagcgtggccaggcacgatgcagggtgtgtcctctctcagccccgccagggaaccctggagctgccgatgcagacagggaggagccccacgggggcccagggcgggagggaagccctcaccgacccctcccagcatgtcagtccattcagttcctgaaaggacttcagagtgaggaaggactagccttgcaggcttttgaagacaggaaaggtgtggctggaggtggtgggaggggacaccaggtgccccaccctgaggagtgtggggagaatggcagccaggccagcacagcatgcggcttcctggggtccagtgctttctgctcgggaactggatgggaagagtagcagaagcacctccttttccccagcatagaaagaagaatcgagtgagtaaggaaaagcatggaaagagtcccaaccagcggcacttgacaaatcactcaactgccctgtgccttcgtgtccccatcagcaaaatgggacggtgggggtgacaggccttctacttttctgactcagtgaaacacggtcaatataaaaaagggaaatacctgaagctccttatgagataactgtctctaaattgattcttagagaatacaaacgaatgcctgaccacctaccctagaaatcaggaagagcatatattttaaactatttcggttattctagagtgcttggtgcaccaggcactctgctaggttgttaagaacccagtctccatcctcaaggaaattccacaaactaggaaactaagagggtctcaggagaggaagataacacagagtttctcactacccccagagtggtacaacccccaggggtacaggcgttcagagaaagttgagggcagggtgacctgaactggtaccacgcacaaggtgaaatggaagctggatctgcaagagccagggtgatttgcataagaagaaaatacaatagggaggccttagctagctgagagtaagagctagtcttgaaggtataaatactgcggtctgcactctaccagccttcctgcacatctataaatcatccaagtctctgtgctgtaccatgagcaggcatggagtcaccctcagaggtgtggggtggcaccagggaccagtgagtcagtggtctcatctgggaatgaggttggaatgcagctgtgcttcttgaactgcaggctgacccagcagagattgtgaatcaaaattttaataaaaatagaacagactaaagtggactgggactcaccagggtgcaacgcatgcaccgagggtaaccaaaggctatgaggtttcattccatcaggtgtgtctgtgcatgatgagaagctgtcaaatctacttctcatcgagtttccatcaaaggcctggaagccatagactagatgccccatgaggtccctcacagccctgctgttcacctactgagtgaccgtagagtggttgtaggcagctgcttatgtgctcttgctgatgagggggtggcagggcgggagaaatcgggggacgggcataagtttgggtgaaagttgagggtcactggggaaaacagcatcagctcatgcaaacacgggagccaaggccattccccaaaagaacttcatgggcctaggattctttccgctttctcaacacctttgaccccagagtgccttcactgccccaagtcagaactgcaggcttatgagacaggctgcgggtgaggagctggccattcccactgagcaggcctggaagacgtcaggggcaggccagaacttcttggggtggcaattccccaaacctgcatgtaagcacaaagtgtgcgtcccttcactaaggatcagagcaaagtgctttccgggggtgcagctgtccctgtgggtggccacttctcagcctccaggaacaagccccatgagctctctgttccaggctctcctaccaggatgacgaaaatcggcaactgacgctcccagaggaggacaagagggacatccggcaatctccgaagaggggtttcctccgctctgcctcactaggtaaatgcaccgctcgctctctggatgtggtcggcggttactccctagagaacactggtcagggatgattgggaaatcgttgtggcctgcctcaaatcagccccacacagtggggcatttccaaagcaaggagacaacattccaaaggcagggtgtgcagggatgagccctggacaccagaatacgtctcagacgaggggaggggaaaggaggagcgtctcgggccatagttactgctcctggcaccccaccagggtgtaaactgtcacaggccagtgccctgttttcctgccctgatggtggctctctggctggctttgcaggtcgaagggcctccttccacctggaatgtctgaagcgacagaaggaccgagggggagacatctctcagaagacagtcctgcccttgcatctggttcatcatcaggtagctcacacttttggacaggccactgtcacctgccagcaggccagacagtccccagggtgacggacaaatcctgaagacttcagtgggtcttgcctgtctcagatggctggcacgtcctgcccctgccctaagagccatccctgtagggcttcacactcctgtgcaggtgagggccacggcaaggtctgcagcatcgcaggtgggggcctaggaagtgctggtgcacaggagctctttgtgtgatcctgaggacccacagctgcaggttccacctgagctttcttcttaggctgccacagatgccactgacgcctctgacactggcctatgcctcagggcactcaggaagatgtacttgtacctagagtttgaatatacctggaaattttgccacacaaaaatccatccagtgacataaagaagtgattaaagaacccaccagcaacatggtcaagagtagggaatgacatccgtgggaagcaggtccagggagattccataaatgaaatgtctcttggcatggctgactccagctgagacagtgaaatccaagatgccaggaccaaacatgccttagtatctttgaacttcagtgttatctaaggccagtctattaaccccaggcaaactgaggtctaaacctgggtttcccaacattctgaccttattaaagttatactcttttatagcatggacctatgttttaaatagacctatgctttgtacccaaaggcattcaactgccaatcaaaagtcataatcagcatgagatggccagtgtggcctggctgagttgatagtacttcagctccaaaaaataaacaggttttcttagcctgtgtggtgttgtcttccactgggctttctgaaataatgaatatggccttacacttttctcagattcccagggacccaggagccccaggctgaggaccaccatgggcaggggcaggaggtggaaggatgtggggacactgtgtgtgctatcttaaaagatttctagaagtcgatttcacctatctgttcttgtcgtactggtaggcacgaaactctcctcttcatctctttctcctcctgtactctgtgaccctagaggtggtctttccccaccacagtgtcgctctctcccgggagcacatcccatcagagcagctcaccctgcagagcctctgccctggcaggttgtcatggcaacagccagacaggcctggtccctaccctcaggatgctcaagaatattcagggacagagggcgtaccgtgtgacttttttttttttttttttgagacagagttttgctcttgttgcccaggctggagtgcaatggcacgatctcggctcaccacaacctccacctcccgggttcaagtgattctcctgcctcagcctcccaagtagctgggattacaggcatgcaccaccatgcctggctaattttgcatttgtagtagagactgggttactccgtgttggtcaggctggtcttgaactcccgacctcaggtgatctgcccgccttggcctcccaaagtcctgggattacaggcatgagccactgctcccagccctgaatcttttaatcacaatacagcaccggatttaacaatggctcaaagacaacctgagctagagactggcagggcattatgaatggccccattaactgtgagaactaaaaccacaaatactggttttcccaactctttgtgaggtgcacagcgcttcttcacagacctcattgcgcttgagcctcacaccagccccacagggcagatggatagacagcattcgttttctggctttacagacatgcaggcctcaccctgctctccattctattgaggacaaaaccaagagcgagagaatgcacagctgacaggtgaccaggccagggctaaaagcaggttaccacgacttcacccaatcccagctttcagaagttacaggagaaagagatcacttcagacccagatgatcctaagatgtattttgagatagttgaaagtcatgccaggttgagataggaccgacaggggaaaataatggcatgggaataccaggcaggtggagctagctggacacagcagctgcaaagcagtgcttgctcagaagcaggggcctgccttgtttggggtcggccactcctattaactcacactccttgtgtgtccgcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtaggtgactcgcagatgggcaggggggagaggccacgggcaacaaggggacttggcatgcggggctgagaagggagcacctggctcttgccaaattcattgcagtcaatatctgagcccgaaagaccctccctctcagggctgcaggagggctcgtgtgcggaaagccatgactgcacaagatgctatgggctctcttgaggctgggcccactgcagagggcggcagaaaccactgagcaacttatcccttatactgcagctgctcgacatgcaaatgtgagcctggctgcctttatacacagacaggcaagatccaaggtgctcaggcctgactgcccgtgagcatcacctggggagctttggaaacccgggacagattaactgatgattgttaaagctcttcgatgattttaacgtgtagcaaggttgagagccactagcctagaacaagcgagctttcagtcccactgtgctctgcctggtcagagcatctagtgcaatcccggcaccacattattagggacctttgacacactggaacaaacccaacagaggatgaccaggatggcaaggttcctagaaaccatttcctaggagaaccgtttcagggaattcgggaagaaaacctggagaggaggtgactttggagggtgcgatacacctctcacacctgcaacgggtgggatggggaaagggtggcaggctcagcccaccagcggacagatttcagctcacatggggaagaccttcccaaatgagctcttccaagatgagaggggcttgcctgaaaggtagtgagccccccatcatcagacatagccaagcagagactgtgctcatccgggcgtcaggctgtggtgcaggaggtggggcgttaaaccaggtggcttccaaggtttacctctcaaagtctggtattcctgtggcctcgatcatcctgcattcatttcacagaccttccctgagcgcctaccatgtgcaggccctgttctaggtacagggacacagctgagaaacagagcttctgctctcatgagctcacatcatggtgaggagagacagataataaacacatacatatataacacatcaggaaggtcaggagtgccaaagaaaaactaagcagggcaaggagagaatgagtggcgtgggcaaggagcaagacaaacagatgcctgaaaggagcgagtgccaggctgcactcagcttcccccgacccgctggctcaggagccgattttcccatagccaggcactaagcagccggtagggaggacagagaagcttaagggtcacctgctggcccttcccagcagaagcaaggcaggggcatgcgccgtgtttgcacagatacctcacccctggaaaggcagcagcaggcaatgggcagtgggcctgtctcagcagtttcaccagggagaatggtttctctgaaagaatagtataaaggttcagtgggtgtcagaaaggagagaggcaggctgggatctgctgatacagcatcagggcaaccccccggcccctctgagagccaaaccttctctggtttttgttttggttgttttttgagacagggtctcgctctgtcacccaggctggagtgtagtggtacaatcacagctcagtgcagcctggcgctgctggggtcaaatgatcctcccacctcagtctctggccttgctaagatcacaggtgtgcatcaccacacccagctaattattcttaaattttttgtagagacgaagtttccctgtgttgcctgggcctggtctcgaactcctgggctcaagcagtccttctgcctgggcttcccaaagtgctgggtgacaggtgtgagccaccgtgctgggccataagcaagtcttcatatatttgatgacagtgtttgaccaccccagccaaaacttctctggcctgcacatccctaattctggcagatgctccatctccacttgttccccatgggtgcccctcccaacacacacacgtacacgtgcacacacgcacacttccccaagtgacctaccagataccccctcgctctagccctcaagggaagagctgggctccaggagtaatgttcctttggttcttcatggctcccaccccgctccttcaggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 517 - DNA, 644700 bp, Homo sapiens; identical to SEQ ID NO: 516

SEQ ID NO: 518 - DNA, 644700 bp, Homo sapiens; identical to SEQ ID NO: 516

SEQ ID NO: 519 - DNA, 644700 bp, Homo sapiens; identical to SEQ ID NO: 516

SEQ ID NO: 520 - DNA, 644700 bp, Homo sapiens; identical to SEQ ID NO: 516

SEQ ID NO: 521 - DNA, 644700 bp, Homo sapiens; identical to SEQ ID NO: 516

SEQ ID NO: 522 - DNA, 644700 bp, Homo sapiens; identical to SEQ ID NO: 516

SEQ ID NO: 523 - DNA, 644700 bp, Homo sapiens; identical to SEQ ID NO: 516

SEQ ID NO: 524 - DNA, 644700 bp, Homo sapiens; identical to SEQ ID NO: 516

SEQ ID NO: 525 - DNA, 644700 bp, Homo sapiens; identical to SEQ ID NO: 516

SEQ ID NO: 526 - DNA, 644700 bp, Homo sapiens; identical to SEQ ID NO: 516

SEQ ID NO: 527 - DNA, 644700 bp, Homo sapiens; identical to SEQ ID NO: 516

SEQ ID NO: 528 - DNA, 644700 bp, Homo sapiens; identical to SEQ ID NO: 516

SEQ ID NO: 529 - DNA, 644700 bp, Homo sapiens; identical to SEQ ID NO: 516

SEQ ID NO: 530 - DNA, 644700 bp, Homo sapiens; identical to SEQ ID NO: 516

SEQ ID NO: 531 - DNA, 644700 bp, Homo sapiens; identical to SEQ ID NO: 516

SEQ ID NO: 532 - DNA, 644700 bp, Homo sapiens; identical to SEQ ID NO: 516

SEQ ID NO: 533 - DNA, 644700 bp, Homo sapiens; identical to SEQ ID NO: 516

SEQ ID NO: 534 - DNA, 644700 bp, Homo sapiens; identical to SEQ ID NO: 516

SEQ ID NO: 535 - DNA, 644700 bp, Homo sapiens; identical to SEQ ID NO: 516

SEQ ID NO: 536 - DNA, 644700 bp, Homo sapiens; identical to SEQ ID NO: 516

SEQ ID NO: 537 - DNA, 644700 bp, Homo sapiens; identical to SEQ ID NO: 516

SEQ ID NO: 538 - DNA, 644700 bp, Homo sapiens; identical to SEQ ID NO: 516

SEQ ID NO: 539 - DNA, 26879 bp, Homo sapiens
ttaagaaaagagctctttattccacgtcgtccgatatttttacacaagtaaaataaaatgcatatctctatataccgcgatctgggtgggaggcggcgttctggaacaaacgctgccgccgaaccctgtaaacatgatggggtggagatgggggtggcgggcggcaggcgtccatcagggaggacctggcctggcctgccccacgggtcggccgcccggctggcttggcggcgtggagagagaccccgtatgtacacacacctggctgctgagcacgctcttgtgtccgctgggggtcagcagggcccaagcactgtccacagcaccagcgccaggcccaggggggtgaggctgcaggtgaggctgggtagggcacctgagccttctgagtcaccagtcccgccacccccgctgcctgcctggcccagacggcagtggctgcgggtgcggttcttgcgtgaacagcctggcctccggcgagggcccgaggtggggaaccctggtggctcggagccctcgggccgcactgcagtgagcgggggctcagcagagccaggcagagtcccaaagggtgagtcattgatgtgccgtgggccagagccgttgcccggcgggctgtcaccgggcggcacgcgtcccttcagcgcattgcctgccgaagctggtcttccaggctccagtactgaggccttgtcagcggcatctggctggcagcacttgggaagccccagcggctcctcatcggtggccctgccggtccagatgggatggtaagggccggtggccacagcgcagccctgcaggtcattggcagctaggcgtttgaggtcacggccagccaggcgttgcgggaggctgcagggcacctcggaggaggagccgcggaacttctgcagccaggcccagagtgggcgtgcccggcagtcacacacccaggggttgtcgttgagcctcaggtactgcagggcacgcaggggggccagggcctcagtgggcagcgctgatagattgttggcaaacagatagagtgtcatgaggcggccaaggtcacggaaggcatgcgggtgcacatgggccacgcggttctggtgcagtaggagacggtcgaggctgtgcagcccacggaaggcgcgctcgggcacgctggagatgcggttgccgtgcaggaagaggtgtgtgaggttgcccaggtcgcggaaggtgtcatcaggcagtgcctgcagcgcgttgtcctgcaggtagaggtactgcagggcagccaggccgcggaacagccccgggcccagctcctgcaggccgcagcggtccaggtgcagcgtgtgtaggcggcccaggccgtggaatgtggcagggtccacagaccggagctgtgcattatcgctgaggtccagctgctccaggagggccaggccagtgaaggcagccgcatcaattcgggccagcacattcgagtgcagccacaggatggtgaggttgcggcaggcacggaagctggcagctggcacatgcgagatgcggttgccgtgcaggaagatgcgctggctggcagcagggatgcccacgggcacagcctgcaggccctgctgggggcagcttgtcgtcaccttgggctcattgtagcatacgcaggcacctgggcatggggctgccacctgccaggcctgcagccacagcacccatgccagcagccggctccctgtgggcagaagacagagtggttagcaggaagggcaggggtactggagaagctggaggttttgctagagccaggtgggccccggagattgggtctcaggaggacctggggctgggtccaagatgtggccaccacccccgggaatcgcagtgttgggatccctgcttcacaggcctcatggacgatgctgggctagaacatgccttggagccatgcactccaccctggaagccacatctgcagactccccataccacacccaggagcagcccactgggtcaccaggggcactcacttgaaggcctcctggaatggacactggtgactgcaggtacctcctcaggactccagtgaacacagagcccgcattgcaggagtccccggggggtcccagtgggggttccacccacagggcctaggaaacactgcaatggggctggggtccctctgggcacgtctatctcaaaaacgggcgcctggatgcccgagggcgggggtggagggcaagtgtgtccagggcttaggaggagtcgcgtcccacaaccacccaggcagcctgctccctcctccacacatcctcctttcaagcacttcctgacttggcaggaaccctcctgaagcctccgccccctggcctcattctctgctccatctcctccctgggaggagttcactcctccccagccaacccctgcagtgccagctgcctgcacccctcccacccagacgccatcagcagggatagcctcccagtgggttctcccccagccccaggtgcctgcaacccctcctccattacagggccagatacacctggggcttcaccaaggccctacatgggcagtagtccctcccggggtgccgcatccagagctggtctcaccagcggggtcacccactccggagtaagctttcctgcctctcattccaccattgagcccccacccctttggaatgctgaagattctttctgccttcagcagtgagtctattaaaatgtgaatccccctgggaaggttatggcttatcagctaacacttgagttatcagctaacacctgcgttgacagctaacaccttccacggcagctggctaagagcaggattctgcagacatgaggccggctaagtgctggggttggagccgggcaggaggaaggagtggaccacaggccagcttccccaacctagaactgtgaccctggggccctcctacccacatggggcccctgccccactgggtcctctctacttgggcagacagtgcagtcgccctaaacgcagagcccagcaagcccagcacgcgcagtgaccgctgggcatgtgcgtcctcccagactcaggttcataggtcctcagaccccctccccacagcctgggggcctcctctgccaaaccccctgccccagggccatttgttggctaccagggagatggcagcccagggatgggggtccggaggcccctccctgggtgggctgggtgaggaaagcacctggcctcgtgttctgtttaaactgcggacaccctctctgctctctttctacacactcttcctaggaaggtggggcctgaccatgtcagctccccactgctgtctcacctgctgtcaccagagggaaaactgtgctatgtaaatggcacttcctgtcctggggccaggtggggtggaggccccacatgctcatggggcagggtcaggactcactgccacattatcgaccacaccacaccactgactgtgggggtcaccaactgagccttgtcaccaaccataccatgcggctgactgcacccaccaagactagccacccatggtggccacgcccgccacattaccactgagccatgccaccatcccaccactgtcctgtggctccaggcccgaagctgtgggctgtgagtctggctgtggtcagggctcagctcactcgccttgaaccgagccctgtgctcatggatctccctcccgaagcagctgtgtgtccactctaaacatgcccccagtgaggtgccagaactgagccacacggtggtgcggggtcgggggagacaggggaggacatgggggagtggccacgtggcgctcagttctgccaggaagtgggtattgggcgcaaagacacggctcggttcctgccgagacaactgcttttcgtaaaccaacttctgagagtcgggtgaggtgggctctctcctcgctgcagccatggtaattggctccagcctggccccccttggggcctgcccgctggtctccatggcaacccctctgctgagcgagcaggagggggcatctttttatgagataatcaaacccaactttgcagcatgggtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaactctaataggatgctctactgtccttctggagatagcatggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccatggatagcgtgcctgtccaccgtccccacccaggttggccctgcggccacctgagcctgcgagggccccagagggctctcctcagcctccaagctgcacacaaactggtacatctgtgcctctcccaccctcccaggccaattaacatctcttctttcctccagggtctcctcctgggacctccccggaggatggccctgctggctgtcagggctgggtcatagctaggagctcctgtctcagcccaggcctggctcaggagccacagtcaggggagggctggctctcctgcctggaaggctctgagctttcccagcggggacagtgaccggatactgacccagagcctctccctgcggcagccagactgggcagggtaggacccaggatcaccaggctgaaggcccaggaggctgggcagcaaacagtccaggacgcatccccctgacgggagcaacaggcagcccaggtgggcacctgcaccatcagttctggtgagtggagggctgttcacgttcactgcaggagggagtgtggcggggggaggaggaggtgggaggagagcgaggagggcaggagcagaggggaggggtggagaagggggatggggaggtggcggtgggaggctctggggatatgcccagccattgggcaggcaggcggctgctgaggtcagcagctcaccccagcagcccagggagctgagccgagccgagcagggatggccttcttcatgtggtccctggcccccactgttcctggggccccgcccacctccgtgccctcccaagcttgggctgaagttccacagggatgcctttgcctctgcccagcgatgccaggaggcagcacagggcaggcagctgtggaggcgccgagcaccggctttcatccacgcacagcttggtgccctcgggccccaatgccgcccctgggctgggatcaccggagggtcccatcacctgctataaaaagtgagacagcaatacatttacagattaggaaactgaggcagtgagtggttaagccctgccctgctcccactccagactacccaggtggagaggcggccaagggagacactcacagtgctgcccggaggggccacgaggcatgtcctgcccaagcaggaaggctggcggcctggctagtaatgggggagggtgtggaggggctgggctgcaggccacgtgcagaggggcaggcagcgccctcctgtgtcatgggtggccgggaggggaatctccagggaggctctgagctgctgcttcccagggctggggtaagaggctgcagagggctggggctgggggtgggaccagctgtagcacagccgggacatcagtcagctcaggatcctctcggacaccagccatgtccccgtcaggcggtcacgtcacagaccacagttatgaggcagaacaggaggccacagctcagtgcaccaaggccagaaatagctccaggcgggggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgtttcctgtgcccttccagggctccaggtgctgcggcaggagattggcagcagcttctggtgggggcagtctgcccttgaggggtcctgagtctcctagggaagtgagtaccagcccctgatgccctggccctggcccctgctccttgttgatcttggctgcaggggcagggtaggcagaccaggtcaataacaggcaaggacacctgccatggtgagaggtcactggacccagactgaagcagctccaggcctagctagctacatgctgtgggggaaactgaggcccagtgtgggcagagccttcaggactggcctcctgagtgtgcctagtgcttcctcagccccctcggctccactctttgccctggccggcagggctcgtccctgccccgtgatgctgggctcaccagagacaacgagatgtaggtaggtccagggccagcaggccaggccagaggctgggcccttcaatccagcaaattctcttggagggggtgtcaagtttattgacccattttacaaatgaggaacataagaactggtgtgggtataatcaatagcaaacacaatccaaggtcaaatccaaccatatgctacttacaagaaacatgcctaaaagtacacaaaatcttgcaattaaagatattatcagaaaaataataacaagtaaagcaggagaagccacagccccagggctagcgggcttcccagtctcatggccccaggggtgcgaaaaggtcttgctgggcagtaaaggctcagccacccccgctcctaacctgagctccacagtcctgtttccagccagcagggcacctgagagggtacacctttcaagtcacagacactgaagctagcagaggatggcctggcccaggtgagagctggcagccctggatggcaccctcaccccaaggacacatcaacgtgggccacaccgtgcaggatcatccactcgcttggccctccctccgtaccttggcaaggtgtgaagtggcccctgtcccaggtgctgtgctgagtgccgcccatacaagaccaggccgaggagccgggtcccaggcactcacggtccagggccagctgaccacgggcagccaccctgctgcatggcaggtgccctatgggagagttaggagccacagaggcctgagccagccccaggcagcatgaggatgttggcaggagcccaggagcccactaccagccaaagggtcttggcagagccccaagtgggcaggatccttggcctagcacctaggcctcgaggattcatctttggtcaatgctgggctgcctgcgtggagggctccagaaccttgccccatccagcccatacacccctcactggaggtgcaccctcctcggctcccaccccagtgagccccacactgggggcccctggaggctctgcccagtggaggcctcgcccagcccagggcacagccagtgcccccttgccccacaggaggcttgagcccacctgctcctccatgctccaccaggagccaacaaacacctgctgcctaattatctggagaatcctgtctccaccaagggctcatcttggtcctgcagctaattcaatccagcagccagagcaagctgagtccccagaggacactaatgagcaagtgaccggtggccggcctgctcccaccctggggacgcactctgagccaggtctgggcccagcactgccatacacctgcctcccatgcccatctgcctgcctgaccctgcccgctacctggtgcctagccctgcagggcccacatccactcccatgggctagcatccagacctaagccccagccctcccacactcccccaggaccctggatctgctgcatgcacaaggctgaccactgcctgtgagcccagagtgtcggccttgacagggcaggaggaagtacaagagcacatgctcagggtgcacgagccaggagcacagactcagtgcatgcaatgggacccctgggggtgcacacgataggcgtgcataccggaaacacacaataagagcccccagggctggtcagggctcaggcagagtccactgagcagtagagggttgctgggatgcgagcccctcccaggagccagggcccggctggagggtctgcatgccgctgcggcagaggaagatgtgtaggcacatccccatgtgttctcttgccctcagcatttgtaaaacatgatcaaccaggcaggcgagcggcctctgtccgagcagaatttattctgctgtgaaaagacacgtgtgggtcctgaggctcttgccggcttgttctcagcagccttggatcagcctcagtcagcagaacagcagctggacaggctcccattggagccatcccagggactgcccagcccttcacattagaaactgagctgggggcagcagctggcccacggcacataagcagtgcctgctaagaccacagagaagctcagccaggcagggccagtgggatccagcactccccaggggatgaggaatctaagaggcaggagaggatcctcctcagcctgggatgttcccattggaattcccccagccaaggccagagctccgtgtccgggggccagagtggaacccttgtcagagccgacaggccttggcctcctattctactggcacctggcaaactggcccaagggctggctgctgcttctgtaaaggatgtgctattggcagccagccacacctatgtgttcacgcattgtccatggctgctttcccgcaacaacagcagagctgagttgttatgacacactgtgtggcccacaaagctggaattatttagtatcacaccattcacacaaacagtttgccgacctggtttgtgagcaagccgagtgtgggtgctgccaccttcaccctcacaatggccccagcagttcactcagacccccactaatgaaaaggaaaccaagggtcagagaagaccacggtcctgctgaagtcacatagccaggtgaacagagcccagcaacctcagtgcaggctcagctctgtggagacctgggcaaggtcagcatctcacggaggcctagggtgaggggttctaggcaagaaagagactcagaaatactgaaatactctgcaggtcaaaacagaaatgatcatttttctaaagaggctgtcaggagtctcacagtcaaatatgcataaaataggacaacctaacacaaataagttgggaggggtggctcacacctcagcctcctgagtagctgggattacacacacacacatgcatgcacacacacacacacacatacacacaaagagaacaaaatggttgtaaggagagggggacagcagaggaagtgctgaatgacacagtccggcttcggaggaaaggacttgggtggcacttcagaggagacaaatccagtgcaggtagttttgaagagggcagccgtttaactgaggtagggggtctctggggacagggcccctccatgccagtccacccaccttggaaccctgcagaggctgggccgaggcctctccctgcaccttgtatcagggactctggccaggtcacaccaaggtggcttatgacccattaacatcaagctgcctccctgggctggacagggcctggaaagaggtgacctgggcagatccgtgtcgatgtacttcccaggacatcaggattccagcctctgctaaagggatcttcacagttaataacaaagaaatattaaagatgagaacacttggtgcaggaaacaagagaggaaagggagtgcggtccctccttgcaaacaggatgccctggaccaccctccacggcctcaggcctggatgctcctgcagacccatagccaagattgtgaaggaaaagtaggctgtggaggcattttctgtccttgttatcatcattgtaaacatactcatcatcaccatcaccatcctcatcaccatcaccaccactatcaccaccataatcatcagcagcagcatcatcaccatcatcaccaccactatcatcattaccatcctcattaccatcactatcaccaccatcatcttcatcaccatcctcatcaccatcaccatcctcaacaccatcctcaacaccatcatcaccatcactatcatcatcaccatcaccatcctcaacaccatcatcaccatcactatcaccaccactatcatcctcatcaccatcctcatcaccatcaccagcctcaacaccatcatcaccaacactatcaccatcattatcatcatcaccatcctcatcaccctcaccatcctcatcaccatcatcactatcactatcaccaccatcatcatcaccactatccttatcaccatcatcatccccaggcgaccagagcagcaccatccttatcctcatcactatcaccatcaccatcaccatcatcaccatcctcatcctcatcaccatcatcccatcactatcatcaccatcctcatcacaatcactatcatcaccatcaccatcctcatcatcaccatcgtcctcatcaccatcaccgccatcagcatcctcatcactatcatcatcaccatcctcatccctgtcaccatcatcgtcttcatcatcatcaccgtcatcatcactatcatcacaccagctctgtgcaaggcccttagataaagggcagcctggggctgacctcacacaaggataggaagccccaggtgagcaatgggtcagtactgggtcgacaccagatatccctgggcagaggccctggcccaaggatggggaagggaagaggacaagggatggggagtaagaaatgagggcccctcgcctccctgggacagcccaaggtgcagcctttcctcattcctggaggtttcaggatatccctgtgctgcatcctcccattgtacggtgagggggtgactgccaacccactcctcagatgaggcactgactgaggcaagtgccttgctggccaccttgcaaggccaggagacagtgcacacaatctggactccaagatctctgcccacccccatcttcatcaccactatccttatcaccatcatcatccccaggcgaccagagcagaccctgagccccagggatgacacagcagggaggggcagccactctgggctccccagtcccccatggcacctcaacctcagcccaggaggctgccctcccagggatggctgaaagtgggccctggggtcttgcagccctgggctcagatgtagcctctgcaccccctcacagagtaggcagagaatctgccagccccctccaaatctgtccccacaccagtgatgtgaggacaatgagaggccagcacctacctccccccaggaccccaaagaaaccccacccaggcccccacccagcatcctgcctccccagaggcctgccaatgtgacctgggtcagcctcgtctcaggtgaggagtccagggaggcaaggtacagctcacagcgtcccagagccacacggacccctctgctccagcggtcttgcaaggccactctggcctggcctggcagtagccctgctttattgaggagatatggcaggcaggatcctggctgcatctgggctggaagagggggcagcagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacgaagccatgagcagcagtgcacgccggtaatcccagcactttgggagactgaggtgggaggactgcttgaggccaggagtttgagaccagcctgggtaacacagtaagaccctgtctctacaaaaaattaaaaagttagccgggtgtggtgatgcatgcctgtaatcccagctacttgggaggttgaggtggaaggattgcttgagcccagaagtttgaggctgcagtgagccatgatcatgccactgcactccagcctgggtgacagagtgagactttctccaaaaaaacacacaacaaagaagatgcactatggtattggcctccttcatagcacactagatgccaggaaacaacaacactgcaacagcttcatagctctgaggggaaactaatttcaacatggaattctagaccgaaacaatccagcttgaacatacttgtaaatacaggaagacttccggaatgattcttcaccatatcttctttagagagtgagtcaggcttatgtttcagccaaaatgaggtgcaaacccagaaagaggaaaacgtggggcccaggaagcattaactgaaatttcaacaggtggtaaagggaagttatggggcagcaggacaagtgcttggggtgaatctttatccagggaaaaaaatgagaccccaatagaagccctgatgtggggaagagtaagcccatgagggtggtggatgggtaaaaaacatcaactgtaagccccaaggaaaacaaaaggccatgaaagagaaggaaggtcacccatcccacggcaggattgagaagaacatttatgggacctgggttgggaaacactggctgtgaatttaactgatggcagcgagacagccatgctggggagtgtgctggaggagacagagctggagtagaagctgaggaaatgtggcggcaaccactggcaaagccagggaacagaggcgacagtggctgcctcccaggaggacgcggggcaggggcagattgagcccattctccagaccagcctccgaggctgggtgcaggtgttaactctgcaatatgttgttgaccgaatgttattattttttaaaacaactgcatatgtggcactaaaatctcagaaaacagataaataaaaagaaaaaaaagaaagtgtatcttccagaaggtggagacaaatgtaggttagaagcaggtgtctccaaggtgcaggaggagagcgagggacagtgagagctcaagagcacctggacatacagccccagggcagctggcatctggccagggaggatccacatgctgctttttggtcccctgctcggccaagggtggctgaggatacatctgggtctcccaggacactatgggctcttggccccagagactctgcaatccagacacccgaaggggcagcttctggcctaaaagcccaactctgtgcttgggccttccctgcaggccaggcagctgcttccctgaaccagcctcagagttcctgcctgcccacccagcccagccctcacactgtgatgaagccccacccctggattccccttacccctgcccgctcctgtcccctccttgtcacagatctgagccccccactccaggctggggcccctcaggagccgggggtaggggtgtgcggtcaacacccagcaggggtcgcctagcactggggtgggtgtgcagcccccagcctcctttctgaccgtgcacacgggcttctctcagctgctatgagagcccccaatgcgtctccacaaccaaaccgaggcacgcacgcagcggcgacgtgaataagtaattgctcttttattaacaagtgataaattattcctatatgattgtgtgtgataactcttccttatttgaaatcaatttgggatggaaactgttgtcggcttctcatccacgagggtgggaggcccaggtgccgctgcctcttggaaaacgaggtcagtgtatttcagctacttcctgaggctgatgcgccgccccactgcgcagggccagtggaagggggtcagctgccctccgggaggcggggcagtccggccttatttcctcagcatctctgtctgggacccacgccactgagcccagggcacagaggggtccctcaagtccaaggccacactgggcgtcaccacagggtcatcaggggtcagggggccatgcacaggccatactgcattcatccccccatgtaagccccaaagactgggcagcctgacctttcatcccacagaggacactccagcacccagctggtctcctggcctgcccgggccaccccacggtggcttctcaaacctgcaaaggcataagccattctcctaaaattgtcctgatgattttacaacagccctggccccatccccttttcttcctcccccagcctcacagaggagggttcagggactcagcctgttcagggcagcccctgggccaggcctcagcacctcttctgttaatgcatatttaaaaccttgcaacccaccgggcagccagccagccggtgcctccctcccaggccaggcctgcaggaagccatgccccgtcccgctcactcctccactggctgcttctccgaccccgatcatggctgcagcaggcctggaggcccggtcacccccaggcccagtcacatggccctactcaggcaccacctgtgcttcttggctgggtttctcatctgagaaatgggaaggctgggtctgggtgaggcacttctgtgggcccactcccacggtctccttgacacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatgtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccatgagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagccaggaagtgctctgctggcatcctacctggccctgacgccaggcctgaagccagcaccacccggggctctgttgctccaaggccattgcccctgctggcgtttgctcaaggagctccccctccagaatgccctgccctattcccagacacacttcctctggggggctcttctcccccagccccacccctgccacccctaaggaggctggccccttcccaatcccttcctcgtctgcaccactgccttgcccaaggtgtccatcctcagacccaatggggccaccatgggagcccggctgggtaatggcccataagctcctgcccatggagtactcaggcagggaggggcacaagcttggctgagcatgagtgacaggctgggtgggtctcaacctcaccctgggcctggggtagccccttgcaagtgaggatgttgaacacggtggacccccaggcagaaagtgagccacggggggctatgcaggactgcagccctcccctcccctcaattcactggtgagtagcctgctactcccctggctcccagggcagggccctcatcacctcgagacccagaagcagtgatggagaccgtcctgcaacatcaagctccctgtgatctgggggccaggggatcctgagtaccctgcctcctggagtgctctgcctgcagggggcagtagcagcaccttcaggtggggtggttggggtggcttcccggaggaagtgataactcagctaggagtggggcgtgggggtggtcctgacatgtaccaaggctgggggtcaagtgtgcactgtctctcagccaggagggtggaggcgctggaccaaggctgggggtcaagtgtgcaccgtctctcagccaggagggtagaggcactggaccactggggcctcaggtgtccaggtcacttgtccctggagtccctggctatgacagaggccctggtgggcagctcggggttggggacaggccaaggcataggggagggcacaaagggaggttggtgccccacccatcacccatcatccgcctcaggccaccccaggggaccggcctccgctccggcagcgggtgaagaatggactccattagggccgccatctgtctcagccatgacgggtcctcgcggtgacatccgggaggtatgtagatggaatatctttatggggagagtttttcttttgccagttttcaaataggaagccagacacttgtcacacctgtccctgtgtcagcctctgcctgacataaattggggccgaggcagggagatgaaagacagcctggaggcagccgggtgcgcagggcccatgtgtcaggccgagggagcaccagagctgcaggcagcctcctgctggggccaaggagagctcgccccgcagtccacctccgcagcctctgcccctccctccactcccctctggacccacaagttcttcacctgccctcccccaacccagagccctccaagcatctcacccgggcagtggcctgtcctgcagccactgggcttctgttaggggacactggagcctcctcagcccccaggccagcagctccagctcctcttccagacctggggccagtgtggctttcatgagcggtcaatgtgggaggctcagagtcctcaacctcacccccgctgccactcctagggaccttgtgggcttcagcatgtttccctggaatctgggggacttgggggtagagcatgtcaagaacctcaaggtccctgccgcccagcatgggactatcttagaactgatgccaggaagaatttgctaagagaatgaagggagaagcaagtgacccctgtgggcctcccctgcatcggggactggaccagggcccactgggagtgcatcttggtgcctgaaactgcaccaaggatgaggaggggaggaccctccccaggggacacttggggttcacctggcaggccacactcaagtccacagtcccccatggccccagcgggtggggcaggggacgcacccagctgagggaactgtggcagtcctgctgttgtctcacgtggccctagggggctcatctgtagcccccacgggagccccaagaagccaatccctgctgggctcatgggctaccacctcatacagccccatccctcgggaggccctgaggagaccctggggctgggcagggcgtgaccggccagctccatgcttcctgacaagggggcctggatgtccagggagagccaggagggaagcggagactcaagtggagagtgtgtgggagggaacgttgctgggctccacaaaggagggggcaccagggctgactcccaggttcctggtggcatgcgtggaggcaggtggggccaggagcaccagcgcagcacatcctgcgtgaccttgggccagctcctcagccctccctcgacagccgtgctggtagctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcgccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacatgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgctccagcttcacgatagccacgtgcggacagggaggctcagagggtaggtggctccccgggggaaacagagcaacccttgtgcagccggctgggccaactgatctgcacctaacagccagtcttgaaggccaccaaccctggggtctcccggagctgacccagggacagaagggcaccaggcactgcccacaaaggtgcaactgatcctcctcaccggcgcctgggccctccctccctgccagtgtggctgtcccacccttcatggctttctgcatcctcaagctaggcctgggctcttcaagtggagaggggtaggcagacacaggtgccaggcactgggaactagggacgggggcttccctggtgaggatggaaaagaaggttcctacatgagaccctctagcccaggccctgagaacgaaggggccaaagcttcacctaggggcagccatgggggagtttaggcaggcagtgcctggctggaaacatgtcttagggaagcacttgaatcccggggtggggaacaagatggtaggcagggagccggggccggctgtggccacaggccggggacagaggccaggtctgaggatggccctcagtgaggagtaaaggggatggaccgggagacagggtgcaggtttgacactgattttgcctttggggatgggtcgagggaagaggctgagactctgggcttggacgttgggtacggaggatgtgacactagcagacaggctggatctggaggcccaaggtgtgtagtgtggggagctgtgtgtgcaggagagatgcagggcactagggagcctgaacccctgctccagtgcacaggccgggcacacggcagggaggaggcagtcaccattccctcacttgccgggacctgggaggcagggcagagtgggtgatgggccaggctggggccttggaatgacatctggcatgtggcagcggaggggggacatgtaactggggactgtggactcccagctggaatccacctccaccttccacatccacgcactgcattttggtctttactgagcacctgctgtgtgcaggggctgctctagcccctgggaccaccaagggccagccctccacaaccccagacctgcactcagcccccacccacttcctccagagccccacaccccacacactgaggactctaggcattttcccactcttgaagacactgagctgggaacaccacctctggctaccagccgtggactgcagagaggcctacggtgaccaggaagggtggagctgcccaaggtcacacagcaagccagcactgcacaagcttacccatggctgcccagccttggggaatgggggacttctggcatgtccccgagctgggccctggcagaaggcaaataaaggcaacatctcaacaaggttgtgatagccggggatccaggcaagcaagggacaatccaggaaggctcccaggaggaggtgaggggcctggagcccaccctggcctgagcccctccttggcactccagcctgcctagccctgcccccttccttgacgggcccctcacccagcctcagccttggcctgacatttcccgtgacatttgctgcaaagaaatagagtcataaatccaaaggttaaatttgcacatcgcctcaaattgctgggagaagcagtggtccctccacccactgggcgccccgtgggtgcggggtttgtgtggcagggtctacccatcccagggcccttgctggaggcccacaggtctcctcctctggtcctccggggcacttcaaccactgtttcccaaaacaggttcctgggcacaccaggccctgaggtacatcgcataggggtgcctctcagagaaggtgctgcccacccctctccaaaacagggcccaagacgccctgcgggaaaggagcaccatcagcaccatttattccagcaggtcccacatttgaccacaaagcccttatgtgatacccccaacattccaaagaatttcaactccatggaccgtgacccgtgacagccagctaagaatgccagggtgctgactggagagccaagaggcacccgggggcccagggcaggctgctctgagtgaggctgggtcagcacccgacacctcactcccagatcagcccagctccatgtgccagggccctgaatggggctttccacctgccaggcctgtgtagacctacatggggaccctggcctgtgcccactcagcccctcctaaggccactctcgaggtgtgccaactgccctgcctttcttctccacctcctggtctggctgctgtgggttgcctccatcggacaggacacagctgcggaacagtgtcagcatcaccccatgccccgctgccctgctgccccgcagaagaggccccgcaggccatagcaggcaagaccagaggctgtatgaaagaggcaggggagaggtggccccaaggcacccactgcacaaatggctgcccagactctactcactcaccatcacctacccggccagcccacggttgtcaaagcctcagtgggctaggaggggcaggatctggccctgctgccgagtcccctgaaatcagcccaagcatcgggggagaggcacgtgaccagaccccagacctggtgggtgccagctgaggacatggtggggtgggtgtgcagagctgcatctcccagtgtccagctccacggctgcaggcagtgcaggaggccggtgcaggtttggataaataaatgatggtgcattctcaggaagggattccacacacaccagaaaacccatgatgcacaagaatagttcccgatgtgcaaaatgtttaaaatacagcgataaaagaagaaacggcagcacagaacacctggtgtgggggagcccagctgggccccagggacagtgcagggagatttgtggggtggggcagcatgcccgccgctccgatcgggcttccctgggccactctgtgacctcctatcctttaaagcatttaatcctagagatgcccgatgccaaggatcacaccccttgatttgcctggctcagaagagaatctgacaggctaggaacgaacgagtgaatgaatgaacaaatgagaaagtgaatggatggttggggcaaatgcagcatctgggatctggctttgaggagggtgcctgtgaccttggcctgggtgcagccagaccgcagagcagggacactgaggggtgcagagagggacccgagagggcatctgcacagctgcagaggcagcaggcggccaagccagctcccgcagaccctgaggcccaggccctgggtggctgcagagggtcaggcagaccagcctgggggtcagaggtcaggctcaccagaatgggggcgggacggcatgaacctcattgatcagatagtagccaagtgtcaggagccctcactaaccctgtgccagggccgggcggggcgcctggctcacacacgcatttgttcatttccaggtcatcctgaaactccccgtgtgcttcctgctcttgacccctttcccaggtgcacagaccaaggctcccggtgagaggttccgggccacaggcccaggacagcaggagggctcctctgcctcccgcccgtcctgtcctcaccagctggaccctcctggtgttgcaccggctgcacagggccgtccgtgccacaaagcatgaattcaaggctggggcagggacgaggagagggcaatgctacaaggctgcactgttcctgggcagagggagggggagagcacggtcccacacaccctggccctcacagcctgcctgtcactcacagcaacagcaaacaaaccctggcccctccacaggctgtgggccagttcccagcctcccaggacagcaggaccttcccccaccttccagggccccagcccctgtaggggtgtcctccatggaccctccacaagccctctggctttcagagacgtgctgggccaggccctccctcagcctctcccctgcttctcactccatgcaaacctacgtttctgccagtcccagcagaaggaccctggcacggggaaactgaggctcaggggttccacagacccccaggtgaggaacagggggagggcagggagggagtgaaggtactatgggagggtctcccaagctgggcagcatccctgccctgtcccctctccactcacctgtggcccgagttgcctgactaggggcttttattgtcccttctgcacatggatggggtgaggggccagctggcagtgcaaaggtcccaggaggactctgctgagtgggggtgtggggaggtgttgtgggcattctgaggcagaagcaccagagtcagaactccacagggaaagccgggccaattccgcccagcctcagcctggaagtgccccgataatccctgaccactggcccatggtgcaggtgaggaagactgaggcagagaggcgacctgtcacacccaaggtcacaccgccagcaggtggctgagccaggacccaaatccaggtcacggttctgccacggcaggccctgcacgtgcccctctgccaggtggcgtctaggtgctgatggccacccattcccacccccggcatgggagctcacttcctcctcacctcagtagagaagaacagggaacagtaccccctttatagatgggaagactgaggcttagaaaaagagactggccagccccactgcttcagctgcccctctgctagtatgtttcaccctcacacaacctacaaggataacctgctggtccccactctatagatgagcctctggtggtggccaggggagcaggaggtgtggcctgccaatccaagccccagcccagggcccttgccacagtgctagtgggccacccttgcccatcatgcagcatggcatccatctgctcagcaccctacacaacaccggaggtaggggagcccaccacagaacccctcaccaagaaggtcctcaccatggagaaactgaggcactggaggcggggcctctgcagtcacgctgggtcacgtgctccagtcagccaagctgcagcggccaccaagggtgcccagggtctggcctgttggtcacagtgttgacctcatggcctgaaatgggtcttccctgcccagacaggttccagcccaccatcatctatctgcctcagccctggtgggtagggagtggctgggagaccctgcccctcacaccctgggctttgcggtattcaacgagcccccaacacacattccagggcctctgctccagattaggccacagcctgtctaggcacacaaggggcacccacaccctggaggcaaagagacatgcctatgtgcccgcaggcacacatgatcacgcgcacagacacacgtgcagatgcataccaagttacacacacgcacacaagcccgaggcggggacccccaggacacggaggcaggcaggcagaggtggggcccaggatgtcttgcccctgtctgtgggcctggcctccccactcaacagacgagcatgtgggtgcgggagtggttattgcgaaaggggccccagcatgtgccacccgtggagaccacagcaggcatgccgcgtgcatgcatgtgtggccgtgggtgtgcaggcgggggcgaggacacagatatgcaccctcagagtccgtgtgtgcacccagtgtttgtgcatgtgcacactggggcggcgttggcttgcatgtgcaccagaggtgtgcaagtgtgcagtccgtgtagacaagtgcacgtgcaaggaaacgtgtgtgcagcctgcggcaccatggacatcagcagggcagcctgggtgggcacctggggagcaccctccaggcggggcatgcccaactcacatggagcccaccctcccttgcccgcaccgcgggacctcacagccggtggggcgggggagtcccacgagggctgctagggaggggttgctgattgccccaccgcccctgattcccccagccaagcctctcaatgtccctcgggctgcagatggtgggcgttgctgcctcctctcaccgcccgccctggaggcagcgctgggacaaccctgtcccccacgccctctactgccgccaacgcccccattcatcccactgtggactgacctcggagaaacgggaggttctgagcccagaccgtgaggctggggtggaggcggcccgacacccccacccaccctcggtacccacgtttctgcaaaaacccgctcgttaaccccttggtggccggggcgctccgaggccgggccccgcccttccagcccacggcccccgccctcgacttggcccagcatcggggaccctcggaccgccaccctcggccctgccgaagccgtcaactttcccgggaagcggcaacttttcctgccgcctccggctccgccctcccggggccggggcgccagcggccccagcctggcgcggcactgcggtggctttccctgccgcccggctacgcttccctcgcctcggcagcccgggacgggccctgcggctccggggagggggcgagccgcccccctccgcgccccgccgccggccgggctcgggtgcagcgcggacactcacctccagcggacgccctcttcatcgtaggggttgggcggggcgcgtcggggactgaaagtcgtttcggggcgggcgcccgtctccccgcggccgggtccgcatccaggcgccgccgctacggcccggccccggcccggccgcgggacgaggctcggcgcgctccgctccgcccggctctggctgggctcgggccgcgggtgcgcagggcgcgcagggcgcacag

SEQ ID NO: 540 - DNA, 5868 bp, Homo sapiens
cggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgtgaagcctggtcatggcctgccaggacagggtggaatctgagcttctgcccccaacagggccactcggaatctgagcctctgcccccagcagggccactcggaatctgagcctctgcccccagcagggccactcggaatggcatgcgggaggggagcagaagagggccctgtgtggcacagcaggcctggagagggtgggcagtgcccatggctggctggctcaccctcctgtagggaatgggcctggcctccgtgctgggaatggcacagaaatcctttccagagcctcaatccttccacttcacccccataccctgagcctggctccccagggaccagcagtaaaaccccagatggaatggggccccggggcactcgggctagggcagagcaggcccaggcactgacctgtgggttggtggtcacgtagaagccagccacccccgccttctccagtgtgctctgctggtcagccaccttccggtccagctccaggatgatcttctggtccatcgcccgctgctcctcacggatccggtgttccacggcctgccatggggccagggcgcggagggggagaggtgagggcagctctgccatcagggggcggggaggtgagggcagctcaaacacatgctcctgctgccgtccccagtggcagcagctctgacaccaccggtgcatcctcaccacacccaggcctctcctcggccatgtgaacccctgaagggggccccaaggggcttccacgaatgccctggcttgggactgccttaggaccacacacacatctccacaggcacaccctgccccacggcttgttggttacatgccagtctctggttgtccctgtgctccctgggagaaggatgggccccttcctggccccaacaccctaccattgcctttgtacccccctgaggccacctgctctgtggaggcccaaacccacgaggagctgctatccaggggagcactggtgggttctcaacctccacccagccccagcacacttggtatccgcaaagaggagccacctggtgggactcactaggcctccagtgtcccactcaggcccaggacagccacccatgcctgagcccccacaccccttcagctcagcccagtcagcagagccaggtggtgcccacaggagagctgggccggccaccctgcctgcgcccccagtacctctagttctcgctgctgagccgcctgaaccacaggcaggttgtggggccggcaggcctgctgggcttcctggtgcttctgccgcagcgcctgcctgagcactgggagggatgagagcccgtcagcaggcggtgggactcggcagcagccctcacccatgggcacctgccttgccagcccagcagagcagccaggccaaaggggtgtctgcagtggggaggatgccagcctcctccatcctcccaccccactgtcacccagggccgggcccttatctggtggcaagtctccaggggactccagaaggtgcggggcactgaaagagtggggtggggaagactggccaggtggggccaaagctgcagccccagacccagggcagctggaggaggcaggcgggagggaggctgcagtctgagggcttcagggcccccatggccacaggccatgagacatctactcaagtgtcagagaccacctcaggcaaaggcatgggaaaggagcaggaggagcggggtcgctgaccctgagcgtggggcctctgcctaccaggggtgtggtcgggccctccaccctcagtgctgcccttcagggtagacagcccctccctcatttgcagctcccagcccccgcacagcgccagagggagaagggtgggcagacctgggaggcccaagtttgggatgagcttggggtgccataagcctgtgtggctctgaggggctcaccctcagccatcaagtaaagctccacggtccttgctaaactgtgcacaaacacagatgtgtgcaaactgtctggtctgaagggaatgtacagaggaagcgatcatgggacataaaccaccatgaaacagaacatgcagcaccccacagctggcgccagtgaccagtaagtgccaaatggctacagctccccaggagggaggggtccctggccaaaagaaaaggtgaaacccaacactctgttcctgggaagagccctgatgttgcagctcttctctggtggccagtccccagggaactccagggcccctgaggctcccctgcaggtagcctggctcccgctgtgcctacagccttccccgatctcctgtctcttcacattctgtacacacctcgacgatggtatttaccaaaagcccccctcaagacagctccataacacagggaagcagggaaatgtcatctccttcactctactgatcaaacattgctacaagtgccaggtccactaccagattccactagatagacaaccaaaaggcaagaagagagccacgctggctgcctgggcagaaggggcctggccttagacatgaccagggaacacaaaggaggcaggagcagccagtcgcccctgccaaatcagcaggagaagcagaaagtcaatgcaggcatgcctgctgctggtggaaccagggcctggcccaaaccttctgaagcacaaacagcattgggcccaggcagttactaaaactccccatcctgctataaggaactatagctctgtggaaaaatggccgattccaggactgagacacggagaaaacaagaaaagatgagcctgaacacatacctgaaccagaaagcaagaaagtgctcacagaatgatggggcggcatctaaaggtgcctggagcgcccccaactggccacacatggcacagtctgggcattaaggaataatgagccatgcgcttgggattagtaaactacatacatcttacagctcaataaaaaattttaaaaagacaatcgcccagacatttaggggaagaagtaatgccaattctacacaaactcttctggaaaactgaagaggagagaacacttcgaaactcatcctataaggctggcaaaaaccctgatacccaaaccagatattacatgaaaactatagaccacagtttatcatgaacatagaccaaaaaattcttaagattttagcaaatcaaatccagcatacataaaaaggatactacagcacgacccagtaggatggaattcaagtgactgtaattcactgtagtaatagaaaatgattcaccacgtgatcatctcaagagctgccgaaaagggaactgccaaaatccaacatccattcttgataaaaacacaccaatcctggagcagatggacactgcctgccttctggggaagggggccttgcactgctaggagaaatttttgccacattaaacctgcttctaatcaggcttctaccagcagtccagtgtacaggaaacccagagagtggagaagcaggttaaatgcaagaggaagcatttcgtctgatagatcaagagcagggcattctataaaattagaatgccctggactctacaaaaaagtcaatgccacaataaatgttggggactgtttcagaagcaaagagaccaaagtaaccaattgtagtacatgaacttggactggatccttacttataaagcaacaatttgccacaagttaggtaccatgatgtggccgtgcactgaaagtcaggagacacccggaacagttaatttctcagggggctaccttctgcagctgtgtaggagaccagttttgttctagagcacttgctcccaatccaaggccaaggttgaccccaccacccaggttgtctggaggcattcttggttttcaggactagggagggtacccctgccatcctgcaatgcgcaagacagcatctcaccaaaaagacttacccagccacaaatgtcagcatggctgggttgaaaatcctggtctccaggaatgctgaagactcttggtgaatgctatgctgtcacatgtatatattttgggatgtcaagaactagagcaaaacgttaactattgaactttagtgaagagcacaagcgtatgcactatactatcttttcagcttttctaaatgttttaacttctaaaataagaagtttgggaaaaataacaaaggtggaaactgatggtgcagggggacctgccctatataatttgcaggaaagggctcccaagcccaccaagcaggcctggctcaagtgggaagctcttcgggtttgggagggcgccacaggagacagtgcttaggaatttgatgtgcaactggaatgaggccctgcgaggcctgagagggaactgaccctgaaagacgcttgctgcacaactgtcaacagacttccaactactgaggggcaatgctgctgcagtcagcgccaccaccagagtctgcctgcaggccaatcaggcaccgaggcctagggccatcctgtctggaagcgcgtggggcacagggaagcccgaacagggagtttctgctaagaaggtgggtgctgcgcaactgaaaacaaaactggttggacccactgatcaccaaaaaggcgctgtctcagtctctgcgcccgttgattttgtcaatcttagagacctcttccgaacacttccaaggaaggagctgatctgcacagataccaagagctgcccggaggcgccgacccggaggaggcggcacctcatcccgctgcccccgcgcacctcggtgctcgttctgtaggcgcaggcgctggttgtacaggctcttttcggtgaggtgctggatctccagtagcccctgcacgatttcgaacacggtgccgtcgagaagcgccagggccaggtcgctgagcgtggtgtaggacaggcgctgctggaaagagctgcgggtaggggggcgcggtgagccccggcgggaaacgaagccgcctccgcaggcctccgcccgccccgcctgcgtacctgggcaactccttcaccaggctctgtagcgccgacagcaactggtagtgtcgctcctgctgccgggcaccgtccgccacctcctccaaggcggccgcgtagcgctccatggcgcggacgcccgctagccgccggcggcggcgacgagctcccccagcttcacgacatcccgagcgcggcgcgtcccgccccttttacgattgtcccacgcgcggcgcgctccgccc

SEQ ID NO: 541 - DNA, 24872 bp, Homo sapiens
atctgtgctgagtttttcaaaggtcagagcagattgaacctttgtggttccattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatggttaggttttattcctcaatttatatatttgattcttataccaagcagagtacctttgaaatttttcttcatttaaaaaatatgtatcttggctcaagcctgtaatcccagcactttgggaggccaaggcaagaggatcacaaggtgaggagatcaagaccatcctggccaatacggtgaaaccctgtctctactaaaaatacaaaaaattagccaggcatgatggcagctggtgtagtcccagtgtgaattgggattcagtttattcccaaattcccaaaatatatatatatatataatatatattatattatatataattttatatataatatatattatattatatataattttatatatatatatttgtcggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtcttgctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactagaaatacaaaaaattagccaggcatggtggcagctggtgtagtcccagtgtgaattgggattcagtttattcagtttattcccaaattcccaaattatatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagagctttgaaaacctgtttacttgttaatgctgttttgatgtattgtgtctttgttctcccgacccatcatccagagctctctgcaggagctaagtgctcatcagttccatgatttggaaactgtctaagtttagaggcacttgtatttgttagtaaataaggcaagatgatattgtttcacaggttttagtgcagaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaacattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagcaatgctgtgtccctccacatcccctaggtgactcgaagaagccttccaaaaagcgtgtgaaaaggaagccctactctactaccaaggtaaagtagcctgtctttgcctaagatgcaaatgttgttttcttggatcctttatttttcagttgatatcagctatgggaaaattatccactacattataggtgttagataatatttccttgggggtggaggaggtgtattttaccaactgacacctgattccagaggacgtgcaaaattggcagtgtcagatagtacactgggtgctaagggatgttttcttcaggaacaagctttccactttagataagaattctgcaatttctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctacgaaaaaaatgttgtgtttacccagcacaactctcagtgccatgtttcttaatttaacaaatcagaccacatactttacttacattagttcacacctcatcatcatcatgcccatatgttgtgagcttgtttactgagcccacatgccagatggagaaactaagccacataaataaatgtgccctggttcacttgctgcatagtgaagagtcaaaatgtttactcatacggtgctaatgttgaaggcctgaactacaacctctatttatcagccagtgaagagatcactattcaccatgcaagggagttccagcaccctctatgcctggaattacccacacctgcagagatcccaaacgccatccctcacataagagaacgtcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaatgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcattatttatacattttcaataaatgatgatcttcataacataaaatcaatgatgtagtacactagaatactgtccctagtattgaatcttgtctctcagcaaagggttgcttaaagtcacgtgacagattccattcaactgatggcacatgctgtagcagcagttaaagcagtcatttgaaaaggcttttactataaacttacgtgtgagcctgaagtgggggataaaagaggcgattagctcccctgtgccatgtttctcttatgtgcgtggtggaggaaaattacacaggaaggtgatggagagaacagagcaaaggattggacaggtccattgaacccataagactatggtgaggttagtgaatgagattggtcattttaggtcaaattttacccagagctggtgcagccactgcccattcttagccagaccttattgcaggcagctctgatcaatagtcaaggaggcagtgggggttgtagactttactcattaaatcaccaaagcaccagcccacacggccacttttccagttaattgacagtagcttgcacattcaggtttgatcagtggaagggaagttactctttgcagacccatttttgacaatcattttgcggtgtcggaaggtctgagcagcctcgggaggcaagcagtccctggtccctcagtgtagtcactggaggagacagtcactgagaggcagctggcagggtgaagggaaaggggaggcaggccacagagatgacagcctttaagctgtcatactgggaggtcaaggatctgaaagaggaaggagaattctttatcattaaggacctgtccttatctcaggcatttcctccagagcaccacctttgtccacccacacaccttgggctaggaggactggagaaagacagtgaggggtctcttgggtctctggcacagggcgtgatgaagagatggcagtttttcaggaatctctctctttagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctctataaaccataaggcgtcatgcccacggaaaagccgaacaggaaagcatgctccactgccccggagccatccaagttccccctccatattccgccactgctaagtgtccagcttattcctcctggcatgtagtaaacacttagagaacattactgaagtaccagtcctctctaaggttttcctgtatttagtgattttttagccctgtactgtgatactaagaagtagggcttaaatagggcctaaaaagtattgctaaaattacattatgacagtgcagagaactgagggcagagggaggacatgagcttgccaggtccacatggcttagtggaatttgaatccgggcccccactctgcaccagccctgcactcacagtcatcctgctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggtcttctgtcagcaagatgtcaacagccctatctattgtcaatgcattaaccagcatcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacataagcatagatctccctgaaagagtggtgctatattattatttttcaattaatatatttctttagagagttttaaattgacataaaaactgagcatatggccgggcgtggtggctcacacttataatcccagcactttaggaggccaaggcaggcagatcatctgaggtcaggagttggagaccagcctggccaacatggtgaaaccccatctctactaaaaatccaaaaaaattagccgggtgtggtggcaggcgcctgtaatcccagctactcaggaggcggaggcaggagaatcgcttgaacccaggaggcagaggttgcagtgagccaagatcatgccattgcactccagcctgggtgacaagagtgaaactccatctcaaaattaataaataaataaataaataaataaataaataaaaattgagtatataatacaggaagttcccatattattctgtctcctcaccctcacttcctaatttcacctattagtaacatcttacattactgtggtacatttgctagaataatgagaaaatattgacacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtacgctttagctgctttcatgtcttttttatgccttaatggcaaaaaatggcacattaaatcaccaaataatattgcattcaatgaatttttgtctttttattcacctgttgaagaattcggtagatttcatgagagaaaccatctgggcctggtgctttctttttcggaatgctcttaatgtgaattcaacttatttaatagacataagtttattcacattaggattctagcgtgaccttgggaagattgcctttcaaggaattgatacatttcactgaggttatcagactgcggtcatagaactgttcatgatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtcacattttcttttaatgtagttaaaagtatttttaattttctattgagacttcttaacccatgagttatttaaaagtgcattgctaatttgcaaatatttggggattttgtggctcttttacagttgttgattttttgttgtcaggtatgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccgcaatctaggcgagggggcatcaacggcagttctgctgtggcactgccctccttcttagcttgtcttgctctgtcttaggctccctcaaagatcccacccttcaggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaatcaaggaaaatgtaatagttttccataaattagaataccctacatgtacaattaaatgaaatggctagtatagtcttgaaaccaaaaccagataaggtaaattaaattctgtgatattttaaaatactttaaattctgactaatgtgagttaatctcaaaatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgttacaaccacttgaattaatgctgctttcacagcatatctcttggcttgttaaaaacccgacaagaatttccgtaacattatttttaacacctatattgggtgtgaacccaccataaagtttgcccactgaaaaggtctacaatttgatgctttattaaattgatactgtgtgcacccaacaccacgatctaatttaaatatgtttccctcacccaagttctgtcttgcgcactggcagttaatccccactcccatctccagccctaagcaatactgctgtgacattccatctccataaatttcccacttgctttatagaaatggacatatatatatatttggaatctgacttccttcatttagcatactatgtttgaagttaattgacgtgttagcacgtgctggtcatgtgttttccttcatagtctgctgtgtttattcatacaaatagtgtttattcatttatcagttaatggacatttaattgttttgttattttctttgatgagtaatgtagctttgagcattcacatacagtcatgtaatgcataatgacattttggtcaaaaaaaatttttttttttctgagacccaggctggagtgcagtggcacaatctcgggtcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacaaatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaacaccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatgtaacacattatttatcatttgaaccttttaaccaaagtgtgcactccgtggcattcaatatattcacagggttgcataaccaacaccactatctacacccacaattttgatgatttcttacaaaaccttgtccacaataagcaatatagcaccttccccctatttccagcccatggtgattcctatccgactttctcttgtatgaatttgactattctaggcacttcatgtaattacaattatacaatatattccttttgtgtctggcttatttcactaagcataatgttctcaatgtccacccatgttgtatcatctatcaaaatgatgttcgttttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaagagtagagttcctgggtccaacaggggttctatatttaaccttctgagccactgcagactgtttttcacagtggctgcaactttatccatttctaccatcaatgtatcagggttacaatttctttacgtccttgttcacacttattttcctttaaatcatcctagtaggtgtatattggtggctgcttgtgtttttcatttgcatttccctaatgactaatgatcctgagcagcttttcctgtgctactatctgtggctgtatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcactgcagagttaaaacataccagcattcaacccatgtctcctgtcttgaagtaaactgtcgtatgttggctggcctgaacaagcgtagatattctccatcctcaattaatatgcatgcatgacaaagaaaaggaggcctggatgaaaaaatactgtgtgattaataattatgctttaattaattttaaaggatataatttcagtacttctaattctcccatcagcagttataacaaaggattagtgaataaataccatagactgttttgcctagaattgaatccaacctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaataactcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatacaaaatggcatttagctatgatggcttcaggttgtagactgtatccttggggtccttgtccttggaagcaatgtcttctccttggattcagtattttgcacttgccaacctacgtggacctgagagatccaccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcatgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaaaagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggtctccgtggtcacacaacccagggcagttataggttcatctccccacggacaggcatagtcatcagtgtgtcaaaagcacaaagatccccaggtgtttggctcagctcaccgatcctttttttttttttttttaacttttaagttcaggggtacatgtgcaggatgtgcaggtttgctacatatataaatgtgtgtcatgagagtttgttgtacagattattgcatcacccatatattgagcctaatatcagttatttttcctgatccaccccctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgactggctagtgccgggtatggccaccagcccaactgaaacaaaatgttgctttaaaacaagtgtaaatctcatacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaagcaaaggcctctgtttctcatttctttcctgttcatctccttggtcatccttcttccacaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatccttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgacaagggcaacgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccagggcatcgccaacgaggacgccgcccacggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaaagaggacgctgtacacgacatcgctaatgaggacaccatacaaggcattggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtataccacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacatcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctctatatgacatcgctaatgacacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggactttgacctttgactcaatcactataccccttcttattttctctctcaagttgtcgagagactatcagatctgtgtgacgtgtatggcatcatttcaccctcctaatgttttcttttctataattgcaggagccattgacactggagaatgatacctaccctgaaataactcacttcctgaggaaaaaacgccatctctagggtacagaaacctgattctgggctccttttgggaaggaggatttggagtctggtgagagcaaatgattttgcaagtataaaacaatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaaggaaacaggaaatatgtgtcatattggatttggtcttttccgggtttattggcataatagttagaactgtctctctgggctatgagggtgctgtgatatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttccttcaacctggagacagagttctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctggcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccacttaactgctcattgactcttactgtagatgaggaggtggccagcagcccctgccctcccccagttgtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtcaaatgccaataaaacaattgcctctataagccacaatgtttcatccatatatttcaatttccatgtgtaagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacgtttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccgtttgttctgtttccagtcttgctcttataaccaatgctgtagtgaacagcactgtgttgagaagcggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacgtgctctgtcacctagaggtgcagtgcttgggaaggccaaccttggagggttgcctgccagctttacagtgacagaggtgttgagagggactgaccaccagtgcataaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgcactgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagaagaaaggccaggagggtggctggaggccaggctctgagtcattctccatgtgatggaaacagccggagcccagtgggcttggaggtacaggatgcggtggctgatgacagaacaatgtggagagaggcgtcatttgtcaaatccttactttgttctgggcattgtactaaaaattctaatggctcatcccatttaggggctgaaagttgcagaggtttaggaagctcacccacgatactggagcccccatctcttgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcaactcctatagtattgaaatgcataggttagcatttttggccaatttactcagcattctgggttaaaggcttttatttattttatttatttatttatttatttttgagatggagtttcactcttgttgcccaagctggagtgcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgatttttttctaattgaggtattatgtacttttcatttacaaattattgtttacatttgaagtgttttatgaattaatatttaattgcatagatgaagattactagttataggcattttactaaccaatactcattaagcatagcatggattcatatgacatcaaggagctattttatttggtaaaacgaaaaagcacaagaatgaacgaatgcaagaactgaaacagtggagacacctagaatgacttgtctaagatctaaatcattttgttgtcttcccagcatacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaatcaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagccgttcgaagtatggcaaaatggaactttaaaacagtatcttgtcaacaaccaagaggacctgtttcacataaagcccatgcattcatctgcctgtccatcattctgtctgtccacacgggcatcattcgttagtggaactgagtgcccactgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccagatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctctacatatctacattgtttgcagattttacaataatcatttattcttgcatggctgatcattgttaaccaatacaaataaaataataaagaaatgacccacatttt

SEQ ID NO: 542 - DNA, 2772 bp, Homo sapiens
gatcagtttgcaagtgccatctgcagtgtgggggaaccaatcttcaacttgcctgcatttggtattagtattttattaacctttcattgatccaattacggctctttgacacaattttcatcagtgatggactaagtgtgatccggcctgacccgcctccggccggcgtgagaaggggcatgtgtcgggctacgctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctcaaccagcgcctgcaggacctgagcgagcgggagcggaggtgcgcggggaacgccgctcttctacctggcgggcgcgcgagggtcggtcccgcaggcagcgccgcgaggtgcttcgcagagtaccaggctgatccgcccgggcccgcatctctgctctaggcccttgggaacgggtgatccacccagcggacccaggtgggggactcggccaggacttcccagtcctcaatcatgagcctgcggctggtccttcctggcgactgcgggatcctgagcgacccagtccgccttgtagcgccaacctcagtttccctctgcagcctgctgcggaggcgaagccaggcagcgcagcctctgcaaggggaggcgcgcgaggcggcgcgggagcgcgcggagcgggtgcgcagaagactggaggaggcggagcgccacaaggaggacttggtgaggaagagtcctagaatggggctggacccagggtggggtgaggcagggcgggcggaagggggcgggatccgggggtggggtgaggtaggaccggcggagaggtcggcaccgccccaggaccccgtccgcaggagcagcacagcaggcagctgcaggagcagtgggaggagctgtcgagtcaggtacgtgcaggagatgggagggcctgtctcttggttcctctcggaagtcctgcccttgtcctcgcccttgttgtctccccgtccctgtctcccctgacactcgttcctccagaagcccggtaaaccccgcccttacaagccccgcccctagctcttctacggaggggaaccgcagagccagaagagcacggagcagcaactcgcagcccaattggtgacgctgcaggtgcttgagcgggaccctgaggtctttagtaggggcggagcagcagcgtgagcggggccgtgaccacctgggggtgtggcttaaggcaggccctgaaggcgtgggcggggcgggggatgtgggcggagcacaatcgcatgggggcggggctctgagggctagaataggggcggagcgcggagggggcgtggccatgaccagttggggcgttgcttacgactggtcctgaggacgcgggcggggtcatgatcgcctgggggcgggcactgagggccgggggcggggcccggaggcgcagcgggttgccggcctgcggacctcctgacattccctgggtccttctcaagaatgaactggagctggcggagaccaaatgcgccttgcaggaggagaagctgcagcaggtgagggcagaagcgggttctgttggaggagggtaggctttcgagtgtggatggggaagggcctgtcgccccgacgccgccgagtctaacccgggtgtccacacccaggacgcgctgcagacagcggaggcctgggccatattccaggagcagaccgtagtcctgcaggtgcggccccactcagacgccaaggtgcctcccgcctctcctcccccagacctggggcggtaagtctcccaacccaccgccaggacgcctccccgaggcctcagtccgcactctcacccgctccaggaggtgcaggtgaaggtgatggaggctgcggaggagctggacgcctggcagagtggccgggaactgtaagggagttgggcctgcgggcgcggcggggcactgtggggccgggctgggctcccacctgcatgcctgtccccgcaggtgtgacgggcagcttcgcggagtgcagtacagcaccgagtcgctcatggaggagatggccagggcggaccgagtgagcgcctgcgcgggtccgggcggggtgggctggagcgggacaaccctccccgtcccccccgcggtaccgcctccccctcctcctggaaaccgggccggcgccgcgggcgcggaggtagctggatgcggccctctctccccgcaggagacgcggctgttcggcggccctcgcgcgctggccatcaggtgagccgggcggtgggcgcggccgcggtcccccacctgcccgcctttcgccccgcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggctgctgccaacctaagtgcagcgccccgcgcctggctccaggtggactccagggcacctggctttatttctggtgcactcctctcctgagagtgtagaccaaggttgcctaataaactcaagggatgaa

SEQ ID NO: 543 - DNA, 14965 bp, Homo sapiens
aggaggcgctaccaggctcttcgggccacaggcctctcctccactgcatgtggcggcagggcgggtaggtcgcagggctccatgattgtggggcagcttcaagggcacatggggcagaggccctcgaaggtcccctcctcagtaggggatgtcattctgatagtactggatcatgttgtaggtccggctcctgaaaggccaagaagagtgaagggagattcgaggagccagcagggtctggggtccctccctgcagggagccctacctgtccaatcagccccttatggctgcccagcacctgaaggtacaaatgtcccaggcgtgccctcccccacccagtgaccacatctgctccaacccgggggactctgaggccacctcatgctcctcagccaaaccgcttccatccgtgggagccactgctctgccccatgggcctcgggccccttggctcgtcctggccagatgcctccaaggggtctgtacgctctcctcgcacctctggagagccccttctcgccctgccccagcccctcttgaggtcctggccgcctggcttctctgcttcctatcagcaagagctccttccgtgcccagcctccacagtgcccttgttagggtgacggacctgggcgccacctgggggcaggtctcagcttcctctcacgctcctccggcagttccccatgcagatggccacacctgggcccctcctcctagtctggatgtggtctgtcccatggcacagccttgggctcccacatgcccctcagggccttaccaaccccacatgtttaagtgctgcccccttcggggatggctcacttgctgggatcgccatcctccctttgttcaggccggacccctcaaagccacctctgactcccacagcagggagcctgtcagcccggtgctctgccttcagaccctgagccagccctccccagggccccctgcacccatctcctcccaccacagtagtgaccagcagcccggcctgcacctccagtcactgcccacgaagcagcccgaggcaggcgcagggaaggagtgggctctgactcctcagccctcctgggaggagggaggcctgacaccacactcagttctaatactcctggccttgtgtccctattgctccttcggcctcacgagccctgcccaggtgggcccggcctctgccaagtgttcccctcggcacaccacagccccctaaaccagcaccccactgctcctcaagagttcctgtcaagacttgggtcttcatgagaggggcggcttggggacagcagaatcctcatcgcctggtgcaggcaaggccctgcaggtgcccagtggccaccgaggcagtgggagaaggcaggggggcggggcactcacctgttgctgaggaagcagctctggatgaccttcatgatgaaatttgcagcctcgcgctcagtcatgttggggctaaacctgtgcctggagaagaggctgtgtcagggctgccatgggcagggccgtgctggctccctggcccagtgggaggagggtcttccatggggacggacttcagctgagagccatgccctggaaatgtacctttggggtccacatgttggaagatggggtgctgtgaaggccacacctggcctatcatgggccctgtccccttcccagcatcacctgagtggccccatggcattaggggactaagcattggggagctaagctactgcagccccagaccttagggtggaggtggggtgggcgtagcatccttgacataaatagaggcccctgggtgggtctctggtgtggccggcacaagcaggggcccctcacagttgtggtctaggggtagagcctcacctaggaaccctgtctgctctgaggttccaaggagatgacaaccacagtgacaattacatgaaaggtacctatcttggatggagcctcagctaatggacaactgtcccccagatggcctgcgtgtccaccaaggaacctacttcaagaacttgattgtctggccgcgaaaacagggcaggcccgtgtccaacatgatagtgaccagggagacgaccacatccatgtagggcctggggagagacaggagggagcggtgggcagaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacagggtggatgggatgcccagaaagggagagcccatggctgaaggcgtgggcaggattgtggggaaggtggttggaattagatgcccagagcaagaatttactggcacaggtgggcagacagaggtgaccaaaggacaggtgtaggtcagcaggtggctgctagcacctacctcactctctggaaccggattcccttcatcctaaaggggatctcagaacgttccacacaccccctccgcctccaccctggtcctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactctgcaacaggagcaccccctccacccccaaaaggcaggttgtgttttcttggagacagtgatggggtgggtggtggggcagcaggcagagaaagagaagggaggaagtggaggaaggagccaagctggggcactgaacctggacgagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcaggcctgtgcagagagcgccctgggctcaaaaaggccctggggcctgtgggcattctccctggtcccacacccaggatccctgggcctgtgggcactctccctggctctgtgcccccactatggaggcagagcccgaatcagcaagtcagtcttcggcagcaggagtgacgggctgtctggatgtgggggtgcaggcacttcctcccacactcagaacttaactttcttctaaggagtccagcccagctctacattcttttgactcccaaagtggcttacagatgccctggtgtttttttttttaaatggagtctcgctctgtcgccaggctggagtgcagtggcatgatcttggctcactgcaacctctgcctcctgggttcaagagattctcctgcctcagcctcccgagtagctgggactacaggtgcccaccaccatgcccagttaatttttttacttttagtagagatggggtttcaccatgttggtcgggatggtctcgatctcttgacctcatgatctgcccgccttggcctcccaaagtgctggcattacaggcgtgagcactgcgcccggccaggtgccctggttttttttttttttttttttttcagatggagtctcactctgttgcccaggctggagtgcagtggtgcaatctcggctcacagcaacctctgcctcctgggttcaagcgattctcctgcctcagcttcctgagtagctgggactgcaggcgcgtgccactatgcccagctaatttttgtatttttagtagagacagcgttcaccattttggccaggatggttttgatctcttgacctcgtgatctgcccgcctcggcctcccaaagtgctaggattacaggcgtgagccaccgtgcccagcccaggtgccctggttttaacccttaacaaaggatgactgaggagagcagggtgtgggtagaggctgggtatgggtggctggggtagggtggagcgcacacgactttccccggcctgtggccaccctggctacctgctggaaggccagagtggactcatccccgtactggcgtgtgaagtagtcgtacatgccaaagtctgtctggcggcccagctggtcccgggaggtgcagtcggggatgcactcgatcaccccgcactaggaggaaaggccagttctgaggcccgccgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagtagctcttctggctcatgcagggcaaaagccgagaacccagagatggagtgaggtggggagaccacagccgagcaagagtctggaaggccttcctttctgaccaccgggggctggactcaggctgctgggaccaccaggccctgggctgagcatgaggctgagctgtctggtggggtgtgtgagataaggcacccaacccctggacagttccctcaggtgggcactggcatggcagggacagtgggaaaggggctggaaggagaggcctctgggttttgcagaagccctaatttaccccgtggcacctgaaccatgtaagagaaggaaaagattcacatttctgcatatgagattggactctggtgggcctggagccttggggagcagcaagcccagtccccaagcctacttgaggcctgaccctgcttacctgccggcagtcgtctcccagtttgaagatggctgcctgccaggagatcttctggccgtcggcctcctgcgtgctgcactcatcctcagagtctgagcggcaccgcagacctgcccgcagggagagaggccactgttagcctgtaggcagtgagaagccctctgagggggccagggatgagtcctctcacatgcctgaaaggaaccccagcaatcttggggatcacttcttcaaaaccccaaggaggccaaggaggagcccagcagggcccaaggaaagccttggaacagcaggtggaatccagggttggagtctaagaacatttaggcttaaatggaactaaaaacagagccccatttcatctgcagtgaagacccaggtgtgcctgagtcagtgttgggtgctgtgagctggggggcaggaggaatgtgtctgtacactggggtcctgggagggctcggggccagtgtgcagacatggccatgggaggcaggtccctgcaaggggtggcagccccctctccacagctggccacaccgtctgtactgggttgaagagtgtctccctaaaattcatgttcaccccaaaccttagaatgtgtccttatttggaaacagggtctttgcagatgtaattaggttaagacaaggtcacagtggattaggacagtccctaatccaatgactgatgtccttcaagggagatcatcatgtgaagagggaggcggagatgggagtggagcatctgcaggccaaggtgagcccaggactgctggcaacaccaccagaagctgaggaggcaaggtgtgacctgcccagagccttcagagggggcacgaccctgatgatggactccagcctccagaactgagatcgtccgtacagtagccccaggaaactaacaccccccaacggccccgggcccctcagcctcaggaaggagcctgctggagcatgccagctgactcatggcagacagacctctggggtggcacatctgtcagtgcatttgagctccctgccatcccctagcgaggggtctgactgagggcagacagatggacagacatcatcttttatggagagctgtactaaatttaacacatgccagaagaaactggcattagcaaggaaaagcactgagctcccaaacaaaatcagggttctttactgaccttctttttcaagttcactaactccacatcgcttcaccttgaacttggccagatatggggcttttgcagcactgaaaacaacaaaaagaatgtggcacccatgatgcagccgagaaaaacttcacacgcggacgctgtggaagcgggggatgggtagggtgaggcgctcacctctacatcggggtcccagacttgtagtcgacgtccagcacaatggcttcagggttgctgggcagggagcagcctgtgcagggacagaggcagtcacagggagtgcatgtgtcaccacaggtgagccagagtcagtttccaacacggatgttacgtgcgtgtccaccctgcaggcacaccccacccctgtggaggggcctctggtccttgtccagggcaccactaacttattattctgtggccgctaagggtccgtcctccttgactcttcgactcttccaaccatcgaccaaatgagtctgcaccttctgggaaatgctcttcctagaggagcactgagccccatcctcacggatacagccctactgcttctgggggtgtgtgtgaggcctgtcctgcctccacctgcctgagcaacagcctctgaacagccctccattcttggagtccctgtttttttttttttttttttttttttggatagagtctcactctatcacccaggctggagtgcagtggtgcgatcttggctcactgcaacctccgcctcccaggttcaagcaattcttctgcctcagcctcctgagtagctgggattataggtgcctgccaccatgcctggctaatttttatatttttagtagagatggagtttcgccatgttggccaggctggtctcaaactcctgacctcaagtgatccacccgtcttggtctcccaagtgctgggattacaggtgtgagccaccacgcccggccttccttacccatttgaacactactctctcaaaagccttacttaaatgtcactatgtccatgaactgtccttggttctcccagcctttaggacttttgtctaacacgtttctttttttctttttctttttgagacggagtcctactctgtcgcccaggctggagtgcagtggctcggtctcggctcactgcaacctacgcctcccaggttcaagcgattctcctgcctcagcctcccgagtagctggaattacaggcgcccgccaccgcgcctggctaatttgtgtacttttagttgagatggggtttcaccaagttggccaggctggtctggaactccttacctcaggtgatccacccgccttggcctcccaaagtgctgggattaaggcatgagccaccgtgccaggccaacattgtttctttatgcttattttatatctctgtgagttcaagcttcttcagctcagggaccatgtcttactcatctttttaacagccacaatacccaatgtcatgccttttcttttcttgtttttgcttttttgagacagagtctcactctgtcacccaggctggagttcagtggtgcgatctcggctcactgcaacctccacctcctgggttcaagtgattcttgttctcagcctcccaagtagctgggattacaggcacgcgtcaccatgcctggttaattttttttttttgagaccgagtgtcgcactgtcatccaggctggagtgcagtggcgcaatcttggctcactgcaagctctgcctcccgggttcacgccattctcctgcctcagcctctcgagtagctgggactacaggcgcccgccaccacacccggctgattttttgtatttttggtagagacggggtttcaccgtgttagccaggatggtcttgatctcctgacctcaggtgatccacctgccttgacctcccaaagtgctgggattacaggcatgagccaccgcgcccggcccaggctcccctttctcagtgagtgctcagtaaatgtgtgaaataagaggacaagggaaagcctgtttctggccaaggaactgccagtccccaagggggatgtgtgctccttgagccctgagaggtgggctttgaggggagccaagcttggccttgctgtggggtacagggagaggggggcatgccatctcctcctcttcctcacctgcccttctgcctgctccaggctgtggctcacactcaggcccctctgtgctctcctgctagagccctgctggcttccctgacctctggggcaagactcagccaacacaatctagagccaggggctggggacttctgtgcatgccccctgcagtacaatgcttccagctctttttgcccctccccagcagttgtggccttcccaatgcgggaacagaggccctgcatacatgtcctgccctctctgggaagccgtgctgttgtgtgagctcaatacaatgtgttgggaagaaatggttaaaccggggtcctgcagggcactcaaggaccagccgctgtgaacatctgcacgggacagacagagtttggaagacaagtttgtgccaatagttagaaatgcagagagaggccgggcacagtggctcatgcctgtaatcctagcactttgggaggccgaggcgagaggatcacaaggtcaggagattgaggccatcctggctaacacggtgaaaccctgactctactaaaaatacaaaaaaattagccgggtgtggtggcgggcgcctgtagtcccagctactcgggaggctgaggcgacagagcaagactccatcgcaaaaaaaaaaaaaaagaaatggagagagagctgcccagtgaagtctggatttccatcttctcttgaaaagctcggcttgaattcccatgtggccacagccacaggcacccaggagcgacttcccatggaggcggtgagggggtggtgctgatgggtcccagcacacctgagccctcccacactgggcccgccatccccttgtctgtgtgacctgctcctgtaatgctggagcctaggaaccctcttctagagtaacagctactgaggtcagtgtgagcctccagaaaaacagcaggcagcaaggaagatgaagggcacccactgacgagcagctcccgctcactagcggcagattttggggaggggctggggtcctggggcaccaggcaccgtgggcccaagcaggtgtggggctggccaagccactgtgtccacatcctgcagtgcctggagagggcagcagccttcacgccccgccgcccgcctgcaggaagaggttggtctgagcctccagaagccacctgctcacctggctgcaccgtcacttcagacagggccgacagacaagccttctttctctggtcgcctttagggtagggcctgagaaacaggaaagaaattcttgctttgtctcctggaggaactggctactgggggacagcccagggcccctcctgcctggattgccctctctgtccctctcttcccggctctagctgctcctagcgcagccaggcaccactggcagcgattcttgccctgcattcctcatggagaatccccgacagccccggaagggctgttttctggcaggctctgcccctgctgtgtgcgggggtgtgtggctgggggtggtgggggtaataatgcctgccacctgctgccacccaggaaacgctagctcccgtccttcatctcttgggttagaagctgccagcactgctattctcagcacccagcccagaaaagggcctcaaagtgaccaaggtcagagcagtgtacgcaatggagacagcccagccggcgtgcccagcattgatgactccagggtttcatcccttatgaatgcacaaagccaccaacatccaaggatggtgtcaggtccacatgaatggaaggtctaggaaaacgatgacaggagctgcaaaggcagtctggttttcctgacaccaagaggatcgatccttcagagtgtggagagggcagggtgacctcaaattgtggagccatgtgctaaattccacaaatctcaggaatgaaactaagctgtgtttcctgaaactggcgtggccgtgcattctgccataccttcaagagccctgactcaccccaagcagtgcttccccacccaccctggctgtccatcagaaccaccagcagccccgctgctagagactctcattcatctggttggggccacgcacgggtatttttaaagcttcccaggcaattctgttaagctgcagggactggaacaagattccagaaggtggtttccgaagcactgcacttacttgatgacagccgacacgttggtgatcttgttaaagaaatcaaactcccgctggtaaaagtccttcgctgggcccgacaaggagcctgtgttctcctctactaactgctcccggaggtcgccgatgtcagctgccaaggaaacaaagaggctgagtctctgtggctgtggcagaggcccctcaggaataccagccctgtttcccaggccccagactggcggtgcccagagtatgctctgcaggcttggtgagaccataacagctgctgtgtgccccttttgctgtgttgacacagccgacactgctgggaagctaagctggtgcctaagcggagctcaaggtaggggccaagcgcacaagtggacgtggaatcctcactgctgcacacgctacacacgcaggaagaaaaaagcccgtgtcatttatgaatgtcacagggcatagaatcctcactgctgcacacgcagggagaaaaaagcccgtgtcatttatgaatgtcacaggtgaagcaatgaaaactaattcttattaaactctaccctgaatacatgtctttttttttttttttaatagaggcacacagtgggcggggctctatattaaatagtgtctctcactattcaaatcccaggctgaatttaaattcctgggctcaagagatcctcctgtctcagtcacctgagttgctgggactacagctagtaggtgggactacaggtgcgcatcaccacatctggcttttaaagtatcctttgtgatgaaacgggatgtgcacgaagcactcttgccgcatctaaggcaggcgctgtcctgagaagcacctggagcttgtctgattttggagcctggactaacctttttcacagacctttgtttttacttgaagaaatgactgacagacaacatatagctattcagacttagggatgtggcagatgttttcctgaaaatgaacaaaaaataaatcttccactcaaaggaactgaaacatttttttggaaaacttggatctgctgctgtgagctcaatagcttcccttaaaaactctttctgggccgggcgcggtggctcatgcctgtaatctcagcacttcaggaggctgaggcgggcggatcagaaggtctcagccaggcaatgtggcccacacctgtaatcccagcactttaggaggccgaggtgggcggatcagaaggtctcagccaggcaatgtggcccacacctgtaatcccagcactttaggaggctgaggcgggcggatcagaaggtcaggagtttgagaccagcctggccaacatggtgaagccccgtctctactaaaaaataaaaaaattggccgggcacggtggctcatgcctgtaatcctggcaatttgggaggctgaggtgggcggatcacgaggtcaggagattgagaccatcctggctaacacagtgaaaccccatctctactaaaaatacaaaaaattagccgggtgtggtagcgagcgcctgtagtctcagctactcgggaggctgaagcaggagaatggtgtgaacccgggaggcggagcttgcagtgagcggagactgcgccactgcattccagcctgggcgacagagcgagactccgtctcaaaaaaaaaaaatttaaaaaaaagtccgggtgcggtggctcacgcctgtaataccagcactttgggaggccaaggcgggcggatcacgaggtcaggaggtcgagaccatcctggctaacacggtgaaaccccgtctctactaaaaaaatacaaaaaattaggcgggcgtggtggcgggcgcctgtagtcccagctacttgggaggctgaggcaggagaatggcatgtacccgggaggcagaggttgcagtgagccgagattgtgccactgcactccagcctgggcgacagagtgagactgtctctcaaaaaaaaaagaaagccctctctcgtctctcagtctgtgcttagtaatcagctaggcgctgagagaacagggcatggcctccttacagaggtttgctgcttctttgcgtggcatgttttcatttggcattcccttccctggaatgctctgccctgtccaccctgcatgccggtgcagcctttcagactcagctcaactgtctcttttccagaaaaccatctctgattccccaactctggatgggccaagtgtctgtaccggaggactgctcccacagttccctcaaattgaaatcacctgtccatttgactgcctcctacaagacaacaacagaccataccccagtcatgtaggtgtgcaccagcctcagcccaatcctgggccgtcagctgctcagaggggtgtgtgaacgcagctggtgccagtgcagggaaagtgcggtgagtggagtctgctcagctgcctcgggtgcgtgtttatgcttctcagctcaggccagaggagaagcagagccaggcatgcaccggcctccaatgaccgtgcaacacagtcaaggccagggctcaggggggtctaactgcttttccgtccctacctctggcaccctcagggctgcccacgttgcacccctgtcctgcctgcctccaccatgagcagctgcactgttgagggttacctgggggaacaagctggctggcggtcaggtacttcttatctgagaacatggcggtccaaaatttaatcatgatgcttatgtcttcacgcagccgcttctctccttgagtaggaaactttgggggacagcttcaaacaaccataagaggacaacggctgagtgtctggagtcagggactagaggccagtcacacaaagcagtgagaaggtgatgcagacaatttcttaatgacaaaaggtcagcccaaagccagtcattagcaaggatgatctggcccattcccatgggaaggtgtggtggctcgggagccctcttatgccctcctccctcactgcccacagcagcccctacagctttccactgaagctgcacttgtggcagatcagggcaaggaagctgcactcacacaacagcacagcctatgggtgcagagccccaggcagtgggtgtttgcaattcttcgtgcaataagccttcacattaacagggaaattaaatggacgcacttaatctcctaaatcagttgaactgagggaaaatttgcctacatctcgctgggaggctagctctaagtacacgggacacatgcacagggctgaagggtatttaaatccacagggccagggatactgaaggaggaggttggtgagcacaactgggcaactgtgtattcctgtgagtgacttcctgggggtctggggcgatggagcacttggaggggctgggccgtccctggatgccgcacagcacatcttgggggagtacctgaagtagtcaaaggcagtggagtagatcttctcgcgaagcacattgcggatggttgcatttggaaccacatcggcatgcaggagggacagccccagggtcagcagcctgtgagggagccccggacccggtcagagcaggagcctggcctggggccaagttcaccttatggactctcttccctgcccttccaggagcagctcactgaaatgtgttccccgtctacagaagtaccgtgatacacagacgccccatgacacactgtacacaccaggggccctgtgctccccaggaagagggccctcacttgaagcggggcccgatggccgccacatgccggttcatgctccccttggccccaccgatgttcagggacatggagcgctgcagcaggctggagaagatctccacttggtcagagctgcagtacttggcgatctcaaaccgctgcaccaggaactgagcgaaaagaggaagacgctgtggtggtggggctgagccgggctaaccctggggccggcagagacagctgaggaggggttctgggctgactggccgagcttgccgaaggccttgggctcggctacccccaccccaggaacagtcctggccccccaggtggagcaccccacagccttggtcggggaacaggcacgtacgtcgatccagatgtagtggggggtcacttcggggggacagggtttgggttgacttgcttccgaggcagccagggggtctgcttcctttatctcagcagaaaacaggccaaatttctgctccactgtcatgtgccagcccctgccatctcccgcatgaac

SEQ ID NO: 544 - DNA, 5793 bp, Homo sapiens
ttcttttttaagatgtagacttttcttgagactttcgtacaaggcaatggacagataaccttaacctcccagagaaaacacacattggccacagaaaaaggcgcttctccgtatacctgccatagttatcagcaactttgaaatggcttctcagactctcaggggttggcttgttgtgtttgcttttgcaaataactcaggcttaagtcctgctactttcagagcctaggggacgcttaaggactaccatcagtttaacacagtggcacttggagcacatgctacttatggtggtgaggaggggtgctggtgtgagggtctgaacgcttgcttctcctctggcagggtgtgagcagccagaggccactacctgggcaaggatgcttgctcagtgtccatggagggacatgtgatccagcaggtgggcaggaaccaggcccctgtggccgcccaactctccataatagaatccttggtcatccatgggcccgtaaaccatgaccacgtctcctgccctcagcgccagcctgcccttcccctggccccccatttgcccatccccaggatcatagtccagagctgctatcatgatctttggagtccacagtgggagtctcttggagttcccctggagcaccagggaggaaccctgggggatggtgagcccctgaaagtcctcgaggtgggccacagaaggcaggttcccttgggccggagaacgccacctcctatcagtctgctctgtccccacctccatctcagccactaggcgcccggggatattgcccacttgcctgttgcactcgctgaggtagaaatcatgggtgtcctgagagccccacactcttagcaactgccttttctggaagaccagctcctcctctgcagccttgaggttggcagacatcaccagggggttgtaatcagagagggccacaaagaccctggctggagtgttggcccccgtccccagctgttgggggccacccctgggcatcttgatgactttggcggatggagctggacacagtgccgagctgggctcatggagctggcaccctctcttcacccccagagcttgtccttgcctgctgtggggctcaggctccctcctctcctctcgcctctctgtgccccacagatccaagcacagtgcctcctgctcctccttcaaaacgttatggaagtcagatgcatactgttggctggcgcccagctggggaggtgtgaacccttgggcatcttgcttttgccgaagtaccctctcaagggcagccttttcctgacacggttctttcctgggcccacactcggtgcgtagatggatgaatcctggagcagggcttttgctggtgcccatgtgctgggagcaattttccttctccccaggctggtcactgactgaaggtggcctgtggttctggggactcttctgaaagagcaggtcctttctacagccctcccaggcctctgcaagctcctgggcttggctgccagcccctgaactcggacattctccttctgagcccaggttggacactggggattgcctccttgggggttcttcaaagaatgcttctaggaacttggcctggggctccccgcagcttccagggttgtgggggctggccttggcactcggaggagccagtgacagcttctgggggcagacggggaaggtgactctgtaggtggatgggtcgccacaagtgtagctaaagggtggagtctctggccatcggtgacacatgaagaagtcctcggggatctgagcaggcactgaatccagggactcaccacagagtgacatggttctcactgagaccttctgccacgtgaggggcacctgtagctgggagaattccaatagggtgctcccagcagtggcatcggcgacctcacaaaccttaagcccatctgcatacacagcataaccggtgacctggactccattggaggacccagctgagtcaatggtcacagggagccagctgaccaccaggacacctggcgaggcatggcgctccaccagcacatccagcggtgggtagggaggtcctgccaagagtgtgtcgaaggtgacggtggaggacatagttccccaatacacctgcagcaagtcccgtggcagccgcacctccacccgcgcccggtagtgcgtgccggggcacaggccctggaaggtgtagcagctcacgcccgctggggtcagggcatgctctcggtcatcaagatataccacatgggggtggcggtggctgctgtagacccaggtgatgttggctgatgtggctgtgacattctgcaggtgtagctgcatgggagccatacggagcacccctttggtccccagaaggggtctggagaggccctgcttccccatgctctgcagcaagcccagctggcaggcttccgtcttggtatccaggatctctgttgctacttctgtcttggagcccaccctgaccatctggcacagccctctgtccaccactccctgggctttcccagataataagctgtcttcctccagagcttcatcctgccccgctgggagttgactggggccaagatcaggggatttggcaggcaggcagcctgggatgtagctgtccggaatctgctccacgaagttggagggcaccagcccccgccggccatcctcaagctccccctcatagaagccatcctcatccatgtccccgaagatatatatgtagtccccagctgtgaggggcagctcaccctcagggtgatcattgggcccctcaaatgggttgtagttatactgagccatgaagatcttgagcttgggggcagcaggagccgccgagccccccatttccagggccagggacacgctgtcaggctccaggtcatccacctcactggctgtgtccctgtccagagtaggggaggacggcacggtggcccacatcgacccctcagaggaggagtttgactgggagctggttttcttggacagaggttggctggcagggactgtctctgaaacttgggggacactggctgactccccaagggcaactgggctctcctcgagggaggcttcccttttctcctgtatgtctctgttgggctgtgacactgcgtagtcttcaggccgtgcgtggaacttgggccttctgctacctttaacttgggactccggcatttgactggtctcccagggctgttcaggagggtgaccaggccgacactggagcgcctgtatctccttccaggaaggatggaggtcacacagggccttctgcgggtcgcgttgcagctgctgctgcctgtcctgcccgcgcgccgcctgctgcagcagctgttcggcgatcaagccggaggcatcgcgctcttgacacgcgcggcccaggtggccgcgcacttcgctattctcagcctccaccttccgcacccagtcggtcttggcctgcagccgcccattctcctccgccagccaggcgtttttgagcagcgccgcctgcagctgtgtctcggcctcctcgccacgtcgccgcgccggggccgcctgcgcgcccagctcctggcactcgcgccgccgctggtccagctcgcgctccagcgccagcatctgccgtcgcacctcctcgcaggttgcgctctggccgcccgcctcgggccaagcgccaccgttgccctgctgaagcatcaactgcctctgcaggcgcagcacttcccgctgggactcgcgctgcaggcggtctaagtctctgacgttgagccactgggtgcaggggccgccccttccagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctcgccgggtataggcgcgctcacggcccggaggttggtctcctgcagcttgcgggcgcggtcagctaggcgccgcgcgagcccggtcagctccgcgcgctttaccttgagccgcttcaccttctcgtctgcctggtaggggcagcctgcacgccgcagctgcttgttctccgcttgcagggtataacagcggcgcgccagcacccacaacgccttggccagcagccagttcagctttatcagctcgtggtggcccaggcccgggggtgagggagtcaggacttcgcagggctggctctcagagccttctcctccccgcgggttgctgagtttcctgtgggctgacggtggtggtggcggcgggagtggcgatggtggcggcgagagcctccgggagccaggggtggaggtgtctggtgaggagggccgctcctcggatttggaggccttggggaggctccgggtgctgtcaagcgagcgggaacacgcaggtgcgaagcaatcaagggagctggcgtgcgtggagagcaggccgtctggggagctggagcacgcagaggacaccaggcctagcgagcgggagcgcacaccgacttcagcactcaggctgtctagagatccgagttggcaggcgggtttgggggcgtggcaagagccgctggaggtctggggcagcggttcttccaaggaatgcacagcttgggggtccggtgatcccgacaaagccgggtgcccgcggaagtgcgccaggatgtacttgaggaagagctggcgctccacctccagcgccgcctgcagatagcggatgcgcgccgcctgctcgccgtcagtctgccagcgaagctgcgccaacacttcctgcaggcgacagcggcactgcgccgcggaaacctcggacgcccccgggcggctacagtggccgcggttcaccagctcctcggccagctggcgctgcagctcccgggcttggcgcaccacgccatcgcgctcccggtgcagcagctgctgcagctgccgctgctcggcctccttccagcgcagcagctgccggatctcggcctcgcgttcccgctgcatctcctcttgcagctgccgcaactcccggctgcgctgtgcctcccacttggagcgcagacggtcagccagctgtcgccgctcccgctcggcctcctcacgcagctggcgctcccgggcagcgaagcgccgccgttccgcccgccagcctgcccgctccgcctccagctccgcccgtagcttctccagctcccgcctctggttctccagcactgccgccgccgggctggagcagcccggcttcttgggcgacgcgcccaaggggctgggcgagtccttggccattgcggccgcggcccggctggtctccagacttcgcctggcaggcctcagctcgccaacggccgccgccgaccgcccggcgcgccccttccggcgccccctgggggtctccgcgtgccccttccgcctcttggcatgttcccccgcctcctgccgcggatgtctggcccaggcgcctctccacctggcaaggccagggctggactcccacacccctgctcaaactggcccatgtcccttccaggatgcacgggggcttttccggtccctacacttttcctgcttctagcaccaagtcccttgtgaccctccccaggcaccctcccaggcactgtgcagtcccaagcaggccgcggtgccccgagggaagtctgggctgctgctcctgtacttggagaaaggggcagggtgtgtgtgttaaggccacccatggggtgtgggcatacctggtcgtgggttcaggtggtgtatttgggtcaggtggctgg

SEQ ID NO: 545 - DNA, 14349 bp, Homo sapiens
gtagtttgcgcctatttcgcgcaggcgcgctttcccgcagcggccgcctgctgctctttgtggcagtcgcagtccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatctttttttttttttttaaatggaatctcactctgtcacccaggcgggagtggtgcaatggcttgatctccgctcactgcaacctctgcttcccgggttcaaactattctcccgcctcaacctcccaagtagttgggattgcaggcgcgcgccaccacgcccggctaatgtttgtatttttagtagagacggggttttgccatgtttcccaggctggtcttaagctcaagcgatccgcccgcctcggcctcccaaagtgctgggattacaggcgtgagccatcgctcctggcctcctgcttctttcttccccgcgcccaatcatttgttcccactcagacgtgcttgattgggggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggtgagtggctgtgtgttcttccttctttatgaagagggttggcacattccctccccagccctggatcgtcagccttccacagaccttcacccgggtacctgctggccagtcctcaggaagctctgggcagtgggaacagctccaagtgaagagtccagatgttgcccgaggtgtgccctcgagatgtgctctattgaatgtctcgcccagtccaattcagtgggtcagttgctggggatctctctgcccagcgctgtgctgggagctctgaggagtggttttagtggaatctgagaaagtagttgacggctcacatggggtcgctttgcctatccacgtgctggccaggggttggtgcaggatgtttgcacggttggtttactgggactggaatcagacaggggcacgtggagcagctcaggaagggctggattgcagcacttggttaagagtggcggtaggggacacatccctgtgtgctttcctctgtacccagcccctggcatggggccttcatggagagtcctggagatttagagaatctgggggctcagcaaggaattggccctgggaacttctgcagccaaatgggacccagatccctccttttacagactgtgaactctgttcctcattttgtttttctaccgcaaccacctcaccccatggttgtatttagaagggtgcagttgacaaagagagcacagtagagtgaaagatgtggaggaataaggggtctttgggtttttgttttttttttagcattttgtgattttgtcagtctgccactcaaaagaggtgatggcagattatagccagctagaaacagctgcaaaacgtgtattgtgagctgtgcctcacttctgtagtgtgtcacaatgctttatagtcctcaagaaacttgacagtcaaatgcaatgcatgttccttgcttaggggatagatccaaaaaaattgataaagggcagtttgggacaagaggaaatttgaaaatgggctgtatcttaggtcatattgtatcaatatgaaatttattgcatgtgataatagtactgtgattatgtaagagaatatccacaggagatacaagctgaagactgtagagtgagacatcatgatgtctgcaacttaccttcaaatggttcagcaaaaaaaaatgtgtgtgcatgtatgtatgtctgtatgtgtctgtgcagctccgtctaggtggtagggccctcatgcatgtgttattcctattcctaaaatattagcttgttagatctttgaataaccagttgactctcctgagtacacatcagctttggcattttctcttgacagtctcattctcactcacagttcaagttgttctgtctcctgggacatcttgtgtggtctgttctgacttctctgctagtgtcattaccacatcagcatctgattccaatgcatactgtctgggttttttattcctttccctgcagaatgatgacacattagacatggacttctcccagtggccagaaatacccatcaaaaaggcctgtgcgggcctcagaccctaccctactcttgctggttttgctccccacactgaagccatgtagcctctgacagcctcactggccaacaccatattctgatacctgtggagctatttttttgtttttctttctttttctttttttttttttgagacagagtcttgctctgtcgcccaggctggagtgcagtggcacaatcatagctcactgcagccttcaactcctgggctcaagcaaatcccccacctcggcctcctaagtagttgggaccaacgtgtgtgcccccacacctggcttggagccttgtttcagcccattttctccttccctcggctatcgtcatccttcatgcctgcatgcctcagttaggggtgtgttctcagcatttgtcctcatctctacctcctcatctgaaatccagtgttttggggggtaaggttttattgaggtgtaatttatatacagcacagttgtacaattttaagtatacaatttgatgaggttgagcaaacgtatacagttgtgtaaccagcaccacaatcatgatatgggacgtttccatgacccaaaaatgtcctcatgcccctgtgcattcagtggtctcccctctccccttggtaaccactatagttttgctgtagattttcctctttaaggatttcatatggaatttatattatgtggtcttttgtctctgctttatttcgcttagcatatgcttttgagtttatccatattgttgtgtgaatcagtagtttgttcctttttattggtgagtaatattccatttgtattagtctgctagggttgccatacaaagtatggcaggagggcttaaatgacagaaatgtatttcctcacagttccagaggcaagaaatctgaaatcaaggtgtcagcagggttgatttcttctgaggcttctccttggcttgtagatggccaccttttccccgcatcttcacatggtcttacctcttctatgtctgtgtccaaatttcctcttcttatgaggacaccagttatattggatcaaggcccactgcattgaattcattttaactgaattacttctttaaagaacctctctccaggccgggtgcagtggctcacgcctgtaaccccagcattttgggaggctgaggtgggtggaacacttgaggtcaggagttcaagaccagccggccaacatggtgaaaccctgtctctactaaaaatacaaaaatttagctgggcgttagttctcgcctgtagtcctagctactcaggaggctgaggcaggagaatctcttgaacccaggaggcagaggttgcagtgagctgagattgcaccactgtactccagcctgggtgacagagtgagaccatgtctcaaaaaaaaaaaaaaaaaaaaaaaacctctctcggagttaccaagcattgagacataagaatttgaggtgaggggtatacatttcatcccattgctccattggatggagcaaactgctccgcagtttgcttatccattcaccagccgatggacatttaggttactcataggcttttgctattacaaataaacccgctataaatatttgagtacacgtatggctgtgcattttaatttctcttgcataaatacctaggtgtgaaattgctgagccatatagtaaatatatgtttgtcaattttattgatcttttcaaaaaacaatttttttgttttattgatttttctctattttctgttttccatttcagagatttctgatccttattatctccttggtgtcttaagattgaaacttactttacttactttagtgtcttaagattgaaacatagatattgatttgataccttttttcctcatatagcattcagcgttgtaaatttctaagcactgcctcaactatatcctacaacttttgttatgtcacattttcacttttattcagctcaaaatagcttctaatttccctagtgatgtattcttcagccatatgttatttcagaatgtgttgtttcatttcctaatatttagggcattttccagataactttctattatggatttctgatttaattctattgtcatcaaagaatgaactttgtgtgatttaaagtctttcaagtctaccaagatttattttatttcccagagtgtggtttatcttggtaaatgttccacatgcccttgaaaaaatatgtattatgcctttgttggttagagtgttatgtaaatatcagttaagtcaagttgaatgatggtgttttttaattgttctgtcagtttttgcattatgtattttgaagctcttttagtagatacatttatatttaggattgctatgagttcttaatgaattaactgttttatcattatgtaatattctctttgtctctgatagtcctctctctgaaatctactttgctattactataggcacttgagctttttttttttaaattagtatttgcagggtttatctttttctatcctatcacttttaacctatctttgtatgtaaagtgggtttctgtagcttgctttttgaattcagtttgacaatctccaccttttaattggagtgtttaaactattcgcatttagtgtaattattaatatggttggatttacatgtcctttttttttttttcttttgacagagtttggctcttgtcacccaggctggagtgcagtggcgcaatcttggctcactgcaacctccacctcttgggttcaagcaattctcctgacctcaggtgatctgccaccttggcctcccaagtgctgggattataggcgtgagccaccccacccggccttgctattagttttctatgtcttatgtcttttttgtttctcatttcctcccttaatgacttcttttgaggtaaacacatactgttctaatatactcttaattcctctgatttcattaatatttttcaccttttagttatttgattggatgctggacattgtgaattttactttgttgagtaggtttttggaattccttgtttctgggatttgttctgggatgcagtgaaattacttggcatctatttgatcctttcaaggatcaaagcaagtctggagttgggtggtggccaggatgcccaggcccagggggagcaggcaggaaggattggaaggcagtcaggtgaggactgcaggtagcctctcttagtcccttggggcacagaacttgctgatatatacaaggtttccttccttagagtgtaataacagtttctagtctgggatcggatccttttgcgttactgagctttgaatagagttgctgggatttttgtactattaatattctctcaaatttttaagtttgaaattcttgactccaggaagcatagcatctcacccaggacttagagcctgatacaacagccatgtacagcccctgggtcccaccgcaagttgccagggccctgtggtgtctattcagacctgctttcccaatctagaaggtggtgtgggaatgcatgccaattcccagcccccctccctgcccctggtccccgaattcagtcatggtcagtgtctacagcacaaccttctggcatgggagaaggtcacctgaggttaaccctttacttgtagggtccttaatcaatctctggctcctttggaaccatggacacagaatcagtcctgggtgagaacctatatgtcatttcaggaatcggtgagtttcaaggatgtggctgtggacttcacccaggaggagtggggtcaactagactcccctcagagggccttgtaccgggatgtgatgttggagaactaccagaaccttcttgccctaggtaaaatccccccagccccaggctgggcgtcggctgtcagccttcttctacatggtagatattaaggagaatcccttcagtgccggccctggtgccagatatatcatggggtgggaagcaaggcctgtgccttggggcactcatggccaggggcctcggccacgccagaagtccccaagggacagcgtgggagctggtagcatccttgcttggtgtttcccctggtcctgggataggggcagggagagaagagaagaaggtgggaccctggagcccagctggctctggaacagtcctcaagcaatgaagtaaggacgtcagcacacgtggggtcttcagagtatacactgggatttgggttccagtctgagaccctcactgcttttggcccagaggacctcctgttcccagagagggtgtccacttcacaggcattgtccttgttagggggcggcctgtaaggtcgactgggcctggagagctgcagcatgcccagcccactttctctccacgagcaggacctccactgcacaagccagatgtgatctctcatctggaacgaggcgaggagccatggagcatgcagagggaagtccccagagggccctgtccaggtgagcagaggcacaggtggaagggtgccagccccagcacccctggtggcacctcctcctatggcccctattttcctccctcagtttgccccggctccatctccccttttcaggtcccccgccagaccctcctgcctgcctcccttcagcacgtactgagcactgcctgtgtgctgagacctgttctgggatacaacagggaacaaacctggccactgggaccaaatggtcacctgctgatggggatggggaggcaggaatagaaatattgagccattggtgttggctgggcagccgggggtgtgggattgggggcagggggccaccagggaaggggcagctggcgttggtcagtgtcagggtcagcatgagcatcagcatcagggccagcgtcagcgtcagggtcagagccagcatcagtgtcagggccagcgtgagcatcagcatcagggccagtgtgagcatcagtgtcagggccatcatcagcgtcagggtcagagtcagcatcagcattagggtcagcatcagcgtcagggtcagggtcaacgtcagcgagggcttccaggctgtggccaagatggcagccctccgtaagggaaaggggactggggtgggtgttgagcagaaggtagtctgcttttcttctccaacattctttttgtagacttctcttctgagttggttgataaataagtggtaaattcggcttaatttattggacagtgactgctgagcatgttaggtgtctagaaagctcgagaaacacctttctgtgggaaaggcagccgataagctgtggagcacagaacacgggggtcggggaaggcagcccctcctccatccccctccactgccacataccacccagccccaacctgcaacagtggctgcagccccagctttctggtctttatttctcaccccagcctctgatgcttgctttgtcctctttaacaagattacaggtttcaaaaaattcatatttttgtttgattcatatatgaatatactgaaaatgaggctgaaaggttactgaaatcctgcataatctttccacccagagatgacggttctctaataactgaccatgtcactgattcctctgggcccttcctctgtgtgcggatagacttctaaagctacatgtggccaggcgtgatggctcacacctgtaatcccaacactttgggaggccgaggcaggcagatcacctgaggtcaggagttcgagaccagcctgaccaacatagagaaaccctgtctctactaaaattacaaaattagctgggcatggtggtgcatgcctgtaatcccagctacttgggaggctgaggcaggagaatcgcttgaacccaggaggcagaggttgcggtgagctgagatcgtgccattgcactccagtctgggtaacaagagtgaaattccatctcaaaaaaaaaaaaaaaaaaaaattagctgggcgtggtggtgagcacctgtaatcccagctactctggaggcttaggcaggagaattgcttgaacccgggaggcagaggttgcagtgagccatgatcgcaccattgcactccagcctgtgtgacagagctaaactccatctcaaacaaataaataaataaagccttatgcaccctcggaagcacagcactcacgccggagtctggctaccacactggccatggcatagtgagcgtcctcacgtgatgtttactgattgcacagtatcccttagatgaatgtgccctgctgtgttgttggccctattgctgccaaaacaacttttttctggcctgggcctcttctctctgctctgtgcaacttccctagactcttacctctcacttggtgtggatgtggtctacactatagcaacaccagctgagctgcagccctgtgtcactgaccatctcgtgggcctctgcttgcatgtctaaaaccagacttggaactggcccttcctcctcctttataaaagcttccaccatccacccaggcttgggtgtttgctgaggtctcatcctctcccccatttcctctcttgccaccttcagtcaacagctagggccatcagttttagcacctaaatggctcttagatctgctgcttcctgttcattttcacagccttggttccagtctgaagttgccatttttcacctgaattattcagatggcctccctaactggcctccctaactgctggctccaaccaccttacacaccaccaaagccaccttcaagacaaaccattatgccaggcacagggactcacacatctaatcccagcactttgggaggccaaggcaggaggaccacttgagcccaggagttggaggctgcagcgagctgtgattgcacccctgcactgcagcctggacaacagagcgagactgtgtccccgccctctgcttcccccgccccccgtcaagacaccatatgatcacatcaccctctgtgcaaaaggcctttcttccccggctgccctctgagtcaggcatctggtcacctcgaacccatccaccttgccagggtcacctctcagccttcctgcctctgcgtgtcttgtcttcatcttactgtctcacctctgagcttctgcacatgctgttcactctccacctggctacctgccatgtgtgccatggccagttccacttgccctgctcttctgcatgtgttggggccacaggcagcaccaccatgcagctctgcccgctgcactagactgctcccttttaagcctggggaggacagaattagaaataaaatctcctgccagctcagaaaaccttgctatagagatagaaaagaaagaaagccttcttattgaataagtgtttaaccagatgtggtgtacaggagagaaagaaacctccccctttgacagaggagacacatccaacccagcacacagggcaactgtcttcacctaaaggaagagtacagctttttgggttttgtttgtttgtttgttttttgagacagggtatccctctattgcccaggctggggtgcggttgcatgatcatagctcgaagcctcaacctccctaggctcaggtgatcctcccacctcagcctcctgagtagctgggactatagacaggtaccatcattcctggctaattttgtattttttgtagaggggtctcactgtgttacccaggctggtcttgatctgggctcaagtgatccgccaccttgacctcccaaagtgctgggattacaggtatgagccaccgcgcccagcctcttgtagctttttgacaagcaggaagttacatcttggactcgactcttggactaggctcattttgcttctgaaaaggtttgcatgcgtctcgagacagagaaagcatttgcaattcccagtgttctaaagggaagcgctggggtgtggggagcccttttttccttttggcaccacagacaatttttaattcatttgttagtcctagctactcgggaggctgaggccggagaatggcgtgaacctgggaggcggagcttgcagtgagccgagatcgcgccactgcactccggcctgggcgacagagcgagactcggtctcaaaacaaacaaacaaacaaaaaacatgtatttgtcctgtgtattgcgagcacctgccatggtattgatacagagcagtcggtcagccgacgtgtccgtgaatgagtgtaatcctcatcaacagctcccaagcttgcccctttctcagcccccttggtgcttgtagctgttccttccgggattcctttggcttctccgcctctcccggtctttgctctctggtagctccttccgtgttcttcctctcccttcttcccgctcttgcttgcccatctcatcctgggcgctcccttctctctgcctgcaccttccagccttggccctggtggcctctcctctcttttctgggcttatctgcatctccaggccaattctcaaatctgaattctaggccaggtttccgcttgctcacagaaaatcattttcaatatcttacagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacattac

SEQ ID NO: 546 - DNA, 14349 bp, Homo sapiens; identical to SEQ ID NO: 545

SEQ ID NO: 547 - DNA, 14349 bp, Homo sapiens; identical to SEQ ID NO: 545

SEQ ID NO: 548 - DNA, 14349 bp, Homo sapiens; identical to SEQ ID NO: 545

SEQ ID NO: 549 - DNA, 14349 bp, Homo sapiens; identical to SEQ ID NO: 545

SEQ ID NO: 550 - DNA, 13273 bp, Homo sapiens
tgaggggaaaggcattttattaagaaagctttggccaagcccccgccgggaggagcccatcctggggcaccggccgaggggggagcagccctgctgggggcctataaatacatctcctcaggccactagagtcgcccctggaggtcccgcggcgtgtggggcagtgggaggccatcaaaaccagctgacagctgaggggcctgggcccggggcgccagggaagggaaggggtgggacggactaagcccctgaggagcggagaccagccctcctccccaggctggggtcaaccagatgcccgggagcctggccagtggaagtagccccgggctctattgggacggccaagggagggagcctccagccagaggcaccaggccctagcgggggagaggcagcccgggcagaagtgcctctggctgcaaccaatgagaaggtagccctaaccaagtccactcctggccagtaagaggcggtctttaagcggaaccctcccatctttggccaatgagacgctgtctggtcggagcgctccataactcggccaatggggagggagtcgcccgctaagcgcctgtcaggcctcgaccaacgggatgggcccttcccgccagagcacactgctccaatccaggagcggctgcaggacctgagccaatgagacgcaacctccgctagccgcgcggtgcccggccaataggaggccgcccgtgcccggtagcgtgggaggtgtggggtggcgggcggcgctgcgaagctgagggagctgcgcgcggacgagccacagcctgctacagggtgggtgcgcccgccctgcccagctcgcccgccgcctcccggctcttcttgcgcggcggcttctggatgggggtcttcttccggggggtctcaggcgcgggcaagtcggtcgccgccttctcaggccccggggtttcggtcgctgggggcgcgcgggcgggcgaggctggcggcacggagcgcttggctttctgtgggggcgccggcttttccctggggccctgcgcgcccagggccacctcggcgcggcccaggctgcgagtcttgccgcgcacgtcagcggccaacatggaggcagcctcggcgcgcttcgcgggggaccgccggcgtccgtgggctccaagaggccggggcgcggcgcgcgctcgggccctgggcggcgagggcgcagcgagggctgtcgcctcctcgggcagccccggggggcgcggcgttgggtcgcgggtccgggggctgccgtgttcgaccgtatgcgccgatttgtcgctgggcgtccgtttcctcttgctggggctgggcgcggcctcggagcctggcggcggtggtgagggcgcacggccagctgcagcggcgctgtgcttgccgtggatccaggacaccttaggcttggtggcggggtcaggtggcggcggtttcctgcgctcgggcgatggcgacagcgacaggcccccaatctcgccccgggcccgggccggccgggcctcgcgtcgggccacgcgcgcgtacagagcccctccgggcccctccacgctggacgccgaccgctcgctgtcggaggacgcggggaggggtatcgcctcctcggcggaggctggcgtggtcaagggcacaggggacggcgccggcgcctcggcagggacagtggggacttcggggtcccggctctccgctggtgcctctggcaagggaagagcagggcggtcacagccttcaggaatacctttaggggctccaacctccaggcgcaaaccttcacctttcctcctctacccacgcccttggcactgtgtcaccctggcatctagacgtgcctggcacagagcaccaaccacacatgtgtacttcagagcctcaggctatgcggctgactctgaactcaggctgtgcaaggagtgatgggcgcattcccgcgactgaagcccaaccttggcctggcctggcagccctgccccaacacccctccagccttgggcgcctgcatcatcgaatttgaggctggaacatccccacaggggttccattatccttctttaagagagaaggcttctagctgggcgtggtggctcacgcctgtaatcccagcactttgggaggctgcggtcacctgaggtcaggagtttgagaccagcctggccaatatggtgaaaccctgtctctactaaaaatacaaaaattagctgggcgtggtcgtgggcgcctgtaatcccagctactcgggaggctgaggcaggagaattgcttgaacccaggaggcagaggttgcagtgactggagatcatgccactgcactccagcctgggtgacagaggcagactccgtctcaaaaaaaaaaaaagagcgataaggcttctgaggctctgagttggtcacctgcccgtggcatctgggggcacagtcaagggaggagacagggcagaatcccagaccatcaggctcctttctgctatctgtggatcaaaggctgtgtgtggatccaactcccatactctgtggatcccttcctcctgtctcctctgccaccccctacctaagcccagaaacttctctctgcctactttcccccaggagcaaccctgggctgtggcctacccatctccccacacctgtctccggtactgagcagcagagtccagctctatggcctcagctctgtgggcaaccctcaggtaccagcatggccaaggccttcctctccatgctgcctgcccttctcctgtgtcccacccagaacacagcttttccatgggaacatttcactgggctggagtgatgcccaggtagggccttacttaccctcatggggtacacagtacacagggccttcatcagtggtgtcaaacgaggagaaggaggcccgagaggaccaggatggtgagggctgctccagccctgagggtggctccaggaagctgcagttgagtgtgttatccaggtcgtggtgggccactggggaaggatgaggcagagctgccaggggtccactctgccccagccggtgccctcattagcccctgctgtgacaaatgttgatggggtgaccaagaccagccctattcttggactgcagggggcacaggcaactcaacaggtacagtgacactgggccaggactggagaatgggtagaggtgaacccagaaaagaaacatgggcacaacatgtgttaaggtgcaaggcaagtgtgtgcatccagggagctggaaaaggttgggctgacgtgttgagaaaaggccagaaaggtgggagacggggctgaagaagacacctggctgggacaggccaccaaggcctccaagctctgttttaggccctgccttgtgcgaataaggaagccttggagcacttctgagcccaaatgcgcagtggcagggctgccctttggctcagcccatctcagcaagctgcaccctaggcctggcctccagagatgcagaccccacaacagggggccccagaagctggctagcctggcctccattccacagagggatgtggggtccactccccacacctatgtccccagatgccatgctgctaggtgggccaaggggttttctctctcttgcttgcttgctttttcttttctttcgacagttttggggtttctcctccctccctccctccctccctcccttccttctctttcttcttttctcttctcttctcttctcctctcctctcctctcttctcttctcttttttcttgacagttttgctcttgttgcccaggctggagtgcaatggtgcgatctcggctcactgcaacctctgcctccctgcaacctctgcctcccaggttcaagtgattctcttgcctcagcctccagagtagctgggattataggcatgcgccaccacacccggctactttcgtatttttagtagagaccgggtttctccatgttggtcaggctggtcttgaactccaggcctcaggtgatccacctgcctcggcctcccaaagtgctgagattacaggcatgagccaccatgcccggcttggctaaggggttttctcagctgtttccttcatctcccaagagtctgagcccccttcccctccatctttagaaataagtgggaaagagaggaagagagggtccacccaggtgcaagtcagcatggagagaagcggcacaccccacccccctatcctgttggtgggtggggaccagcctgcccactttccaggaggatctctgggtactgctggggatgtaggcaggagggtgggtcctctccgtggggcagggcactcccgtggccacgcattcccccagcagctctggccgggatatacagcattctcctacagactgggggagcctgcgggacccagatgtccacacacccctgatgcgatcactctcagggccaacgtttctgacatatgcccacatcagccggcgcacctaggactcctgccttcctaccttgcctcgccctcagcagctgccacacctcttaccttccctctggtcgcacctcctcgcgcccacgcacatcaacactcaaggtcccccatttcctcactgagatctggaccccctcacacccatttcccagcagcttcctgcgtcgagaggtgtttctcccagataccccgcgctgtcatccttacctacgactttgggtagtttctgcctccggagcgggatccggggcagcttcatgctgatgcgactgaagcgcccgcatagtcggtgcggcgccttcttcctcccaagcgaaagctccctgcgggggcggggtctgagcggaggggcggggccggggcggggcccaggggcgattagatctcggccggagccaagcacagaaggggcggggccacgtccggggcaggggcgcggaagggttggatctgggtccggtggcacccagagggtgcggcctgaacccaggcgaaagcggggcagtatctgggctcaccggcgcgtagggtccttgccgcggcaagcgcagcagcagccgagcagcgagagcagcaggcagacgagcaggacgagcagcgcgcccgcgcccatcacgcccttgcgctggttggtttctgtagggggttatggggtcagcgcggtttctggcaccccctgcattccttaacgggacgcccctcatccacttacctaggtggcaggcaccagtgaccgggtcgcacgtgtcctcgtggcagctgcaggcctgagcacagtccgcgccgtggagtccgggcgggcacgtcacgttacagctgccgggacatagggtcaaggcatgccacagccgcccccctaggatgccccctaccctcacccctcacccgcggccagggcccagggtccagggtcccagaaccgggctctctctcgctgcattcgtcgtctagggattgaagccccgccccgcccgtggcacatattgggtagtggatgttttggaaacgaatgttgcacaacactagtgggggggcctgggggataggacccgtggtggccgcgccgcagcgcccactgctggggctgactcggctaggtgggaagaggggctgctgaaccagacccttggctgtaagtggaggtccctggtccttctgtaccaactcggggtcaccttaagagcccactgacacaggctggactggtcaccagatcctgcgctgaacgtgagctccccgacatccaggcaggaaactgcccccaaagagcctactgtcactccctagctggggtaagggaccaaggctgaggtgataacccagctcagggtggagaggccacctcgtcggctggacccccctctgtggcaggtacaagcccccaaccccctcccggtcccggggcactcactggggcccgtggacgccagggctgcacaggcagcgccccgactggaagtcgcagtgtccgctgccgcagtcggcgcacacgaaggcgcagtcctcgccgtaagtgccattgctacacttggtctcgcaccttggaaagaggggaggaggcgtcagcagaaatggaggcaaacggaccacagcgccctcgacattggggcctttgttagggaggcagggcgggggactgcgtgtctgggccgacgcaggcagggctgctcaccggtcgccgatccagcccgcgttgcagcgcgtacacttgccggtgacatggttacaggcatgcccgtcgcggcatggcggacagcggtggctgcagccctcgccatagaaaccggtggcgcaaggctggtcgcacttggttccgttccagccgggctcgcacgtcaagcagcggccctcggccaccgtgcacggctgctggcccttgcactggccacacctgggggaggggtcggaggctagggaaggctgggacccgcctcacccctgtccccatcggcggcccgcccttccacctcctccctccctggccgagagaccgcgcttaccggcggcgacagcccaagccgtagaagccggcggggcacggctcgcgacagtacttgccgcggtagcccggctcgcaggcacacgtgccgtccacagggtggcagcggccgcggaagcactggcagtagcgatcgcagcgcgcgccgaacgtacgctcgcggcactgacagcggccgctctgctgctcgcagggagacgagttgcaggcgcactggttgttgcagctgcggccccaccagcctgcgtggcacaggcaggcgccggtctgtgggtcgcagcgcgacgtggcgctgcagtagcacgcgctggcgcactgcgcgccccaccagccgggctcacagcggcacgcgccgctccgcgggtggcacgtgccgtgctggcactggcacgcatgctcgcagcgcgcgccccagcgccgcgcgtgacaagtacactggcctgtcacgtcctcgcactgcccgtgtgggtggcagctacacagctccttgcagtcggggccccagaactggcgcgggcactctgcaggggaggagcggagggggtggaaggccccggtgcttgagtaggtgcccccagccagccggaacctgcccgcgtcccgcactccagccgccacctctggggacccgccccgaaggcggatccgaccccgccccaccttggaccccgccccatctctccaggattccgccccaccgaccaataccggcccgaccccacgctcactggtgtcgcagttggcaccgaagtagccgtggcggcagcggcactcgccaggcctcacgcacacctcgttctctgagcacgtggagttgccttcgcacaccgctgtggacgagacaggccagagctgctgcgcgtcctagccccgccccctcccccgccccaggtccccgggatgacccactcaccaatcccacactcgtccccttgctgcctccagccagcgcagcacgtgggcacctgggagctgcgagcagagggaggacatctaagcccgatgcccctcccccagcccccatctgctccgggctcctccgcagcctccgcacagcctccctgcctctgcagttgcgctcctgtcctaggggggtggttaatgaggtcctgccaggcagtcgtctggcggtggaggattgccacaaacagacctcaccgccaagaactttccagcccagaaccacccaccccatctcacctaactcctttgtgtcctcctcccacagccattaggcctgagaaaagtggccttggagtcccaggaaggacagcagtgaggcagcagccagggagaagaccatgggcctcaggacctgcccaaatgtgagggtctagggcatccctccaagtggagggcccagcctaatgggtgtcatggatccagatgtcatgtgatgtgacatgatgaggacggcactaggactagctgggccacagggacacacctagatgcccagttggggttgagctccagtggggaggggcagcctctggacagggggacggggggtggcatgtagacacagtgaggtgaccacttggcagaggggcttctggagggaggtggggtgaggcccacccagccactagggaaggagcaggcacatggggagtcctccacgtgcaggaggaaagtcaaactgtggcaaaagggctcagggaccagggtggaggaaggagctattagagcatctgtttatgcctttgttgttggttttgaaacagtctcgctctgttgcccaggctggagtgcagtggcacgatctcggctcactgcaacttccacctcccaggttcaagcaattctcctgcctcaaacctctcaagtagctggaattacaggcacgtgccaccacacatggctaatttttgtatttttactagagacagggtttcgccatgttggccaggctggtcttgaactctgacctcaggtgatccgcccgcctcggcctcccaaagtgctgggattacaggcatgagccagcgtgcccggcctgtttatgctgattgtcttccacttgttccatttgatttggctttacagagtacacaatgctaccgcagcacttcaggagagcacaacctctaaaaccctgggtggatggggtgtgtgagcacaaaggtttggaggccctgcctgagtgaagccatgatggctagagagggttcgtaggggatgagctggggttagcccacattcaggggcagaggaggctgagaaggaagagccaccaaggctgcgggatcctaggttcccagccgacccagaacttcgcctcgatcctaaaggcatgtaacagccattcgcactttagagaaaaggagcacgcttcttcacaagcaggcttggattcagtatctgaatctagaaccggaaggtggtggggggcggagtttgggaggaagcctgaagaccctagcgggatgggatagactggccctacaccatgcatttcaggatagtacatgcctggcatgctcctgcccaggcttccgaggatgccccagccattccccagctagacagaataccaccccttgtacagagcacctaggcctcgaggcccctcctcctgaacaaggcttggttctccttcaggccaaagatgggacctggcgaacaggaccataaaatctcaaactttggggaattggtccagtgtattttccacaataaaactggaaaccagagacaggaatacaaaggcctggcttttcctggcccctgcccccactgtctccacccacccagccctgacccagggggcaccaaggtgcccatctgcagggagacccaggtctgctggccatcacccacccacttgtgtctgcttctgaaccatgttcactggatggagagcctctgcaggtgtccctcctgtggggagctttgccaggtggcctgctggaattgccccggaagcactaacccccttctgccctggacataaggctctgtggctaggaccctcgttttagggccacactcagctgggtttgatgtctgggtttgccacttgctgtgtgacctcaggcatgcagcttaagctctttgagcttcaggctccttagctatatagtagggctctactgtagaaagattaagagagccaagatgtttttttgccgggcgtgctggcatgtacctataatcccagctactcaggaagctgaggcaagaggattgcttgagcccaaggagtttgaggctgcagtgagctgtgatggcaccactgctctccagcctgggcaacagagtgaaaccctgtctcaaaaagagagatagagataggagagagagagagacagagaaagacgacagagagaaagagagcgcgcgccaagacctatgaagtggtttggcacatactaagcacaaaggatcctgagcacaggctgcagtgcctctgagtgcactcggtcatctctggtttagcgggcacccaggcctaaccccagcagagctaatgcccaccagcaggacagagtccatttgggttcactgagaacaagatgctttccttcttggaagggctggcagaaaaggccgggtggtggtggcaagcccactctctgaagatcttacaaagacgggtggggaaagatggcctgctgcagggctgctcccacgcttgccctgtaagtcggcaagaccctcagaagccaggccataggctgggcccaggcccctcagcaagcaagacatgccgtaggcttctccctcgtagagcattagttctgtgattcaaacccactgtgagttcttacatcttcaagttggctcatggggtccatacctgtccatgttctcccccaaatccaggcagaaaagcttctctgcctgccacacccttcagaccccacaccagcccgaccctcctgctgccccgcctggacacctctcctctggtttctgtccccatcctcagatctctcttgtgtccacactagctccctcgggaagctcactgaacactgacaacaccttggaccctccagcagggctctccccatcaatgctagacttgcaaatccaactgcccaatagatgatgtcaccagaaggagacctcatgggcctcatgcccaaccagcccaaacctgaactcttgacctccttgcaccctgagtcttccctgcctcagataaccctgcctgtcctttcaggctgggaagctgagacctggagaagcatctctgactcttctttcttgtctacaccagatccattgagaaaaaagacgctgagctctagcttctaaacgatatctaaaatgggatcacttcctccttccctatcccagccttgtgagagccaccctccatctccctggctttttgtaactggccccagcttccaccccctgccccccagggtgcgaagtgtttgccacctggcagccaatcctggtcagatcccaccctttctctgtacaaagcccccagggggtcccatggccctcagaagaaaagcccaagtcttctgagcagtggcagcccacggtggcctgcccaccctcactctctggcagctcctccgccagcccctcctggactctgcccagcctcctggatccttcctgtacttccacaggccctctgccttgggaaccttgccccagacacccacagggcctccgtgctcttctgcaggcctgtgctcactcaccaccttctcagccgttctcctcagaacaccctaaaggaaacagcactccccaacccaacacctcccagctcttgctagatgtctagacacacttgcttttctggactgtgtctcctctgccacagggtcagggtctccactgcagcttccctacaccaatacaggcctggcacagtgtaggtgcataggattttactggctttgcactctcctctccccatcctcctgcctcccaggaaagggaagggctgatggaagccttgcaagatgtgggaggacaacaaagacatgacccagaccccaggtgggcagtgcccagagtggctgtccttcccatcgacccttgccactcatgaccacagcgatctccacttagccccatgagggggttgtgatcactatcccattttacagaggtggagacaggcccagagaggtcaaatgacttgcccaggtccacacagctgggtagggtggcaccaggatgggaacccaaacccaggctcggttcctggagcaggcgcctcctgggaggtctgcagaccaggggagcgggagcaaagggctctcaggctccggacagctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgcc

SEQ ID NO: 551 - DNA, 13273 bp, Homo sapiens; identical to SEQ ID NO: 550

SEQ ID NO: 552 - DNA, 54365 bp, Homo sapiens
aacagttaacaccttctgtaagatgctttatttcattgaccaacaacatggggtctgaaaacccagcgggaggggtctttttatcacagagccagtcccaggcgagctgatgcatctctgctcctctgcccctcaggagctctcatcctccaaccccagctgcccccacagccccaccccattcacagaaagagggctaccacgtgcctcagcccccctgcccaggctgccagctcccaggtccttttggagaaggactgatctaggcagggaggagagaaggccaacccctccagggctcactgaggaaggccaaagcctttcagaagcagttcctgcagtgacgtaatccacagcctgggatctgcatggccctgagatgcctgcggcaggctggccaaggggctggtgtgaagaaagagggcagggcccataagctgtggccaacaggggcaggggccctgcctggagtaaagtgctctggcctaggctgcgtgggtttcactgccctgcagccccagcctcccttccctctgatgccaggcacagggagcctagtcctcactggagttgtcaaactcctcccagtcagacacactcatcacctcagaggcaaagtccgggtcggcctggctgcggtcaggggtcccgcggggcggctcaaggagcagggagcggggcagggtgagcacacaggccgccaggcctgagatggagttgtccagctggggcccttcctcccagcagtccttctccacatcgtaaatgtgcacgtagcctgtgcggctgccgcggttgtgtgagcggccacctaacacatagatcctgttgtccagcacagcaatgccaggctcaccgtgcccagcagggagtgggcagacagatgaccactgtccagacgtgcagctgtagcaggccacctgcaaagccaaggctagaataaagcccagcacccactgggacgaggctgccagctcccccacaagcccactgaccaaggtggcaacagttacccaccattctgacaggtcaggccccctggaaggatggcacagggccagtgttgaaacatcctgtccatgggccaggctgctgctttctcacccagggatggccgagtctgcaggaggctgtcttttgggccctcccctagaatgatcctattctctctggctttgctccagcccagcccttcctctaggccacccggccctaagccagtctctgcccccgagtgtgtggctgtgcccccatcagcatgtggtcattccccatgtctgagggcactgcttctctcccctccaggaaacgaagctgcctgagagacatggactccactgaaatgtcttcaacctccttctgcagcactcaacacaggcagtaggacagggggaggagacagaaagtggaagtaattccttgcggagtagtcaacatcaatattctcttgtcttcaaaattgtccaaacagtaaacaaagacatggaaaaatgttcaacctactagtaattcaagaaacgcaaaatcaaaacatcagagacaaatttttcaactagcaaccactgcagagaaggaaaatcacaaaacccaatgctgttgagggtgtggtaaagccatactactatgtatctgtctgacatgccagaaaaggaatttggcaataagtattaagagccataaaaatcttaccttcttgactgattagccgtttttggttctctagctatggtgggcagaatagtggcccccaaagatgtctagttcctaatctccagaatatgctaccttaagcagccaaaggggctttgcagataggatcaagggtacaagaatacaaaaaaaaaaaggattaagggtgcagaccctgagatggggcagttttcctggattttccaggtgatccatccaattgcatgagcccttaaaagtggaaggggagaggccgggcgtggtggctcacgcctgtaatcccagcactttgggaggccaaggcgggctgatcacaaggtcaagagatcaagaccatcctggccaacatggtgaaacctcgtctctactaaaaatacaaaaatcagctgggcatggtggcacatgcctgtaaccccagctactcgggaggctgaggcaggagaatcacttgaacccaggaggcaaagggtgcagtgagccaagagcaccactgcactccagcctggcgacagagcgagactctgtctcaaacaaacaaacaaaaaaagtggaaggggaggccgggggtggtggctcacgcctgtaatcctagcactttgggaggctgaggtgcgtggatcacctgaggtcaggagtttgagaccagcctggccgacatggcaaaaccccgtctctactaaaaatagaaaaattagctaggtgtggtggcgaacacctgtagtcctcctagctactccggaggctgaagcaggagaatcgcttaaacccaggaggcagaggttgcagtgagctgagactgcaccagtgccccccagcctgggtgacaaagcaagactccatctcataaaaaaaaaaaaaagaaaaaaaggaagggtaaagccagacaagagagctgagaagtgaggaggactcaacctgccattgctggctttgaagacgaagtgtccccaagccaggaaaagtggggacctctagaagccaagaaggccctcaactgacagctagcaaggaaatgggactgcaactgccagggactgaattcttctaaccagagtgagcagggaggcagatccccactagggtctccacaaaggaaagatgccctgaccgcaccctggttttagcctggcaaggcccatgtcagaggacttatgaatgcagaataaatttatcttaagttgctatgtttgtggtgataggttactgaagcaatagaaaactaatgtgctggcccagaggatctcacaagcagaggacctgttaaaagccagatcgccaagacccaccctcagggcttccgaatcagtgggtctgaggtgcctcgtaacacagcgttcccaggtgatgcagactctgttagtctgagaatcacactttgagaactgttgcatgaacctaaggaaataatccaaaatacctgaaaagctcaacaaagcaactattacttgtcatgttatttggaatagttaaaacttagacacaagaggggatgatgaagattgagtgttaatctggaaaatgcccaggacaaaagtcactgagagaagcagaatgggatatgggatgctcttttttgtttgtttgtttgtttgtttgagacaaggtctcgctctgttgcccaggctggagtgcagtggcaccatcacggttcactgcagcctcaacctcctgggctcagttgattctccctcagcctcccaagtagctgggaccacaggtgcaagccaccatgcctggctaatttttttttgtatttttagtagagatggagtttcaccatgttgcccaggctggtatcagttcctggactcaagccatccacctgccttggcttcccaaaatgcagggattacgggtgtgagccactgtgcccagctcagaatgggatgctctttgactacaatcaggcagaaaacatacacggtcaatgctgaaaatggtcatactgaaaaacagtactgcaggggcctgattatgaatgcttttcctcacccttctctattttttttttttttttgagatggagtcttgctctgttgcccaggctggagtgcagtcgtgtgatctcagctcactgcaacctctgcctcccgggttccagcgattctcctgcctcagtcttcccaagtaactgggattacaggcgcccatcaccgcacctggctaatttttgtatttttagtagagatggagtttcaccatcttggccaagctggtcttgaactcctgacctcgtgatccacctgcctcaacctcccaaagtgctgggattacaggcgtgagccaccgcgcccggccacccatctctattttttaaagttccggcaatgtggttatattaactttataataaaagttttgttctgttgttttgttttattttgttttgaatagagacagggtctcattctgtcacctaggctggggaacagcggtgtgatcatagctcagtgaagcctccaactctgggctgaaacaatcctcccacttcagcctcctgagtagctgggactacaggtatgtgctgccagcctggatctaaaagttttgttgttgtttttttttgttttttttgagacaaggcctggctctgtcgcccaggctggagtgcagtggcgtgatctcagcttactgaaacctctgcctcctgggctcaagccatcccccaacctcagcctcccaagtagctgagagtacaggcatgcaaccacacctggctaatttttgtatttttgtagagatggggttttgccatgatgcccaggctggtctcaagctcctgagctcaagtgatcctctcgccttggcttcccaaactgcttggattacaggcatgtgccaccacatccggcctaaaagtttttaagagtaataagcaaaggtagatgtgtatgtgtgtgatactgtcatggtgacatttgtccaaacctatagaatgtgccaagagtgaacactgtggactctggttgatggtgatgcatcaatgcagtttcaacaactgtgacacatccacccctctggagcgagaggtctgcagtggggaggctatatgtgtatggggggaaaagggggtgtatggaaactgtaccttccacttaattttgctgtgaacctaaaactgctctaaaaaatagtctatttttaaaaggcacatgattcaattacattttccatcaataacaactgagaggcttgggaatgatgacgggtgtggactgccccgggccccactcacctggtgcacgtccctcctgtatccggcatcgttgttgctgcccccgatcacatacagcttgttgaggagggttgccatgccgtgccaggcgcgccgcacaggcccatcagccagtgtgtgccaagtgttgctgcctggatcgtagcagtgtgtctctttcaggtaatcctcccctctgcggccgcaggtgatatacatcttcccctccagcgtcgcgcctgcgtgggcatacacctgtgtggagccaccaggagaaatggcgtgagagggcagtgaggaagggtggctgggtactctgtcaaggccaatcaccaccccacacctgcctgacaacgctgtgaggcttcaccacttcccactcacatacagacaagaatcctccctcgattctcatgggacatactgtcctagtcattgacctctaacctcttcccaatagcggatacatctatagactcagaaatgaaatgtagcctttgtctttcctttgctcctaaagttaacatctgcatgggggaactccaagaaaataaaagcattttttccaagccagtctggaagaagccacagaaccctggggaccgctgacccaccctcagtggcctccacccctcccccactcccactggacatgcaatcctccgggcctgctgaccctgcttttaaaatgtttgtaaataatatctgacactaaactcatgatgtggggagaaaaatacacatggttcttgattctggtcctgaaccttctgtgggctttttaccctccctctgttgggctatctccatagggcccagcctgcccccatcatgggcacctcttaccctggccctaccacttccggaacccacccactcacacccagcaggccaacagaaggccccaaggcaaggccctgggtgttttgagggtagaggagcccctcagggtgtggaggctccagagctatgttactgggcaagtcactaacactgaggccatgcgggtggcaaaaacacaagagtctagagaggtggacggagcagtggggaggaagaacacacaccaagggtttggtttgggtcttctcctatcaccagtaggggtctggggaggtttttctttttttttttttttttgagacggagtctcgctctgtcaccaggccggagtgcagtggcacgatctcggctcactgcaatctccgcctcccgggttcgaatgattctcctgcctcagcttcccgagtagctgggattataggcgcccgccaccatacccagctaacttttgtatttttaatagagacagggtttcaccatgttggccaggatggtctcgatctcctgacctcgtgacccacctgcctcggccttccaaagtgctaggattataggcatgagccaccacgcccagccgaggtttttctttttaattaaacttttcattttgagataagtgtagtcacgtgtagttggaagtaaaaatacagaggtctcacgtgccttctttcccccatggtaggagcctgtgtcactatatcacagggtcaccaggatgctgacgtggacacagccacagaactgtcctatcaccaccaggatcccgaggggctgccctttagggtgacatccactcacctcccttaccctaatcccttccttaagccctggaaaccaccaatctcttctctatttctacagttttgtaacttcaagagtgttgtctgaattaaatcagtatacaaccttttgacattggctttctaccccaacccaggttctaccaggttgttgcatgtacaggttgagtacctccaaaatctgagactttttgagcacaaacacggcactcaaaggaaatgcatttcagacttttggataagaaatgctgaaccagtaactataatgcaaagattccaaaatctgaaaaaatctgaaatccaaaacacttctggtccccagcatttcagataaagggtactcaacatgtaccaatagttggttccttttctattgctcagtagtattccatgggtatctaccacagcttgtttaaccattcactgttgaaaacacctgatttgtttccagtttctggctattaccaataaagctactattaacattcatgtacagataagttattttttatttttttgagacagggtcttggtctattgcccatgctggaatatagtggcacaatcttggctcactgcaacctctgcctcccgggttcaagcaattcttgtgcctcagcctccggagtagctgggattacaggcacgcatcaccatgcctggctaacgtatacagagtagttttcatttctctgggataaatacccaggatggtaactgccagatctgttttccagagtggctgtaccatttcacattcctatcagcaatccatgagcatagtttccctgcacagtcaccagtatttcgtattttcactactttttattttagtcatcctgaggtagttctctcactgtggctttaatttgcatttccctgatagctaataatgttacatatctccttatatgcttatttgccatctatacatcctcttcagtgaaatgtttcttcaactcttttgccttctgttttttgttttgttttgttttgttttgtttgtttttttttgagacagagtcttgccgtgtcgcccaggctggagtgcagtggcacaatctcagctcactgcaccctctgcctcctgggttcacaccattctcctgcctcagcctcccaagtagctgggactatagacgtccgccaccacatccagctaattttttgtatttttagtagagatggggtttcaccgtgttagccaggatggtctcaatctcctgacctcgtgatccacccaccttggcctcccaaagtgctgggattacaggtgtgagccaccgtgcccggcttcttttgccctctttttaatggggttatttgcagtattttgccaaggttttttgtttttgagatggagtctcactctgtcgcccaggctggagtgcaaaggcacggtctcggctcactgcaacctctgcctcccaggttcaagcaattctcctgcctcagcctcccaagtagctgggattacaggcgtgtgccaccgcgcccaactaatttttgtagttttagtagagatggggtttcaccatgttggccaggctggtctctggtctcgaactcctgacctcgtgatccgctcacttcagcctttcaaagtgctgggattacaggtgtgagccaccacacctggccgtttattgagttttaagagttgtttatatatgtatttatttaatactagtcctttgtcagataggtggtttgcaaatattttttaattttgatgaagtccagcttatcaatttttctttttatggctcatgcttttggggtcaagtctaagaattccttgcctagccctagctagatcctcaagattttcttctggtcatcacgtcgcgtggccgcagggagcagacccggacagctccagagcctccgggccggggcggcggcggcgacgcttcggctcctcctgagccacctgctggacccgcaccccactccatccccacaggctggggacaggccctggcgcggctgtgtgggatcagaagcagagttgcagaatccaaggacctatttttgttctttctccgcactgctttatgggaggcattatggcccccaaagacataatgacaaatactcatgctaaatcaatcctcagttcaatgaactccgttgggaagagcaataccttctgtgatgtgacattgagtagagcagaaagactttcctgcccatgagattgtgctggctgcctgtagtgattacttctgtgccatgttcactagtgacctttatagaaggggaaaccctatgttgacatccaaggtttgactgcctctaccatggaaattttattggactttgtgtacacggaaacagtacatgtgacatggagaatgtacaggaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgacacaagcagctgaggtttttagccagaagaattttcctgaagtggtacagcatgaagagttcattcttctgaggcaaggagaggtggaaaagctaatcaagtgcgatgaaattcaggtggatcctgaagaaccagtctttgaggctgtcatcagttgggtgaagcatgccaagaaagagcagaaagactccttgcccagcctgctacagtatatgcagatgcccctgctaaccctcaggtatatcacagatgtaatagatgctgagcctttcatccactatggtttacaatgcagggatctggttgatgaagcaaagaagtttcatctgaggcctgaacttcagagtcagatgcagggacccaggacaagggctcgcctaggagccaatgaagtgcttttggtggctgggggcttcggaagccagcagtctcccatcgatgcagtagagaaatatgaccccaagactcaggagtggagctttttgccaagcatcacttgtaagagatgttatgtggcctcagtgtccctacatgaccagatctacgtcattggtggctgtgatggtcgttccagccttagttcagtggaatgtctagactacacagcagatgaggatggggtctggtattctgtggcccctatgaatgtctgatgaggtcttgctggagccaccaccctgggagatttgatctatgtctctggaggctttgatggaagcaggcgtcacaccagtatggagcggtatgatccaaacattgaccagaggagcatgctgggagatatgcagacagcccgggaaggtgccggactcgtagtggccagtggagtgatccactgtctaggaggatatgacggcttgaatatcttaaattcagttgagaaatatgaccctcatacaggacactggactaatgttacaccaatggccaccaagcgttctggtgcaggagtagccctgctgaatgaccgtatttatgtggtggggagatttgatggtacagcccacctttcttccgttgaagcatacaacattcgcactgattcccggacaactgccaccagtatgaccactccacgatgctatgtaggggccacagtgcttcgggggagactctatgcaattgcaggatatgaaggtaagtccctgctaagtagcattgaatgttacaaccctatcatcaacagctgggaagtcgtgacatccatgggaacccagcgctgtgatgctggtgtgtgtgttctccacaagaagtgaccattgttggagcaccatccagagctagtgaccagtccagtggacagttagtgggagaatcaagaatcctttctagaatgtctgtttctcactatgtgcacagggtgattacaggcaccagtgcagtgatgattgtacttatttgacacatactccccctcgtcctggttgttgttcctgagaagggtgggtaacagatactccagggaaaagaatgcacattgaatggatgtgagagaccacattacctctcccactactttggggagcactttcctgtcatttctaacttaccacgtgcttggtgtactatatgtatgttgtgcctcatatgttgcaaagaactaaggtgagtatagcctactagatgtgagcaatatccagcctagatgattggaaagataccaatttaagtaaacttggtaaaatccaagtcttttttttttccaggaacaaatacattttctaatctacaggtagctaggggcaacacagttccattctaaagggaaacaaaagggagagccccacaaaactttgggggcaagggagagatactcatctgacacttcttttggaggtcagggtttgtatatcagaattgaagttagaatcagtgaattaaactgaatttgatggaatgtgagtgaacctagaacagcactgaagtattacataacctggaagactgagaagggtatattctttgaatgatctttttatttccccaaggtctttcacactggagacagcataaaagagtgaaccaatgttgggatgagagaagatgacataaatgtgggagttcagtataactggggataaactagaagtacctgtgattttacagtcatcttattgcctgccaggggtcatctagccatggcagtgttaaccttgaatgggggtgaaagcctttctttgttgaatcaaatactactacactattacacttccacactatttatttggggatggactgggagtgacagtagcctagtagttcagctacctgattactgccccattcttttagaagcacacttctgccaaggagtggtttgtactgctgtgattggtacatttagtcttttttctgctataagttttccttacctgtcctttagtgtagattttattcattacaggacagaataatcaaggacaaccaaaatccttttgttagtttcagtacctcagctatcaacatttctgagctatcattcaatgttcctctgtgtcatggagtgaaattcttgttttatgggtattgggagtgtgggaatgtgataacctaaacaacctttgctctgaaattccatttttccctctttccctgaagtgtactgacctgtactacagagttaatttcttttgtatttttttaagaaaatattaaaaatcaatggtctcaaaaaaaaaagattttcttcttctttttttctagaagttttatggttttacatttaactccataaaccattttgaattcattttggtatatggtatgagacttgggttgatatccatttttttgccgacgcatgtctaattgctccagtactatttgctgaaagatatctttcctccactcaattgtttctgcacctttgtccaaaatcatgtgtaacatgactgggcatatttactcaggtctgtgggttttccattctgtttcactgatctatgtgtctatcactgtatccataccacagccttgattactgtagctatgtagtaatcttgaaattgggcagactcctcccatcttatcgttctttttcaaaattatttgagctattctagttcctttgcctttatatatacatttcagaataatctcatttacatctaatgtcacaagtaaaatcaaatcaaaattaaaaaatttattttatttattttgaaatttattttattattattttttgagacagtctcactctgtcgcccaggctggagtgcagtggcgcaatctcggctcattgcaacctctgcctcctgggttcaatccattcttgtgcctcagcctccccagtagctgggattacaggtgtgtgccaccacacccagctaatatttgtatttttagtagagatggggtttcaccatgttggccaggctggtcttgaactcctgacctcaagcgatacaccatcctcggcctcccaaagtgctgggattacagacgtgagccactgcgaccagcaataaaaaaaaattttaggctggatgtgatggctcacttctctaatccctgcactttggccgaggcagacagatcccttgagaccaggggttcaagaacagcctgggcaatatggtgaaaccttcatgatactaaaaatataaatattagctgggcatggtggtgctcacctgtaatcccagctacttgggaggctgaggcaggaggatcacttgaaccagggaggcagaggttgcagtgagccggggtcatgccactgcactccagcctgggtgacagagcgagactctgtctcaaaaaaaataaaaataaaaaaatttttaaaaagcttattgtgcatgtaaaagaagagttcatgaaccaggaaaccccaaactggaagtggtatgaagccccaattcacagcagttacaacacagtttataaagcatgaatgaggaagaatattgttccctactgtgcatgtggagctgcataagctttctttgtaaagctatcacactgagggaggaaagcttaagtttcagttacatggctacaggcagttggcctaggggtatatccaaacctcagcttcaattttcattttcccttaatagtacaaaaaaccttcctgaaattttgataggaatactagtattcctgtattaatactatatcaatatgaggaattctgtattaatatatgtattattaattgggttgggaaagaactgacattcttactattcttactcttccaatccatggacttggtatgtctctccatctattcacatcttcttttatttctttcatcggctttttgtaatattcagtgtaccaatcctgtgaggttttttgtttgtttgttttgagacggagtcttggcagagtcttgctctgttgcccaggctggaatgcagtggtgtgatctcagctcactacaacctctgcctcccgggttcacgccattctcctgcctcagcctcctgagtagctgggactataggcgcctgccaccatgctcagctaatttttgtatttttagtagagatggggttttaccatgttggccaggctggtcttgaactcctgacctcaggtgatcccccccgcctgggcctcccaaagtgctgggattacagacgtgagccaccgcgccctgccaacatgacctatcctttttcattccccaacatctgatccatcagcaagcctgatcagtttacctccacgctacactctgaaccctcccatctccctccagctccacagctgtgtgccagcacaggctactgctgtcttcagcccagaccacgcaatgacccagggccagcctcgcttgctctgctcttgatccttgggcttccttcttctacaagcatgccccatgcttcctctcctgctcaggaaaagctgtgagcccctctcctgccctggaaggtccttctgctagactaggcagatggttagatatgagcagggaagtggactccaggttggcctcagcccctagcatggccagagggactatgacctctgagacatgttaaccacacctggggtttcaaaagtcccaacccctctttcagttaagcttatccagctcaagtaggaactaaccccacaaggaactttccacccccgggagcctgtgttgtatagtttgccccagttttgcttgcttcgaaagtaaccttttgttcactgcagtggtaaaaaacacacctcctgggtgaagatttaagatgctaatgagacatgcgataaatacactagcacgtagagccacagtgcatgcgctgctagaagaccacccaaacaaaacatgcttatgagtaacacctcttcccgcccatttatgaataatcatgtaagcctcctgtaagggaggtttcccatgccagttggggcgatcttattctggagcagcctgctctgactcggccttcagaatgtaccttcacttttgcaataaactgccttacacttatcttcgttaatgcatgtctcttgcttaaagtcttaaccaagaagacaagaaccgaggacacattcccagtaacatttcctccctctgtaaatggcaggtctaattgacatctcctcagatggacattccccaaaaagtccctctagattcatcctaccagagccccctccctggaaatcctccagttcagccccctcttcatttcacttaccataattgtaaccactttactgatctgttttctggttaagagtggtttctcctacaaggctgtaaacaccatggagtggggagtctttctcatttcttgtcaccactggattcccaggacttggtacatggtgcttagtagttgcggaatgaatgcgtgcatgaaggaacaccggcagccacgatgcagctggttgaaagccaaggctgcccctctgtggccaagctggagaactgctgcttccccagctgccgcagacaaagaaactgctaagcccctcccacaacacccacctaggaggcttcccccaacacccttcctggaacagaacccaagagccctccttgtccacttggtctcaaggacctcctgatcttctccatgcaaaatctgctcctttccccaggatgggggtacggagtgtccttccaaagaggcttccttctccccaaagaagctgagagcaaggagcaggccacagcttgcagctcacagctgcccaagagacagaaatctgtgtgggctgtgtgaatgacctggataaagaagagctggatccattgaggagacactagccctgacccctgaagtcaaagtctaagtccctgggggaattgggggtcatgagagatactggaaagaggcttacaaaggccagagctcttgctaaactccctgaggcagtgcaggtagaacctgccccccataccatcctctgcctctcaggtgctcggttatccccaaaggtgtacctggcccatagcaggtgctccacaaatgctatgccagtactagcggggtgccctgctagggtacccctagtactgctagggtatgccctgttctcggaggctgagacccaggaagtagggggccagcaaggcctgttccttccctgggatcccatgtctggttgttacaccaggcctgagtaccccaaagtcgtaagataaaagagaggcacctccctaaaacatcatttttccataatgaacataattttaaacatcttcaaattggaataaaccaaggtattatataggatgcacgtgatttttttttcaagttgtcccaatattcaaacataggatttaatataaaaaataaaaccttagagtgtttcttggctctggaaggcgccacccttcaggggacctagagggaagaggtctgaggataggccagtgagctctcagggtcccttcctgtttaacatctctggaagtgtcccagctcgtctcagctgcacaaagagcaaatgttctatccacatttgaactacaaggtttaagcagcttgccagggccaaggtggtgtgacaaggtctcagcatgtaagactcacaagtggggcacaattctgagcaatggggtctggatccttgatgagcctccccaggtggactggctgaacctcatggggcctcatcaatgcattcaatgcagggtctctggagaagcatggattctgctcactgagcctgtttctctgacctgggacaggccttgacacctaggcctctcactctttgcacatcctggggaaggaaattaggcaggagaaggcccctcttcgagggcttccttacctccctcttgagtggggccacgtatgcccaggagttggtggcagggtcgtagcgctccacagcattcaggtcattgtggtagtcacggcccgccacagcgtagatgtacctgcctacaacacacacggacaggtcggcgtgctcctgctgcagggactggatctggaaccagcggttgtgccgtgggtcatacctgtgccgagacatgaggaaagcacagcactgactaggcagggaggctgctccgcaggcttgcacctcttgttctggtcccatttctgctttgcctcagcccagcctgaaccctccccaactaccccacataccagtgcacaccgatctacagccaggcccacaggctgttacacacctgagcacaggtgctccccaccacacagcatggaaggaatggccaggagcctcctgtgtttccacctaactgtccacctgggctgtccaatggctctttttttttttttttttttttttttgtggagagaggtctctctgtcccctaggctgaagtgcagtggcacaatcatggctcactgtagcctcgacctcctgggcttaagtgatcctaccacctcagtctcctaagtagctgggactacaggtgcgcaccacaacgcccgctatttttttttttttttttttttttgatagagacaaggtcttgacacctgggatatggacttaggcaatcctcctgcctcagcctcaatggctgttcgtacagccacttccatctcacttacctcatctcatcatccacatagccttgctcccactcaggagggcctccaaatacagcctctccactggatgggtgccatcagccccctcattggcctccaagccttgaacttcccccagcactccatcaggagtggtcttctcaggcacgccctgcacacagcacccatcataccctcagctttgtcaacagccgcacacacaaggctctggtcatcgtactttcacctcctcccaccatgctgccagccccgcgtttcctgacctcccctccactcaaggtctccctctctgggaaagtggaaagggttaactcccaccctggactgcaggctctgtaagggcagggtgtgtgagattccagggacccccatgggagaaaaggcactagactggttgcggcaggcccacgagggtggaggagtctggccaggacccaaggagggctcctgggctgagcaccaacagggagcatggcctgcaatgtggagcagagatgatcacagagccatgaggggccaggacccagtgagctcaaagccagtatctgaagtgtccttgcccaacagcccacagatagttacagcctctttcagacaagtgtttttatttctgcagaggaagacctattccaaagagaacaagtctaacttcaactggctcacaagagagtaaccaaagttttctttggcctgtgccctatgctggttagtgaaaagatcagtttcatcctttgcttcctgcagcccctgcagtgtggccagcccctccccgccgcctaccaggaatgcagcaaacaggagcctcagaaggcagggccaacaagagagggaacacacacctgggtctccctgacctggtgtgaatcctgggctcttccctgtctagctgggtgtgcctgggcatcagttttaatctcttgggattcgctcagttctgcacctgtccaatgaggtgatatcacctgcctagaaaagctatcaagaagaatcataaaagacgagcatgaaaagtgtccttgttaacttgggggttctgatggatcatggttcatttctatattcctagacctcagtgtagcctctggctcaggacagattatgttctgtctgctgaatgaattaaacaaaggagtaagattaccagcaatgaatcattcattcactctaccaacattcccaggtctcccactgtggatggggcacagtgctcagcactacatccagagggagcctcaagaggtcagggccctgccttcccctgcagaatggaaacaggctaaccagagcaaatgagtgcttaatataatgacagacactgtgaaagaaagaaagggaggtaagaagatgagtgacctgctggtcagcggggcctggggagggcagagctcccttgcagtgatcaggaaaggcctcctgagaaggcagggtctgagacctgcatgacctggggcacaagccagaagaaggtctggcaggggaccagcagtccaggattggggcacagcactcacaggggccccgtcaactggctgggatggtgctgttcactgcctttcctgtgcgccttcctcctttatatacaagtctctcctctcttgtgttcagtctggctcaatcaccatctgcaccccaagtgtctgcaaccagagtgagataggaccctccatgtgctcctgtttgctccttcgagtctattgtcctcacagctttttaagctgagttcatgtggatttgtggcttcaaatttaaagacacacacagggccgggcgtggtggctcacgcctgtaatcccagaactttgggaggctgaggcgggtggatcacgaggtcaggagttcaagaccagactgtccaatatggtgaaaccccgtctccactaaaaatataaaaaaattagccaggcatggtggtgtgtggctgtagttccagctactcgggaggctgaggcaggagaatcacttgaacccgggaggcagaagttgcagtgagctgagatcatgccattgcactccagcctgggcgacagagtgaaactccatcccccaaaaaaaaaaaaaaaaaaaaaaaaaaaaaaaaaaaaagacaccaacagtgataccatatgtcaataatttagacatagccaaagttacactgatttcttatttccctgttgtgtcctgtatccctcttcttctttattgaattaattttctactttatgagaataagtcctcaagtaatatttttctaataaaaataagctttatttttgcatataaagatataaacaattttacttattgctatggactagatgtttggattcccccaaaacccctatgttgaaggcctaacccccattgtgatggtagtgggaggcatggcctttgggaggtgatcaggtcatgagggtggagccccatgatgggcttagtgcccgaggctacagctctttctctccaccatgtgagaacacagacggaaaggaccttaccgggactaaactggccaataccatgatcttggacttcccagtatccagacagtgagaaatagaggtatgttgtttaagtcactccatctatagtatttgttatagcagctgaaactgactaggagagtcactttaactcagatttgtatcatcctattgtaaactcagacatgaaccctagagttggtacaaaaatattctggaattcttgttaaattcattagactgtggccaggcacggtggctcacgcctgtaatcccagcactttgggaggctaaggcgggaggatcatgaggtcaggagatcaagaccatcctggctaacacggtgaaaccccgtctctactaaaaatacaaaaaattagccaggcgtggtggtgggcgcttgtagtcccacctactcgggaggctgaggcaggagaatggtgtgaacccaggaggtggagcttgcagtgagctgagatcacgccactgcactccagcctgggtgacagagagactccaactcaaaaaaaaaaaaaaaaaaaaaaaaattcagtagactgtttttcttctatatttccatgacttaagtattttcatgactattaatgttttaatgtctattaaattttttaaataaattaaatgtactgaccgggcacggtgggtggctcatgcctgtaatcccagcactttgggaggctgaggcaggcggatcacctgaagtcaggagttcaagaccaacttggtcaacatggtgaaactccatctctactaaaaatacaaaaaaatggccgggcgtggtggctcacacctgtaatcccagcactttgggaggcccaggtgggcagatcacctgaggtcaggagttcaagaccagcttggccaacatggtgaaaccctatctctactaaaaatacaaaattagccaggcatggtggcgtacaccggtaatctcagccactcgggaggctgaggcaggagaattgcttgaacctcagaggcggaggttgtggtgagccaagattgcaccattgcactccagcctgggcagaaaacagcgagactccatctcaaaacaaaaaaacaaaaaaacaaaaaaattagctgggcgtggtggtcggcgcctgtaatcccagctattcaggaggctgaggcaggagaatggcttgaacccgggaggcagaggttgcagtgagccgagatcgtgccactgcactccagcctgggcgacagaacgagactctgtctcaaaaaaaaaaaaaaaaaaattaaatttactttaaaatattagcagccatgaaatgccgaaggaaaaattacattattatttaaaaaattttttttagagacagggtctcactctgttgcccaggctacagtacaggggcatgatcatagttcaccgaagtctaaaactcctggactcaagcgatcctcctgcctcagccttccaagtagccagggctgcaagcacgtaccatcaggcccagctaattttttttttttttttttggtagagacgaggtctcgctttgttgcccaggctgatcttgaactcctgggctcaaaagatcctgctgcctcagcatcccaaagtgctgggattattgacatgatctgcacatagcctaaattattattttaagtagggtcagggcacatagcaacatgtaaccagctactactaggtataccatgtagttggtgttcagtaatccacagggctatggctatgggaaaggtacaaggaatgatgcagataatatagatgcaaagaaagaaggaatgaaagagaaaaagtagtatattggagacaaacaccatttgctccaagagaggaaaggtttttaaatatgcggtttctgcaccaatgctttaagatataacctggtaagtaataactcctcaaaatgcaaagcctaatttactgcaaaatcttgtttccttatattctaaaagcctatagcttttagaattcaccagttctaaggctgatgaaatgagaaagcagagaaagaaccaaatcttagaatattcaaattaaggattcatctggaagttttgagtccactggaaggttaatgatgccttcattctggagagatgatacatccctgggttaaccagtagggctgtggtccttcctgccacctccactctgtggatacctactctctcaaggcaggtcttgccgaccccacttgccattgtgatcctactctcagacaggagtttgggactggttattggttacagggtctaatattagcattacccagagttcagctttggtctcacaccccttcacaaggggaaattcagactcctactttaagtgaaagtgagatcaatggcccatagcaggtggacagaggacaggggcaggcagaatcccaagctgtcacccccctagggacagctctgtggaaacatccagcattactgccaagcacacagctgtctctaccttctgctaagggccagaagccaaaacactctggagagattggctttgcaggtctgtaggttactctcagcagggtggtctggccttggccccccaactgggaaaccgagccccctaaaaaagaaggtttaaggtttggccaaagggaagtctaaacctagtgtggccacacccactgggggcacaactttgtttagagaggaaatgaaggtagctgtttccttttttctgaaacctgcccttcctcatatttaaccacaatgtgttattgccaacctctgagtctcatcagcttaacaaaggagatcacttcctggggccagcagtagagaggtcgctgagaaatggccttctcctccttggccaggatcactatgcttgattccaagtggcatggccaggccaggccctaccccaccctgaccccagaaaatagaaacatgaacatgaactcagtcagcatctagctcatggctgctggaaatagttggcaatctctctctctccaacacagctccatctttcagcatgaagggtagggagatttctcacatgcaccaaggtaaggtggaggggtccctggaaatctaatggtagctgagtcttgtgggcctgaaccactgtcccttgctctgcccagaaatggatttgtgagatcacagcctaagtgactgatggagccaggcgcatcctacggaccacagcagtccacaaaactctctcttgggaaaactgcctcttcccaggggaaattgtgccaagtgcgtggcagactgcagggcagagcggaaatgtagcatgaggctcggtgatgcttgttggcctttaccacgcccctgggctgaagaccgcatgctgctcaggcacagcagcaggaagcctgttccaccattagcaagcaggtaagagagaagagcaaagctgactggtgaagggaaactgaaacaacatgcatcaaagctcagagagagcatgatggagggcgaggctgctcagctggcactgctcctaggtcctctccatcccagtccgactgcctttcctgctgtgggctcctctcccctcccgtctcctcctgcacaatgcactcgcaacctagcctaccccaaagaggctgagcaagggtccagggtaagtgggtttctgaggagtaggggacatgcaggaaagaaggcgatccacatgtccccttctcttatctcactgctgtccaccttctctgaattcacctagacttcattccacaatggcaagtgatgctcatgtgaaaggctggggggaacctgaccagctctctcagcccatgacttccacaccctctcatcacctgaagacaaagggaccagctagcaccctgtcctacctccagcatcgggactctgctcgaaatccttggacattgttgtcccctccaatcaagtatacgaagttgttgagcaccgcgatgccctggttggacatgcggggggccagggaggcagtgaagtgcttccactctcccagtaaggggtttagatacttggcctggtcgctgaggacagtggacggcgtggagtgaatgcccccgaagcccacaacgcactggaagtccgaccgcagctccgtttgcgggctctgcaggctgggctgtaggctctcgttccggtggtacatgagggcgctggccactgtgtccctcaaagggctggggtccagcttgtcatgcagccgctgcaggacctcagcttccatcagcggaaaccgcactgtctcaaggagctttgggggctcgtgcagcgagatctggtcagcctgcacctgctccaggctataatggtagagaagggccccctcatatacctcggtctcgcaggagacctccaggcgattgctgctgaggagggagtagaccttctccaatggaagctggcggtacttgtcagtccgagagaaggccacaaagtttttgaggatataggtgtccagttgctcagtcaggcggctcaagtcaaacagctctgccagccggtagacatcgagaatgttctcttcgtccacccaggacatgaggaaatcacagcagaaatggataatttctgggatctgcagagagaatgacacccattcaagcctgggctggtgaacagcatctgggggtgggagagagaatgatggcagaaatacgggctgttgtgggccaggcaaagcagaagggaagtcctccttaattgtccccgaccttttctgacacactggagactggggcttactgcagactaggtttaagtcctggtttggaaacatactgggtgacaggatatacagcatgtttttttttggttttgttttgcttttctttgagacaaagtttcgctcttgttgcccagaatggagtgcagtggcagaatctcggctcactaacacctccccctcccgggttgaaatgattctcctgcctcagcctcccgtacagaatgtttttaacctctctaagcctcagtctcctcatctataaaacggggatcattaaagtgaagaggaacatgatgaaaatgagagagcacataggagtggacccttgatatatgtcagttccctcttagatcaaaagtactggctcggccgggtgcggtggctcatgcctataatcccagcactttgggaggacaaggtgggtgtatcacgaggtcaggagtttgagaccagcctgaccaacatggtgaaacaccgtctctactagaaatacaaaaattagctgggcgtggtggcgcgcgcctgtaatcccagctactcaggaggctgaggcaggagaatcgctggaacccaggaggcggaggttgcagtgagccgagatcgcgccattgcactccaacctgggtgacagagcgagactccgtctaaaaaaaaaaaaaaaaaaaaaaaaagaagtactggctctccagaaaagcaggaagcagcacaaatggtcactgtgtcatatatctgtggtttggaaaggacctaagaccatccccatccctaccctaggattctctggaagagcctgcctctccaaaagcgctgggaccagaaacaaacctggctttttcccccgccagaacatccaccctggttccctagaagtgctcagagcctctcagacacctaaccaatacccacccaggaacctgatttagaattatttttcttttttctttttaaaatttgagacagggtcttgctctgttgcccaggctgcagtgccatggcaagatcatagctcaccgaagtctcaagcttctgggctcaagtgatccctgactcagggttcttgaggttcccagctgggtcaagacccacttgactccagtaagtgcaggggctcccaggtggccatatcaacccttcccagccatggggaagcactagtggtttgaaaggacggcaagagagagaatgacactggagggaggtgggaacaaggccacaaccagcaggctgttaaaggccaccctgtgaacagacaaccaaatcttgggagaataggagacaaagggaagggccctagggaaaactgcctgggagaacaaaccaggtgttgataaattatttaggaaagcaggattttagagtttcagtggggccccccagtgcccacctcctttctttccatgttcagattgaaaatgacgagtaccttgacctctctgtgacccagacagctgcaggttctcccagcaggcttgaacccaaaccaggcccttgaacattcccaggcactgataaaggcatcaaggttgttacccaaaacactgaaggaaaaactggttctggccctgagacaaattccttaaaccctcatagaaactccatacactaacccactctgtgggcaagcctgggtaaagcctctcttttcccttgtctgtcttgaggacatgctacatcactctatacataagttcccctaataaacgctctggccagatcaccctggtgtttgatgcttctttctttggaatcccaaaacggctccatttcaggatgctgtggggtcccctcttgtgggaacccccttgctaccaactccagccatgtgttcaatgcaataaatcagtttctctaaaaatgggaatacctggcttatccaggatcatcaataaattaaccattacacatggaataattctgctggtatttatgtatttatttatttattattttgagatggggtctcactctgttgcccaggctggagtgcagtggcacgatctcggctcactgcaagctccgcctcccgggttcacgccattctcccacctcagcctcccaagtagctgggacaacagacgcccgccaccacgcccggctaattttttgtatttttagtagagacggggtttcatcgtgttagccaggatggtctcgatctcctgacctcgtgatctgcccgcctaggcctcccaaagtgctgggattacaggcgtgagccacggcgcccggccaaggtatttaaagcttatcaataaacactaactataacttttttaaaattcaaaagacatctaatattgcttgcaaggtgacatgctaagagctggatgagacctaccaaatgtcaggcaggtatgtgccctacatgaggtatccccatggtgctttgctaggccctgaccagcttcacttgaccttcttttttccctttttgccagtcttctgctttgccacttcttcccaaactactaggttttcctaaaattctggtttgtcatgggccagggtcctgaagaccaagttttgggcagaatgtgagcacaaacagccctgaagaagcctgggcagcagcagctccttgagaggaccctgctgactctcctttcagtcctatttttagagcagtgggccttctgttcagtgaaatctcacagaggaaccagcctgggctcaggatgtgcaaaagccccatacgaggctcacagaagggactgcatttgcttggggtaacccaataggacagtgttactgggaatcagactcaggcctctggggacaccgtgaagaatctggtcccaggcctactgcagggcacaacacatgggggaagcctccaaaagtcactagctatgtgaacatacatgattctacaggcctatggacttgacatggttatgccaagtaaaacctgctataaaacaatattgtgaagaagcctgtttttttttgtttgtttgttttttgttttgagataagctggcatgtagtggtgtggtgatcacagcttactgaagcctccacctcctgggctcaagtgattctcccacctcagcctcccgagtagctggaactacaggtgcatgccaccatgcccggctatttttaaagtgcttctgtagaggtctcgctttgttgcccaggctgatctcaaactcctggcctcaagcaatcctctcaccttggcctccaaaagtgctgggattacaggcatgaacctccaagcctggcccagaagcctgatatgttaaaaaactaagataggctgctgcctctgagatgacctctgaggcactgggggagatgacccagggctgtcgggagcactggccaaaccaacagagagagactgcaggcctccaagctgactggtgagagagggaaagtgatgttagaaagatgatctggtttcagtgtgtgtgatcactgcagggagaagaaagaaatggcagaaacatacagatggaggccaggcaaaagggaaggaaatggaaacacagaacagagatggctacaagcaataccgagaaggatgacctgtcctcacatggacgcagggaattaagaaggtggacgggctcaaggagccactgaggttgagcccagggaactggcaggatggtcacaggacacacagagcagggggactgacaggggagctccgggagagtggcaggtgtggaggaggagataggacagctggacctgagccatgctgggggagatgtttcagaggcagctgaatcaggagttaactgctgccagggtggagaattggatgagggttcccaaagcaacaatgacagggatgtggggacagaagagatctctaaataaaagaacagggggaaattcttttgttgtaaaagccaactccatctactcaccatgcaggtatggtgagacaagtcagtcatctcagatcaacccacccagcatccaggtcctatccaccaatctgagaacagggcacagggaggctgccagggccctgtcacatggggtggcacctccacatgcccccgaacaggttggttttcctgtgacttgagttgtttttttttaattgcgtcaaacctgctctcatgggaagaaaggtcagaatgatgaacttagcatagcattttgtttcacttttaagaaatgtgggaagaggtgactgtcaactcctatcaggcctctgcctgatagctcaaaggcacctgcaggcccagtcccgtgtaactgcacccacaccactgagaataatcatccaaaacataagtcacactgtcaaagcctcagaaaactttttgaattctgcaggaaaacaagtacttaaagttcaataacaggttgggtacagaggctcacacctgtaatcccagaactttgggaagccaaggtgggagtatcacctgaggccaggagcttgagaccagcctgggcaacataacaaggccccattcctataaaaaaatatatatatatataatatcagctaggcacaatggcacgcatctttagtcccagctactcagaaggctgaggcgggaggaccacttgagcctaggaggtggaggctacagtgaactatgatcatgccattgcattacagcctgggtaacagagtgagaccctgtctttaaaaaaaaaaaaaaaataggccaggcgcagtggctcacacctgtaatcgcaacactttggaaggctgaggtggatcacttgaggccaggggttcaagactagcctaagcaacaaagcaagcctctatctctataaaaataatttaaaaattagccaggtgtagtggcacatgcctataggtcctagctatttgggaggctgaggcagaaggattgctggagcccaggaggttgaggctgcagtgagctgtgatcgtgccactgcactccagcctgggcaagagagagagagcttgtctccaataaattgaatgagtggatggatggatgggtggatggatggatggatggatggatggatggatgcatgcatggatggatggatggatggatggatgcctgccaccatggatggatgcatgcatggatggatggatagatggatggatggatggatggatggatggatggatggatggatgcatgcatgcatggatggatggatggatgcgtgcatgcatggatggatggatggatggacagacaaatagatagataaagttcagtaacaaaacacataagttttcaagagactgaagtggcccagtgaggggacaggcaggaagggccctggcagcaatgctggtggatgctccccattgccagaccccagagcacacaggacgtccacatgcagcctcgggtcagcctacctgcttatgtgcaggatgctttcaatgacagggagactcagacagtggggaaacaaccagcaatagagaagagggcaaaggcagaggcctggggtgtctagagcggctctgcttgagctccaggaacaactccagagtcttccccacttcatggccttcgtcactgcttggtctcctcacattcctgacccatcttcaagccaatgctagtgcccggcaggcatcatgggcatctcagggaaccccacctgggtgtgggtctgccttgctagatgagacatgcctcacctgaagctggcaggcagccaccagtgtctcttgtacattgctcaggctgagctccagctcggaggtgtatatgaaatgtaggatttggcacatagcattgtaggacacaccgtggatcaggacctcttcctgttccatctccttcaatcccccagcaaacattcctctgcaaagtgaagacacaagaaaatggagttataccaacagggacttaagcccatgttgccaagagtgacagcattcagagaagaacctggcgctggtggcagggccctggtagtgggctgacccactctgtgctctgagtgaactgtgtgcatgcatgagccatcccacaaaaggatcctgacgaagtctgggcagccatcctggaaattgtcctgtttcccttttcatgggcccaaggagtcccatgtgagcttcgggaggtgaggccacaagcagcttgcttctgctgtgttcatcagtgcagttcctggatcggagcagtagcaactccagagcacatttcaaagcaatgaattaattaatgggaaactaataaaagtcatttcattcaatgtatatttatggagttcctaccaaatgccaagtatcattcaaagagcagaaggaggccaggcacggtgactcacacctgtaatcccagcactttgggaggccaaggcaggcaaatcacttcaggtcaggaattcgagaccagcctggcccacatggtgaaaccgcgtctctactaaaaatacaaatattagccgggcatgatgttgtgcatctgtagtcccagctactttggtggctgcggcacaagaattgattgaacctgggagacggagggtgccatgagccaagattgcaccactgcactccagcctgggcaacaaagcaagactgtctcaaaaagcaaaacaaaacaaaaaacaaagagcaaaaggagttatagtgaagtaaactggtaaaatagctgggcgcggtggctcacgcctctaatcccaaccctctgggaggccaaggcaggcagatcccttgagcctaggagttcaagaccagcctaggcaacacggtgaaatcctgtctctacaaaaattacaaaaattggccgggcgtggtggctcacgcctataatctcagcactttgggagggcaaggcgggcagatcacctgaggtcaggagttcaagaccagcctggccaacatggtgaaaccccgtctctactaaaaatacaaaaattagctgggtgtggtggcgggcgcctatcatcccagctactcaggaggctgaggcaggagaatcgcttgaacccgggaggcggaggttgcagtgagccgagatcacaccactgcgatccagcctgggtgacacagcaagactctgtctcaaaaaacatatatacatatataaataaatgctaagaaggaacccagcagggcatctgacctgagagtcactggttagaagaggggtaggtggaatgatgagaaggagcagggaaagccccatctgaggaactgagacctaaggataaggctgagagggtgtaggcagccggggagggagttccaggtgaaggagacaggtgtacaagttctggggcaaggcagagcttggcatgcaaggcagccaagatgatgacgaagtgagcagaaagtgggatgggcaggcaggccttggagccaggtccccctacctctagggtaggtacagtccagattgaaatctgagcattatgggatgctcttgaggaatttacccacagagtgatgtgaactgactggctttccgactcaggtgctggaggaggagcccctggaagaccaattaggcctgagattcctgtgggcctggaggccaagggtgaccctggccctggggagggcattgcagctagaaagcagtagctgagactaccctgggacacggcacagagaacctactgacagactgaatctaggaggacctgggaggactcaaggccctctgctgggccgaagaggaccctttactgatggaagaaaatctggacagctgggagtcccgtgattgtgtgatcagtgtgagatacctgtgaaacctccaagtgtagacactgattaggtgtttggaggtaagaggctggcaactggggctgaagtttaaatatgacagcaacatgaagattataagagaagctatttttacattttatttatttttttgactaggtaatacatatacatgctaccagatttaaaatacagtataggttaggccgggcacagtggctcacgcctgtaatcccaggactttgggaggccgaggcaggccgatcatctgaggttgggagttcgacaccagcctgaccaacatggagaaaccccatctctaccaaaaatacaaaattagctggtcatggtggcacatgcctgtaatcccagctactcaggaggctgaggcaggagaattgcttgaacccaagaggcggaggttgcagtgggccaagatcgtgccattgcactccagcctgggcaacaagagtgaaactctgtcacacacacaaaaaaaatacagtataggttgtggtgaaagtccccttgcctctgctcccagaccatcagtcagttcccctcccagggccacactatcctcagggcagtcatattccacatctcacttggcttttttcttttttttgagacgaagtctcactctgttgcctgggctggagtgcagtggtgcgatcttggctcagtgcaacctccgcctcctgagttcaactgattctcctgccttggcctcccaagtagctgggactacaggtgccccccaccacgcccagctaattttttgtatttttagtagagaccgggtttcaccgtgttagccagaatggtcttgatctcctgacctcgtgatctgcctgcctcggcctcccaaagggctgggattacaggcgtgagccactgcacccagcccggtttttacttaacaatatagcttggagactgatccatgcccatgtacgcaagactgcctcactctttgcaaaggctgtctcactttttttattttattttatttttttaagatggagtttcgctcttgtcgcccaggctggagagcaatggtgcaatctcggctcactgcaacctccgcctcccgggttcaagcaattctccaaactcagcctcccgggtagctgggattacagtcctgcgccaccatgcccggctaatttttgtatttttagtagagatggggtttcaccacgttggccaggctggtctcaaactcctgacctcaggtgatccacccgcctcagcctcccacagtgctgggattacaggcatgagccaccgcgcccagccagctgtctcacttctttaacccatttctacaggggtatatttaggttacttgtaatttccagttatttcacatgatgaacatcctcacccttacaacatgctgagtatgcatatgccaggattaagtcccacaaatacagttgctgggtcgaagggtttacatacatttatactttgatagtattgtcaagttgctgtttttatatcattcctgatagcagggcctggtgcctgcaccctctacccccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctttttctttctgagattattcagaaaacatttccgatattttcctctagtgtttttattattgaatctttcacatttaaaactgttgatccacctgtaatttattttggtataaggtatgaagcaagggtccaactttgtttttctagatggcaactctgtcgtcttccctccttcctctaatttttttttttttttaagacgaagtctcactctgttgcccaagctggagtgcagcagcgcgatctcggctcaccacaacctccacttcccgggttcaggagattctcctgcctcccagcctcccgagtggctgggattacaggcatgtaccaccacacccggctaattttgtattttcagtagagatggggttatcactatgttggccaggctggtcttgaactcctgaccttgtaatccgcctgccttgggctcccaaagtgctgggattacaggcgtgagtcaccgcacccagccccttcctctaatttttgaggctatctttatcacataggacaggaatagtctcctttcgttacttttgttttcgacaatttcctggccactgctagctttttacatttgaattttagaatcaagtttctgtaattgccccaaataaaccctcttggtattttagggggttatgttaaacatctaggttaatgtagagataaatagcatttttataatggacacagtggatctttttaactgtccagccatcctctgggtccatttggaagtcttataagtcatcttcctacagatctggcacatatttgttacatttattcccagacatttcactccatgcatggccaagccctcggggcactttcccatgctctttacagtggtctgtctggctctcctggactttccaggactgtgctcgtgcatgtacttctgtctgattcttctgctggcacctctgggactatattggcagcagtggagatggcaacatttcaagcactgcccgccctgagcagggtgtgggtgcttggattgacacagatttttttttttttttttttttttttttgagacgaagtcttgctgttgcccaggctggagtgcagtggcgcgatctcggctcactgcaggttccgccccccggggttcacaccattctcctgcctcagcctcccgagtagctgggactacaggtgcccgccacgtcgcccggctaattttttgtatttttagtagagacggggtttcaccatgttagccaggatggtctcgatctcctgacctcatgatccgcccgcctcggcctcccaaagtgctggtattacaggcgtgagccaccacgcccggcctttttttttttttgtgacagagtctcgctcttgttgcccaggctggagtgcaatggcgcaatctcggctcactgcaacctccgcctaccacgttcaagcgattctcctgcctcagcctcccaagtagctggaattataggcatgtgccaccacgcctggctattttgtatttttagtagagacagggtttcaccatgttggtcagactggtctcgaactcctgacctgatgtgatccacccacctcggcctcccatagtgctggattacaggtgtgagccaccacgtctggccggacacaaacttttaccattttaagaaaaaaaaaaatcttataatcctttcgggggccaaggcaggaagactgcttgaggccaggactttaagattagactgggcagccaggcaccatggctcacacctgtaatcccagcactttgggaggccgaggtgggcagatcacttgaggccaagagttcgagaccagtctggccaacatggtgaaacctcatctctactaaaagtacaaaaattagctgcatggtggtgcacacctgtaatctcagctacttgggtggttgaggcatgagaatcacttgaacctgggaggcggaggttgcagtgagctgatatcgcaccactactctgtgacagagcaacactgtgcctcaaaagaaaaagaaaaagaagggaaaaaaaaagaccagatggggcaacacagaaagaccccatctcttaaaaaaaattagctgggcatggtggcacgcatccataattccatcaatttgaaatgctgaggtgggagtgttgcttgagcccagtattttgaggctgcagtgagctatgatgacaccattgcccagcctgggcaaaaaagtgagactctgtctcttaaaaaacaaaacaacacaaaaaagttcactgcatggatcatgaatggagggaggagaaagaagatatgagacattgtgggtgcaattaggaaaatctgaacgtggactcaatgtcagatgaaattatagaatgattacacatttctttttcatttttatgtttttagagacagggttgctacgttgctcaagttggacttaaactcctgtgctcaagtgatcctcccacctcagcctcccaaatagctgggactaaaagcactcgccatggaacatggctcaatcataaattttcttatatcatgatagtattacaggtatgtcaaagaatctcctcatccttagagaggcgaactgaagttgttagagataaattgtcatgatatctataacttactctgaagtgaatatgcaaaatgttaactgatgaatttaagccaagagcacagttgttcactatacttaactttcaacttttctgtaggatttaaatatttcaaaataaaaatcagagagaaaaaagagcccaaaagaaaaataaaatatatagtcactcctttttattgtttttctttttcaccaaaaattttaccaaatttaatttttttttttttttctgaggcagagtttcactcttgttgcccaggctggagtgcaatggcgcaatctcggctcaccacaacctccagctcccaggttcaagcaattatcctacctcagtctcccgagtagctgggattacaggcatgcgccaccacacccggctaattttgtatttttagaagagatggggtttctccatgttggccaggctggtcttgaactcccgacctcaggtgatccaccctcttcagcctcccaaagtgctgggattgagccaccaagcccgccccaaacttaattcttttttttttttttttttttttttgagatggagtcttgctttgtcacccaggctggagtgcagtggcatgatctcggttcactgcaagctccgcctcccaggttcacgcctttctcctgtctcagcctcccgagtagctgggactataggcgcccgccaccacgcctagctaattttttgtatttttagtagagacggggtttcacagtgttagccaggatggtctcgatctcctgacctcgtgatcctcccgcctcggcctcccaaagtgctgggattacaggcgtgagccaccatgcccagcctcccaaacttaattctttaaacattcatttttggggctgggcgcggtggctcatgcctgtatcccagcactttgggaggccgaggtgggcggatcacctgaggtcaggagttcgagaccaacttggccaacatggtgaaaccccgtctctagtaaaaatacaaaaattagctgggtgtggtggcaggcgcctgtaattccagctacttgggaggctgaggaacaagaattgcttgaacctgggaggtggaggttgcagtgagccgagatgatgccactgcactccagcctgggcgacagagtgagattctgtctcaaaaaaaaaaaattcatttttggctcacggcagcctcaacctcctgggctcaagtgatgcttctgcctcaacctcccaagtagttgggactataggcatgcaccatcatgcctggccaatttttaaaaaaatatattaaaaaaaaattattactacttttctgtaagtcaggaattatgtcaaaataaagacttaaaagttttaaaaagttgttcacacctcatatccattaggatgaccactataaaaaaacaacaaaacaaacaaacaaaaagtaggccggatatggtggttcacatctataatctcatgtccataatcccagcactttgggaggctgaggtgggaggattgcttgagcccaggagtttgagaccagcctgggaaacatagtaagattctgtctctacaaataatttttttaaaaaactggccaggcatggtggtgcatgcctatagtcccagctacttgggaggctgaggcagaagcattgcttgagcccaggaggtggagccatgatggtgcccctgaactccagcctaggtgacagagcaaaatcctgtctcaaaaaacaaaacaaacaaaaaaccagaaaataacaagctttagcaaggatgtggagaaactataacccttgtgcactgttggtgggaatgaaaagtggtgcaactgctatgttcctcagaaaattgtcaatagaatgatctagcaattccacttctgggaatatagccaaagaactgaaagcagagtctcagacatttgcacacccatgttcatagcagcattatacacaatagacaagagatggaagcaaaccaagtatcccttgataggtgaatagacaaacaaaatgtggtatatccataaaatggcacactattcagccttcaaaatgaaggaaatcaggtcacatgttataacacacatgaaccttaaggacacgatgccaaatgaaataagcaagtgataaagggctaatgctgtatgattctacttatgaggtacttagaatagtttaattcatagagacagaaagtagaatggtagctgccagggcctgggggtaaaggagaaaagggagttgtggtttagtgggtatagagtttcagatttgtaagataaaaaagttctggagatctgtttcgtaataatgtgaataatcgtaatattactgaactagatggtaagtgttatttgtgtttattattttagaaccacaattttaaaaaattgttcaccaagtacccagtagcaggggaatgaccaaataaatagaggacatcgacagcacggaacactccacagcacagagagtgagggccatctctactgctggtgcctgggacctccaggatgtcacaggtacagaatggcaaaccagtatgctgcctctggtgtgagatgggggagaaaaatatttcttgggtcagcttgttcaggtcctcgatcccttgtccaaactctttaaatcaagtgtattttagaattcagaaggttccaacgtgagaaatactgtacacatgccacataggatcttatatcccacgggatctgggtcggtgcctcctcttcaaacaccttaatatgccccccaaaaaagtataaagactcacactaggataaaaaatataattagcctcgaaaataattttgagttttgggtgggttccgtggcttaatgagtttacgccaaacttttttttttttttttttttttgagacggagtcttgctctgtcgcccaggctggaatgcagtggcgcgatctcggctcactgcgagctccgcctcctgggttcacgccattctcctgcctcaacctcccgagtagctgggactacaggcacccgccaccatgcccggctaattttttgtatttttagtagagacggggtttcaccatgttagccaggatggtctcgatctcctgacctcgtgatccgcctgcctcggcctcccaaagtactgggattacacgcgttggccaccgcgcccggcctacgccaaacatttctttaagacgtttggctgggccaaagttagctgagttatttcagttgattgttcatagtcagtaacagatcaaactcattcgtctctgtccccccttctcactactgcacttaactagtctaaaaaataataatagataaaaataggccgggcacggtggctcacgcctataatcccagcactttgggaggccaaggtgggtggatcacctgtggtcaggagttcaagaccagcctggccgacatggtgaaaccctgtctctttcaaaaaatacaaaaattagccgggtgtggtggcatgcacctgtactcacagctactcaggaagctgaggtgggagaatcacttgaacctggtaggcggaggttgcagtgagcagggatcatgccactgcactcccgcccgggcgacagagagagactccatctcaaaataaaaaaaaattaaaaaaaaatttttttttcttttgtaaacggagtcttgctctgtcgcgcaagctggactgtagtgggaccatcttggcttggctcggctcactgcagcttcaacctccaggctcaagcaatcctctcacctcagcctcccaagtagtggggactacaggtgtgtgccactgtgcccagctaatatttgtattttttgtagagatagggttttgccatgttgcctaggctaatctcaaactccaggactgaactgatctgcccaccccagtctcccaaggtgctagggttataggtgtgagccaccctgcccagccccaaaagttttttggtttttgtttgtttttgagagatggacccttgctatggtgtccaggctgcagtgcagtgacatgatcccactactcaacagcatgggagttttgacctggtccatttccatcctgggccggttcacacctctttttaggcaaccctgctccaggaaggtcaccatattgatgccaaatttagtgtggataccctgttggcatggcacactgcaacccagaacttctgggctcaagcaatcctccggcctattctcccaagtagctgagactataggtttgagccaccacgccctgctcaaaaaactttttaactgtgagaatggatgctgaatgttatcacatgcctgctcaccatgtctgcagatatgctatatagacacgtatgcagatatgttgggttgtcatgaattgatggaatgccatgattccctggcatgtaactagtaagacagattccctagcatgaaaccaattttttttttttgagacaaggtcttgctgtgtcacccaggctggagtgcagtggcacactcacaactcatggctcactgtagccttgacctccccaggtttaagtgatcctcccacctcggcctccccagaagctgagactacaggcatgcctggctaatttatgttttgttttgtttgtttgtttttctttttttttttgagacggagtctcactctgtcgcccaggctggtgtgcagtggtgcgatctcggctcactgcaacctccgcctcccaggttcaagcggtacttctgcctcagcctcccaagtagctgggattacaggcatgcaccacaacacctggctaatttttgtatttttttttgacctctgaactttttattggcctcctgctccccaaaggataccctgcttctggtggcttaatgtctcagaactttggtgtcattggtctcagacaccactttgccatccattatctggcaggtggtggtcttttggatggtttgcatggagttgctgctgtccagggcatcaccaagactgaagtcctcgccatcttccagcaggcggcagtaggtggtgatcttagcctccagcttgaccttaacgttcaccagggcgtcctactcctaggcctggcactgtccctctgcccggatttgtgccacctctgactccaggtgcagcaggatcccattgagctgctccatctacagggcatagaaggcctccacctccctgaggctgttctacaagctggccttcagatttctcaaggagtccaggttgatctccaaggactggacgtacgtctcaactccgtgattgtcatctcagcagttccaacctcagtggactgcatggtgaccactgtggtgctctcctcaatctgctgagaccagtacttgtccagctcctgtcgtttcttccgagccagctcatcatattgagcctggatgtctgccacgatcttggcaaggtcctgagatttgggggcatctacctccacagtcaacccagagctggcaatctggtcttgtaggccttttacttcctcttcatggttcttcttcatgaagagcagctcctccttgagagcttcgatctctgtctccagctacagctgagggacattggtgtcatcaatcactttgcgaagcccatgtatgtcgctctccacagactagtgcatgggcagttctgtctcatacttgactctaaagtcatcagcagcaagacgggcattgtcgatctacagaaagatacgggcgttgtccacagtatttgcaaagatctgagccctcaggtcctcgatggtcttgaagtaatgcctccagtctctgatctgggtcccttcttctccaagtgcttctggattttgctctccagcttccggttctcggtctccaggctcctcgctctgtccaggtaggaggccaggcggtcattcaggctttgtatggtctccttctcattctggatgcttcccattcctgccagatccccagccatccccgcggccaggcccccagaccccatgcagccctggaagctggtggagcgggacacgaagatccaggaaccagagccctcggtgcctgcatagacgctggccacgctgctgaccagccaggcgccatagctgggagcctggacagagcccagggaccagtagttggtggagaaggtagagcgagtggtgaagctcatgctgtccggggaggagagcaagaggacaggactcaggctttgctgatgacctaatttttgtatttttagtagagacggggtttcgccatgttggccaggctggtctccaactctggacctcaggtgatccacccgcctcagcctcccaaagtgctaggattacaggcatgagccaccgtgcccagctttgtttgttttttgctttttgaggcagaatctcactctctcatccagtctggagtgcagtgacgcgatctcagctcactacaacctccacctcccaggctcaagcgattcttgagcctcaccctcctgagtagctagaattacaggtgtgcaccactacgcccagctaatttttgtatttttagtagagatgggtttttgccatgttggccacactggtcttgaactcctggcctcaagtgatctgccggccttgggcacccattgtgctgggattacatgcatgagccactgtgaccagctctaatttttgtattttttgtaaacatggggtttcgtcacgttgcccaggctggtctcgaactcttgggctcaaacaatctgcccaccttggccttgcaaaacgctgggattataggtgtgagccactgtgctcagcctttttttttttttttttacgagaaaagaggtctcttactttgtcatccaagcgagagtgcagtggcatgatcatggctcactgcagcctcaacctctcaagctcaagctatcctccctcctcagcctcccaagtagctgggactataggccacgccaccatgcccagctaattaaaaaaaatttttttttctttttctgaaactgctctgaaaaaatttaaatggcattggagtcttttcataaaaggcacacctaccctggaaaacatctgggctttgtgttttgtggggaatacaactttctctctcttttggggataaagtgctattaattttttaaaaataaaatcatcaattgtatccaaacttttaaagtaacagacattgagttcagctaagcagtcttttataattcacagatggaatgaaaactaagggagggacgaggtgacccatggaggttgtataaaaaggacagagcctttgggctcttcagactataagggtccaggaggagaggagaaaccacctcagaagcatacaaggttaaagcatacaaggtgggtgtagggtcaggggagccaaagtaagtgtgcaatgaaaagttattaacaaaagtcaaaaaaagaaaatgcagtctggccatccaattcctaaaccatgtacagagtacacagaaagagcacaggaggcttcctgcagcagggcagtacagctctctgcccttcaggaaaactgagattcctccacctgggaaacagcaagggacaattagggaaagctctccagaggaggaggcatctcaggtgggccaaagaagaaaaatttccacaggacagaaaaggcagagaagaggccaggcatggtggctcacgtctgtaatccgaacactttgggaggccaaggcaggcggatcacctgaggtcaggagttggagaccagcctggccaacatggcaaaaccccgcctctactaaaaatacaaaaattagccgggtttggtggcacacgtctgtaatcccagctactcaggaggctgaggcaggagaatcacttgaacccgggaggcagaggttgcagtgagccgagattgccccactgcacttcagcctgggggacagggcgagactccatctcaaaacaaacaaacaaaaggctgggcgtggtgtggctcacacctgtcatcccagcactttgggaggccaaggagggcaaatcacaaggtcaggagttcgagatcagcctggccaacatggtgaaaccctgtctctactaaaaatacaaaaaattagccgggcgtggtggcgcacacctgtagtcccagctactcgagaggctgaggcaggagaattgcttgaacccggaggcagaggttgcagtgagccgagatcacaccactgcactccagcctgggtgacagagtgagattccgtctcaaaaaaaaaaaaaaaaaaagaaatttatgttctttgtaaaataattcagacaatgcagtaaacagaagaaattcagcctccctctccctttgccctttgctgagtccccacggtgcagcaagatccttccagatcttcatggttgggatcatcttccaccaggtcctgaggtttttcactccctatcagtagacacaccacactgcccagtttgcaagtagctccattggataacacagaaaggctctgtcctgcaccatgtctcagcactgggtgcatcgtcccacaggaatgacacctagacacccaacatacaactgcagggccctaaactatgggccagcccacccctaaatgcccttctctctacccttgcccatatcaaatattacaagcctctcacacatatttaccagtcatactgggaaaaaaatagtcctttatcattttaacatttcacaagtaactaaaacaaataataaacatgctaacacttgggaatggtctatttcttttctttttttttttttttgagacggagtttcattcttgttgcccaggctggaatgcagtggcgcaatctcggctcactgcaacctccgcctcccgggttcaagcaattctcctgcttcagcctcctgagtagctgggattacaggcatgtgctaccacgcccagctaattttgtatttttagtagagacagggtattgccatgtgggtcaggctggtctccaactcctgacctcaagttatccgccctccttggcctcccgaagtgctggaattataggagtgagccaccaagcctggcctctttctaggctcactgcaacctccgcctcctgggttcaagtgattctcctgcctcagcctcccaagtaactgggattacaggcatgtgccaccacgccccgctagtttttgtatttttagcagagacggagtttcactatgttggccaggctggtctcgaactactaatctcaggtgatccacccgcctcggcctcccaaagttctaggattacaggcgtgagccactacatccagcctcttttttgtttttttgaaacagggtcttgctctgtcacccaggctggaatgcagtggcacaatctcggctcactgcaacctccgcatcctgtgttcaagcaactctcctgcctcagcctcccaagtagctgggattacaggcgcccaccactacacccagctaatttttttttttttttttagtagagacagggtttcaccatgttggccaggctagtctcaaactcctggcctcaagtgatccacctgccttggcctcccaaagtgctgggattacaggtgtgagccaccgtgactggcctctatttcttatttatacatacacacacacacccccctgtgaaatgactctgggctcttccaataatgttgccactctcccgctccccttcccaatggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagcgaaaggctgcctacactgtcatcttcagaaagagtggtatgacactaaatcaagaagggctgagagggtgagcccaggggatcccataggctccacagcctctggccatcctctcctatacaggtcctaagtcccctgcagggggccctcagctcctctaccctacccactgtcctgtatgttatcttaatgcttattaaaggcctcagctgaatttccctggtgaactgaaagaattctgctgctcctggacacatctgcaccaagccaccactgggtcacattctccaaaactccttttggagacagaaggcacttaaaccatacatattttgcttgatagttcctaattaaaaaaatagagagagataaagagaaagagagagagagagaactacaactaagccttgaagacaaaatgattgaacagaatcagagctagaatggaacacctcaggcttggagtcccatgacaaccttgctggggaccacgagtggccctcagtccttctcaggctcatgccacctatgtgaaataagggtggtgacacccacctccttgagtgcagagcagtgcagacaacagggcaaatggtgtattgatctgctatctgtgtacataaatttattcatttaagccatgggtattgtttgaatatgtgaaaaccatgtcaggtgctagggataagagacagattccaacccagtggaaaagacagataagccagtggttcctcacactgtgccaagtgctgggatggggtcacgaaggaggccataagaaaccccagaggggccacagagctcactgggagggccagaggctaacacctgagggatgagaggtgtgagccagaaggtgatgcatacacagcaataattactgacggaggggaggaatggtaagggaggggaggagagaaaggaggaaagaaaagagaaaagaaaagagagagaaaaggaaaagaaaaggaagagaagagagggaagagaagaggaggcaaagcccaagaaacaggatcactgaatgaaaaatgaactctaagacccccttctgtctctcacacttgttgactaagtcatagccacaaggagtaggggaggctctgaggtgagcaggagaccagccactgtcaccgccagtacctttactagcagagccaggattacctttgttattcttcttacaaacagctctagtgaactcacctgaagtaatcgcaggacgcagccagcaggatgcgatgggcctcgatgtgtctgccctccaccaccagcacaacatcgaagaggattccgctgtcccggagagccagcagccctcggagcagagcctgggagtgctgtgcgctgcggtaggtgttgttcacgcagtgtgggtgtgagggctgtgcaggcaacttgcagagctgggtgaactcctgctcctctgccatcctgacagccacaagatcccttacaactgtggcctgacagttggcaaaacaggggacaggggtgagcaggcaggcatcagccccaccacacacagactggccagctctgttgctccccttgctcctgtgcctccctcaggctcacctgttttccctctatttccaaatcccctaattccttctcccctcccacctctagtccaacttcctgatggccttcttcctgatgacctgtgtgccatcatgcccaagactcttcatctcattgtatcttcttcagcggcaaagtcaaacagaagggttttgggaaacagactgacctgggttggagcccaactccacagggacttacaacatgaccaaactgagcctcgagctccccaattttaaaaagagagataaaagtacctaccccattggggtattctaaaattggtaaaacaatgaacatgaagcataagcacacaccaggttctcaagagctcttcctccctcccattgaatgaacaaaattgggttcttcctcatagtaatggatgcataaaaatggcaagacctgagtagtggtcaggagacacacagccaggagtctgggaggtgggtgccaagggggtggcatttccagggcctactttcctttactgaaattctgagagtcaagcacagtaactgtgattgaacctgatgcatttaaattcatctgcattgccttttaaattaaagattatcttctaataattgagtcagtacgttcaaaaaccgcaaactgatttgaattggagcctctaaaacctaatcagtaaaatgaacctactgcaaatgcacttttgccatggagcaaccaaaagtgactgtggatagccagctgttcaggtcagggagtggccagtcccacactgtgaggcatggccaagctgcaggctctgtaggcacagcacagtcagctacaagatgtgaacatctgtcttctccacctcacttcatcctactttcctctccccaaaatatgtttattctccaattacctccagtcatgcatcacttaatgttggggatacattctgagacttatatcgctggaggcaatttcctcagtgtgtgaacatcaaagggtacacctacacaaacctaggtggtagagactactacacatctaggccataaggtacagccaattgctcctaagctacatacttgtacagcatgttactgtagttctgaatgaaaaaaacacactgtttttcctctcctcttataccacaacaacaaacacaggagacttctgtgaccaaatgtgtgagggtttttccccattaacaagcaagcaatcaattctgccacagataccagctgggtgtcttctaattcagcagtccccaatctttttggcactagggaccactttcttggaagacaatttttccacggggtcggggaatggtttcgggatcaaactgttccacctcagattatcaggcattagctagattctctttcggagcacacaatctggacccctcacatgcatggttcacaacagggtttgtgctcctatgagaatctgatgccacctctgatctgacaggaggtggagctcaggtggtaatgctggatcaccctccactcacctcctgttgtgccacctggttcctaaccagccacagactgatacaggtctgaggcctgggggttgcggacccctgctctaattcaactctaacactacctggagacagtgtctgatcccacaggttgagggctgagtctcccaggttgtttcacctgtgcttctgaccaataggctataaattgggttcccaagatccccttcttgggttcaactaatttgttagagcgactcacagaactcaggaaaatactcatgtctactggtttgttataaagggtattgcaaaggatacagatgaagagatgcatggggccagacatgtgggaagtggtgcagagcttccaggccctctccaggaacatcactctttaggagcctccatgtgttcaactatccagaagttttccaaacccagtcattcagaatttttatggaagcttcattatgtaggcatgactgattaaatcactggccattggtgatgaacttaatcttcagcctgtctcccctctccggaggttgagaggtgaggctgaaagtcccaaccctcttatgcctgccttggcctttcctgtcaccagcccccatcctgaagctacctaggggctgctggccagcatacaaaaaggcatcactctggaaagtccaaagattttagaagttgtatgccaagaaatgagacaagaccaaatatatatttcacaatatcacagtactgaatactataggcaactgtaacacaatggaatttgtgtatctaaacacagacaaggtacagtaaaaatatgggaccaccatccttcatgtggtctggtctgtcattgacggaaacatcactgtgtggcacatgattatatatctttaaaagaaaaaatgaaaaatatatgctgatataaaacttgccaaaaagaagaggtctctctcttcactactgaggctcagggccacccccaaccccatcccctggatgctctactgcttcccatcaaacacactcagttatctgtgcctgcccctgagtctgcctccaggacctgggacctctatccagccacccacccattcctttccccctcctgggctggctcatctttctcaccaaggccccagagatggccacagccaaggtgtataccccatgaccacctctcacttaggattctcttgcctggaaactctgctctatgataattctcccttttctgacctctctctttcatcccacacaccctgctcgagcccatccttctttcccagtggttcacattcccagtttcacctacagctcagtgcctaatctagctagtagccctccaacttgtctaattttactatcaaagctaccatttccatcttggaaacctcactgttttaatatttttcctttctaacccatgtgccctatgaacctactagttctgattccttcacctctcctccatctcagacagccaccctccactcctccagggccaccactctgggtcagaccacagcagtgatgcccctaccagtttccctacctcttgtctcatcctccccaggctgctctccttcaagccttacctactcagccccatcagcagtccttagtccaaaagggatacctgtcatcccctgaacacctttagtcacccatctaggccattctgtctctcatagtcccatattggtcaaggtctagctcgattacttctccctctatcattgtacagagaacatgacaaatatgccccaccattcaaacctgcccttttttttttttttagacggagtctcgctctgtcacccaggctagagtgcagtggtgtgatcttggctcactgcaacctctgcctctcaggttcaagtgattctcctgcctcagcctccccagtagctgggattacaggcgtgcaccaccacacccagctaattttcttgcatttttagcagaaatggggtttcaccatgttggtcaggctggtctcgcattcctgacctcaggtgatccatctgccttgacctcccaaagtgctgggattacaggcatgagccaccgcgcccggcccaaacctgcctatttacccacgacaaggagattccggcttcttgaggggtgaggttttatctcacaaacatctcaaaagcccccatggctggctgtaccacttgctaatgacagactctgggcacttgtctcatatacccacgcctcagctttctcatcaccaccatgaccaccgcagagtcaagagggcctccttctctgagggtgacctccacaactaccccaatagacatcaagcccccaggtggatcctcaccttccgtgagcatagtagtgcctctgctctcttgggaagggataaatggcagctactccctaaacccatactgcaaaaacaagtacggtaaaacagaaagacatcttccatgggcaggcaaagcacatttaccaagtccaatttaagaaacttagctaggggctaagggggatatgctgaaaaatgaatcaattctctgctgggaaggagcacagcacagggtgcaacatttaaaacatttaaaaccacatctatacggttttaaatcaccaaaacgtccaccctcaggagaacagatgtcatggcacagtgatctgacagaacattaggcaacagtcaaaatgcgcaaagtggccgggcgcagtggctcacgcctgtaatcccaacacttcgggaggctgaggcggatgaatcacgaggtcaggagttcaagaccagcctggccaacatagtgaaaccccatctctactaaaaatacaaaaaaattagccgggcatggtggtaggtgcctataatcccagctacttgggaggctgaggcaggagaatcacgccactgcattccagcctgcatgacagtgcgagactccgtctcaaaaacaaaaaaacaaacaaaaaaacaatgtgcaaagtaggctgggcacagtggctcatgcctgtaatcccagcactttgggaggccaacgtgggaggatcacctgaggtcaggagttcaagaccagcctggccaacatgaggaagccccatctctactaaaaatacaaaaattagtggggcgtggtggcgcatgcctgttatcccagctactgggaaggctgaggaagggggaagctgaggcaggagaatcgattgaacccaggaggtggaggttgcagtgagccaagattgtgccattgcactccagcctgggcgacagagccagactttgccccccccccaaaaaaaaaagtgcaaagtaggctgggcatggtggctcatgcctgtaatcccagtgccttgggaggtccaggtaggtggagttcaagaccaccttgggcaatatagcgcgaccctttctctacaaaaaatttaaaaattaactaggcatggtggtgtacacctgtagtcctggctatctggggtgagacagcttggggttcactgcagtctcaagctcccaggttcaagtgatcctcccacctcagcttcctcagaagctggaacaacaggagctcaccactgcgcccggctaatttttcaaattttctttgtagagaagaggtttcactatatggtgtaggctagagtgcagtggtagggtcttggctcactgcagccttcatctcctgggttcaagcgattctcctacctcagcctcccgagtagctgggattacaagcacgtgtcaccacacccagctaatttttgtatttttagtagagacggggtttcaccatgttggccaggctagtctctcctgacctcaggtgatctgccagccttggcctcccaaagtgctgggattacaggcatgagccaccgcgcccgcccccagtctcatatccccaattttagtcatcacaagccaagttccccgttttgtactgttcgaagtttcagtggggagaagaaaggaagcttaatgtgccacatagctacaaactgaaggatacaagatgaatttttatgaagtgatggatggcagagtcaaaatcatttcagaggaactttcagttcggtacgattttactgagtagataccctcagccttctgtagggcccccgaacgagcagtatcccctcaaagaaactcaatccttggcagcatgaagcaaggtcggccacaaaggcaaagggggcggctgcggtagaggagagggagtgggtgctgattcccagcggggcagccttccaaagggtgcgctctggaagaatctcccagggagccgtcttggaggcactcggccccgcggagggccggagcgagggcgcccagtgaggagcccaggcggaaggtggcggtgccccgctgcccgccccagatccactcggctcggcccgcaccggatctaaaatggtcagaactggcagccgacgcttcgcgctctggtgattttgcactgacagcgcgatctccggctcctctcaggaaaccgggagagctggcaaggctgggctcctacggctgcagtccccgggcccgatcgagggaactgaggctcgtcaggccggccccaaatcgcccgcctgttgcaaggccgcccgctccagcgcggagggtcgcggccaggaaggccgcattcggacctgccgcaggcaacagggcccgcccgggtgccaggaggccggcgcgccagcagccgcgctgaggaggcctcgcaccctggcccctggccgagcgccagatcccggcccctacgcgcccgcgcccggggatcccgccggccgcgtccccgccacgtcaggccgcgggctctcctcaggtcgccgcccccgagcctccggcccgcgcccgcccccgcgcccctcggactccgcgccgctagcttgtccccggcccagcgatgcctgcttgccgcccgacccccgcgttcgctgccgcccggcccgttcggctcacgcctcgcagctgacctggtgccgccgccagccgaggccgcactcgcagctggagggaggcgggaggcgggaggcgggaggcgcgaggcgggaggctgggcgagaggagccggcggggcgggggcctgggccgtcacgt

SEQ ID NO: 553 - DNA, 54365 bp, Homo sapiens; identical to SEQ ID NO: 552

SEQ ID NO: 554 - DNA, 80034 bp, Homo sapiens
ggtttgggcctggctctgtgactgaggcggcggcggtggcggccaagcgggatacgggcggcgggagctggggaacaggcatggacgtttccgggcaagagaccgactggcggagcaccgccttccggcagaagctggtcagtcaaatgtgagtagtggtcggggcagggggctggattgtgggaccttcctccttagcgtggcgggcgaggccagggccggacccgtgagaaacctacggcgccgggagacagaaggcgccggggacttgcgtgggtcccagggctcgggcccccccgtctgtcccctccgttcccgacatggactgctcgtttgctttcctggggccgagctctgcaaaccaacgagccctggcttatgaatcatcgtcttgagctttctcattcgtcatttgtgtgctttgggtgcagactttcccccgctttttgaaccacactgaatagggaaagggagagaagcagccggctgtagtgggtttagcagggctgggtgcttcatggtttctcttccagaaaagcgcatcaacggtgaaagaaagtgatgggaggagggtggatgtaagatgagattgggaaggtagttgtttggggtgtgggcggtgggacggaggatctgagggtgaccccccgaaggaatgtggactttgccgaaggatggcaggaagccgctgtcaggaagcgatcgtcgtttctggaggagagcgtgaagagctggggtcagtggccccgctcagaggaactctagcccctcaccaccgactgcttgtttctgttagcagtttttttcatgcgcgtccgtgtgaagagaccaccaaacaggctttgtgtgagcaataaagctgtttatttcacctgggtgcaggtgggctgagtccgaaaagagagtcagcgaagggagataggggtggggtcgttttataggatttgggaaggtaatggaaaattagtcaattgttctctggtgggcagggatggatctcacaaagtacattctcaagggtggggagaattacaaagaaccttcttaagggtgggggagattacaaagtacattgatcagttagggtggggcaggaacaaatcacaatggtggaatgtcatcagttacggctgtttttacttcttttgtggatcttcagttacttcaggccatctggatgtatacgtgcaagtcacaggggatgcgatggcctggcctgggctcagaggcctgacagtttttaactgagcttattggcgtgttgtgctcgccacagatttgcctgagacacagcccctttcctgagggatggtaaaggaaccgtcacagcgcagtcttgtcagtctgtaatgtgtatactgcaggggtttcttgcgaagcggcggttaacttgagcagaccaggggcagtctagtgagtaggtgacgaataaattgagtcctagaaagacaagtaggagtgtgaatagccaccattccaagctgaggagttaggaaacatgagcatttactgcgtggagggaggatcttgtaggctgagagttctggggctcgaggagtaagagagcccaggagatgatggaatgagggtgagcaggtactagcactttagtgggggtgttgtgccaaggaattgagcctgtgtttggcatgtggcattctttggagtagtgaaatgccagtgttgggaatatgcctagagtccctgtccctggagatggatgcagggcagagaagagagaccagttaagctattaagagagtttgaacatttggagggagtagggaacctgtcctttttcatccttatattctcactgctagctcactgcctgccacattgctccgtaaaatgattgtggcatgacctagtcgggcgggagattataaaggcctgcattagacagtggtagaaactgaaagaggaagacagattccagaggagggggaacgtagacaattcttgatgactaactggatggaggggggtggggtgtggggtgaagcattgtggaaggaaggaagccgggctgaatgctgggaaacctttcagtacagtggaaagagtagggactgtagagttagtagctatgggctttgggaagaatagccttgggatatttctggggatattgcacaatcagtgaacagtgttttactgataaaatatagttatctgtaggtgaaaacttgagagatatcccacttcagggttcctgcaagaaaagtccccagggcaagggttcttctctgggaaagcccagaattaagaactggaagggtgagttgtcatcaaagaaaatgggggtaggggaagtgttaagagggctgggagggtgattgaagagtttatgggtgttgagtgactggatacttcataactcagctttattttgcttccgggagaattgagttctttatttttttcgatattgctgtttgtgtgtttttctgttgccgctctaacaaattaccacaagtttagcatcttaaaacaacacacctttagccaggtgtggtggctcacgcctgtaatcccagcactttgggagactgaggcaggcggatcacgaggtcaagagactgagacccatcctggccaacacggtgaaaccctatctctactaaaaatccaaaaattagctgggtgtgatggcgcacacctgtagtcccagctactcaagagtctgaggcaggagaattgcttgaacccgggaggcggaggttgcagtgagccgagatcgcaccactgctatcccgcctagtgacagagcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgcatttcttactgaatgccttggggtggaacttgcttgcaagcccatttatgctgttggccatattcagttccttgagcttgtaggactgaggtgccctctttccttactggctgttagccaggagtcagtctttgttcccagaagctgcccgaattccttctcatgctttttatgtgtctccctccagcgagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaattctagacatacctttaactcttaacttcctcccatgtttttacactgttgtttaaatttggccattttgggaaatgctttatacccaagtaatttatagttgatgaagggatagagaaagtgtcttgcttgtggcaccgtgactcacacctgtaatcccagcaccctgggaggctgagatctgggactacttgagtccaggagtttgagaccagcctaggtaacataaacaaatacaacaatcagctgggtgtggtggcgtgcactcgtagtcccagctactctggaggctgaggtggggggatcgcttgagcctgggaggtcgaggctgcagtgagctacgttcacaccactgcactccaacctgggccacagagcaagacccttctcaaaaaaagaaaaaaaaaaagcattctgagttttgacagagaagaaaacatttgatggttacttatctgtctctaccaagagcctagggaacaatgccccagagcatgagctggtatatagtctagtctcctggctcccactgagaaaaagggattttgagttgaggctggctatgactagacagccattgcagggactctccagttcagcctcttagccctccactgcctccacctcatctgggcccattctgggctgtggtctcctgctctcttcccagtcccatccttcttcccccaacagcacaagtgagggtgaggcctaaagtgtagccactgccctgctgcagaacaatcagtgacttttcttagcattagaataaaactccagatgtcccaccctcccagcccctcaccctgacctggtatagtcatctcttctcctacccccaccgtgttctgacctctctggtctttcagcttcttgaacattctaagctttttttttttttttttggagacaagatcttgctctgtggcccaggttagagtgcagtggtacgatgatagctcactgcagccttgacctcccagggtcaaacgatcctcccactgtagccttctgagtagctgggactacaggcacacaccaccacgcctgactgatttttatattttttgtagagatgaggtttcaccatgttgcccagactggtcttgaactcctgggttcagatgatcctccctactagccttccaaagcactgggattacagatgtgagctactatgcctggcccctgagctctttctttttaaccaatttattatcaagtgtttaaggtattgaaaaatgagtagactcctccccaccactgtattcatgactagctccttcttttaggtgtctgctcagtatcagatactcagaggatccttccctgcttgatctaaagttggtcaccgcctctgatatgttttatctcagccctttttagtttcccataggacctcatacctatgaagcttggtacctggtatacaaaacacttgttgaggagtggaatagtattttcttgggggctgtgtgagtcacctcttttttttttttttttttttttgaggtggagtctcgctctgttgcccaggctggagtgcagtgtcacaatctcagctcactgcaagctccgcctcccaggttcacgccattctcctgcctcagcctcctgagtagctgggactacaggcgcccgccaccacgcccagctaattttttttttttttgagacagagtctcactctggagtgcaatggtgtgatctcggttccttcaacctctgcctcccgggttcaagcgattctcctgcctcagcctcccgaatagctggggttacaggcatgcgccaccaggcccagctaatttttgtatttttagtagagacggggtttcaccatgttggtcaggctggtctcgaactcctgacctcgtgatccacccgcctcggcctcccaaagtgctgagattacagacatgagccaccacgcccggccgggtcacctcttgtattacagtggtattctttatttttttatttttttaagagacagggtcttgctttgtcacttgggctggagtgcagttggtatgatcatagctcactgcagcctcaaactcctggactcaagtgattctccagtgcagtggtattctttacctgaaccagtgtacattgtgaagctctggagcccctgctttctccacttgttacacttgttagcctttctttttctttctttttttttttttttgagacggagtctcgccctgtggcccaggctggagtgcattggtgcgatctcagctcactgcaacctctgcctcccgggttcaagcagttctctgcctcagcctccagagtagctgggattacaggcacccgccaccactcctggctaatttttgtatttttagtagagacggggtttcaccatcttggtcaggctggtcttgaactcccaacctcatgacccacctgcctcggcctcccaaagtgttgggattacaggcgtgagccactgcacctggcctagcctttcttaatcgtgtccctcatcaatgaaatggtagaaagccaatctgttttacaggtgtggtagaagggaaaaatgaagagacctctgtacaagcctttgcagaggtcttgggactcagtggtgagctccctgccaccacctcctgtgcccttgcaggagtaggagatctatagtcttggagaataagggtgataccccaataccccaagcctggttagggaaattgatgacccttattggagcctgtggggaggtagttgggaaattgttagtagcttcatgttggcattttcttttttgaaacagaatcttgctctctcctccaggttggagtgcagtggcatgatcttggcccactgcaacctctggctcccaggcttaagcgatcctcccacctcagcattcccaagtagctggtactacagacgcatgccaccaggcccagctaatttttgtattttgtgtaagagacagggtttcaccatgtctcccaggctggtcttgatctcctgggctcaagtgatccacctgcctcagcctcccaaagggctaggattacaggtgtgagccaccgtgcttgcctttgttgactctttattgaacatctactctccctgcagaaactgcaggataagccacccttagaaccaatttaactggcctttttggggcttggaccttcctcatgggattgctgggttaatgttgagcctgtctctgggctataggctctcagagaacaagagtgcatctgcaatgactagtgctgcacctgtcatacaggtttgtagaaaatatttaagctgtgaatgaacaaaaggaccttatcagctattttctttcaattctttttggtttttctgtgatcctattcttgagacttttatccctcccacccctctgtacagcagattgcacatataaagatgaaataaatagatgtccattgggcaaaacaatacagagaggaggtgacacagctggggaaggacagtccagtatctgatgaagtgccagaaggggcttagggggagcatggaatggagctggaactgccaggtcagccacctcttctagtgaagcctccagagagacgtgagctccaagtaagacaacacaaggaacaaaacatacaactgaacagcaacttccaagggtctggagaggtcttcagaaggatagggagtgcccttaaacttgcaagcccagattctgcctgtgggtcatggtcgtgccataggcagaagccagtgagtcagccttggcggagctttttctgtggcttttcccactcacagctctgtgcccttctggtgcagctccagcccttgttttccagcttcatagcctggttgtcacataaatggctgcactggcttacaggtgtctgtgtataacctattgctagaatgtccattccttgaggctaggggccctgtctgtccctctcttcactttcatagccccagtgccccatagggctgctcctgatgggcaaataggaagtggttgttgagcctctaggccagtcgtgacagtgacctgaggggacttgagccctcagtcatctgctcaggagttcagggctttctcaacagcagctgacgtgcggcaggcatgctatgccaagccctgttgcaggagttgacagatgttgactcatcccctcttcatgctttctttgtcagtagatgtacatgttactcacatttataagatgaggaaaatgagacctagaggagaggccactgctgcttagagttactctacatgttgtaaatcaggggtgtccagtcttttggcttccctgggccatgtaggaagaagaattgttttgggccacacataagatacactaacactaatgatagctgacgagctaaaaaaaaaaaattgccaaaaaatctcataataaagtttacgaaggctgggcgtagtggctcacgcctataatcctagcactttgggaggctaaggtgggtggattgcttgaggtcaggagtttgagaccagtctgggcaacatggtgaaaccccatttctactaaaaatacaaaaattagctgggcatggtggcgggcacctgtagtcccggtggggaggctgaggcaggagaatcgcttaaacccgggaggcagaggttgcaatgagccaaggtcgcgccactgcactccagcctggcgacagagtgagactcagtctcaaaaaaaaaaaatatatagaccaacctggccaagataataaaacctcgtctctactaaaaatacaaaaattagccaggcatagtggtgcacacctgtagtcccagctacttgggaggctgaggtaggagaatcgcttgaacctgagaggcggaggttgcagtgagtcaagatcacgccacttcactctagccggtgacagagcaagactctgtctcaaaacaaacaaaaaaaattaaaaataaataagtaggttgggcgcggtggctcacacctgtaatcccagcactttgggaggctgaggcgggcggatcacctgaggtcaggagttctagaccagcctcaacatggagaaaccctgtctctactaaaaatacaaaattagctgggcatggtggtacatgcctgtaatcccagctactcaggaggctgaggcaggagaattgcttgaacctgggaggcggaggttgcagtgagccgagatcacgccattgcactccagcctgggcaacaagagcgaaactccgtctcaataaataataataataataataataataaataagtaaataaatgaatggttgctgaaccacagcaggacaagacagacaaaccccttttatttgtttttgttttttggaccctaacagcagaggaagagccagccagcaagccccttttgatctttggcctctgccaaccagtaccccccagaccttaacccccagccctaccaggtcccttttgtaagtgaccccacatgcctaccacagttgcaggccctgacatccaccctgaccagaggtcttccagctattactggtgtttgtgatgctgtggctgtggccagtcaaggacccatgctgggcatcccgaggtaggaaggaccatgaccacgtgattatctccctgccactatcatggcagggctgtggggtactagcctcctttaaagcattccttaggacagtaatttctgttaaatatctggagggcaaacattttaaggaattttaatgaatttttaaaaattcaaaatgaaaaatttaaatcataaaaccaaatagaagaaagacccctatgtccatatacgcaccactctgcttcagtgattatcaactcttgtctcatgtacttgacctccacacaattattattactattttttgagaaagggtcttgttatgttgcccaggctggagtgcagcagtacaatcatagctcactgcagccaactcctgggcttaagtgatcttcctgccttagcttcccaagtagctgggactaagggtaggcgccaccatgctggctaattttcttattttttttttttttggtagagaccaggtcttggtttgttgcccaggctggtcttgaactcttggcctcaagtgagcctcctgcctttgcctcccaaagtgttggattacaggcatgagccactacgcctggccatccccagttattttgatgcccagactgttttagtggctgcccactgtctgtggattctgttcttagtcttgatccttcgtgcagtgtctgcacctgcctgccagttccttgacctgtgctccatcataccaagctggcagtggatcctcagacaatctcagttcttactccctgctctgtgtccagtttgtttgcctacctaaaagatccttccttttcgtggctgagcagtgcagccgttctccaaggagactgggccttctgctgcccccaccaccctgctcttttcactgcccccaccccgctgctcttttcacaggcttggtgaggagtttccaggttgcacttggtttgtttgaaggcttatctcctcctagtctgaactcgtcagggcaggagcttgaatcaatcatttcctgcctctcaggactgctgtagcagggggattcctagatctgtccagtgccagtttcctgagtactgctgcaggcccatttcagctgctatggtgatgggggctgtcctgaggggacattcacctcaggtagagatggcagaaacaccacaggaagatgcaaccagtcagctcagctgggggcacttaaattagatccattttttttctggaaggccttttggcaatactgtttatcccagtaccttaaaaatgtcgatttcctccaagggcgcaatcaggaaagtattcaaagcctgatggtgatgagggtgctcattgccgcatcattgtctcaggagtgggatttgtgaaacagaccaacagtgggagcttggttagagttgtagctgcaggtgatgggctctgtgctgctgttgacattgacgtgagggactgccataatgcgtcaacatcgacaagcgcttgttaccaagcaggatgcgtggtacaggctgagttttattaaacagatgtctttaactggtatgaatgattttaattttttctttgtttgagatggagtctcgccctgtcgcccaggcttgcgtgcctggtgacttctctcacctgggccctcaatgccagaccagccttcccaggatgattccatcctttccatccctgcaagggagcttgaggccctttccctttcagtttgatactgtccttccaagttacctttcttcatgttggcacgagagctttgtgccacaccatgccctttctggatgctgtagtgtctggctcttcctctgtctctgtgaccctcttccctggtgaagctttgaccttggcttcatcccctccagatgacccctgatggttagctcagcctgtggtggctccagagccctcattgagtgcatcctgacacgaactgaacagattaactattttttgccttgccaacagcattggaaattccttgagtgtgggacctggactcatagctctatgtctcttatagttcttagcacaatatcttggcctagatgaagtacataataattatatgtagggttgtggaaagcagtgctggctttaattaaagcctgccatggttttgtccatcagtgctgcctaaaccgttctgaacttctcattttgaacttttttccctcacagcttgtgatggttgattttctttttgagacattcatttatttgtttgtttatttggcagggtctcactctgtcactcaggctgaagtgcagtggcgtgattgtggctcactgcaacctccacctcctgggctcaagcgatcctcccacgtcagcctcccaagtagctgggaccacaggtgtgtgcctccatgcccggctaatttgtgtaattttttgtagagtaagggttttgccatgttgtccaggctggtctccaactcctgggctcaagcgatctgctgcctccgcctcccaaagtgctgggattacaggtgtgagccactgtgcctggccctgagacatttatttaaagacaaaggggagtacaggctagagaacagaggggaatagaatagcagccaaggcataattacctctaaaccatcaccccataagggagatgttcgcctcaactttagtaatgactctctttctagtctaggtgcagggctgttaatagaggccctgtgattgggttaagggcttgaggtacaataactctgttatttagggcagtgagtccttggagaagatgctttaccttctttccaagccccatgtctccttattttgagggtgtttttttttttttttcttgagacagtcttgctctgttgcccaggctggagtgcagtggcctgacctcggctcactggcctgaccttggctcactgcaacctccgccttccgagttcaagtgattcttgtgcctcagccttctgagtggctgggattacaggcctgcaccaccacacctggctaatttttgtatttttattagagatggggcttcaccatattggccaagctggtctcaaacttctgacctcaggtgatctgcctgccgcatcctcccacagtgctgggattacaggcgtgagccattgcatccggcctgaggtttttattttgagaatatttcaaatgtacagagagttgcaaggacagtaaaagcactcaggcatcctcttccctgggattcaccagctcattctcacttttaccatcttcccatactccctgggggcctcctccttctgggcttcgtttccttttatttgtttctgtctttttaattttaatttttttttaactagcccttctctttggcaggatttgttcacttttaatccttggccccagcagcttctctgagctctgcctatgaatctgggggagagataggggctcacacaagagtgaagtgtgagctggagggctgaaggggaatgagggacatctgggccaaaggcaggggaccagcaaggcccccacccctggaacttctgttcttcccagcctacgtaccccttgcttcttcttatgttggtgggctctgggggctgggtgaaagcagtgcttgtaggttaagaagtgactcatcccacgtgcccgctgcccttctcttctgttctttgctctttccaagcttcctttcagtcctcctcatcagacatgacctttgaggaagtgatgagtctgctatgtgtgagacagagcccctgttgtgaagtagaactcagggttcgtcctcagaagcctcggtgggtcaccatacgtcctgcaagtgctgtcagtctgctttgattcgtgtgagggagaagtccctgccaagtgctctgtagtaggcattcaggccaaccaaagaacagggcagggtcctgaggcacaggctcagagctcttgcttatttcatggggtgtttaaattgaggtataatccctatcacagtgaacgacacgcatacttccaatcttgagtgtgccaccagagaactgttgatactccccagatctgcacccagccagggcaaactgtgcaccactcttctgacttccatggccagccgagacatttggaatctctgtgcaatcacactctgtgccatctttttttcgagacagggtctcgccctgttgcccagggtagagtgcagtggtacaatctcggctaactgcagtctcgacctcctgtgggctcaagcaatcttcccacctcagcctcccaagtagctggtactacaggtgctcaccaccatgccctgctaatttttgtgttttttgtagagatggggttttgccatgtttcccaggctggtctcgaactcctgggctcaagcaatccacctgcttcagcctcccagagtgctgggattacagtcctctgtgcaattgtgtgcatcatgtgtgaaatttatcctcatttatcctcacaggcagcagttgttctattttttttttttttttttttttttttgagatggagtctcactctgttacccaggctggagtgcagtagcacaatcttggctccctgcaacctctgcctcctaggttccggcagttctcctgcctcagcctcccgattagctgggattacaggcacgtaccaccatgcctagctaatttttatatttttagtagagactgggttttgccatgttggccaggctggtctcgaactcctgacctcaggggatccacccacctcggcctcccaaagtgctgggattacaggcatgagccaccatgcccagcctgtgtttttgttttttttgagactgagtctcactctgtcgcctaggctggagtacagtggcgtgatcttggctcactgcaagctctgcctcccgggttcacaccattctcctgagtagctgggactacaggcgcccatcaccacacccggctaattttttttttttttttgtattttttttagtagagatggggtttcaccatgttagccaggatggtctccatctcctgaccccgtgatccccctacctcggcctcccaaaatgctgggattacaggcgtgagccactgcgcctggccttatttatttatttatttatttatttatttatttatttatgtatttctgagacagagtctttctctgttgcctaggctggagtgtggtggctcaatctcacctcactgcagcctctgcctccagggttcacatgattctcccacctcggcctccagagtagctgggactacaggcgtgcaccaccatgcctggctaatttttgtatttttagtagagatggggtttcgccatgttgggcaggctggtgttgaactcctgacctgacctcaggtgatccacccgccttggcctcccaaaatactgggattataggcgtgagccaccgtgaccagcctgttcttgtttatgacgtgttattccatggaggactctgttccagataactcttttattttgtgcctaatgaactttggtgttagttccagatgttggctacatgaaggcaaccccaggaatggctttggtcatgtcttctggtaaatatatgcacttaattctctgggctgtgcacctagaagttaaataaaggactgggtcagaggatgtgtctcttagcatgttctgctgaacagtgttcccaagtggtaccagtttacgttcccaccagcaaaatgtgagggagttccacttgctggacatccttgccaacacctggtattgtcaaggaacctgtctgtaacaggcactctcgttgattttgaatgcacgctgaaatttactgggtgcagtgacagtaggaagggaaaggatgattaaaaaaagaaaaaaggaatggaaaggctgatctaggagggaggaagctcataaggaaataagtggtaggatttggtgattccatgtgtgaatgctcgtattccgtgtgcatgcgtatatgagcttgcaggagaaagggaggagggaggcactggtatgcactccaccagttctcctgccacagcctctctactgatctgagggctgggtgtaaggtgatgatgtggggagtgggtgtgggtgaaatttccaacagtcagtgggagatgggggaagcaaacctgggaagagcagcctgctgcaggagcaagtgggtgggccgtcctggaggctggatgaaacctgtctgcctaggtggggatggcagaagtggcagagcagagaactccagagcagggctgtggtgggcagagcagatgtgaaggaagactgtgggatgagaggatggggcacggtggagccccatcagcctccagtcacagcagccccggtcccgtctctccctcctgttttggtcagtaccttcaggacttgtgggtgtagtacttcgttccattccggataacattgtagaagactgaaaaacaggaaggtgttttccatactctctccagagctggctgttactgacatattgatatatttccaccagtcttgtgtgtgcttatagcttgatatgtatgcattttaaatatgtaaatatatatacacatgtatttttaaagtgaaactaggctgagactgtgagttcagttttgagttataggtttcccatggcttaggttgtgttctctccctggatggagtctggctgggacctgcatgctcacagcccaggttcacatgaggtgtggatcatgcacaatcatcccacgggcttgagataagcatttgacttcctttttttttaaaaaaaaagttcattatggactttttcaagtgttcccagaagtagagataatagaaaagtggtctcccaactactttgagagttagcaacatatggccagtgttgcttcacccacccttcctcatcacctcctggactattttaaatcacatcccagacaccagatgatttcaactgtgagtacttgagtgcagatctctaaaagatcgagcttccccacccccaccaaataccacagagccatgtgagatcagcatttgggttggcagatctcctccttgccacatgcttgcctggtggtgaatgggacactttcaggcgagacctaggggagccccaggccagcaccaggacagagatctcgaggcctttccaactctgctggttcttcagaagtcaaaccaacagattggagtatgtgaaggaagctcgtgtattcttctgaactagcttagacaacagtacacagtttgaagggcagcagccttttctgcaggttagttctttcaatgatcttgtttactgggagttgagagaccttgaggatagaggcaagaaagcgtcatcaagcagcccagaggggtgtacagtgtttgaagtctcctgtattggtatgattcgagattttcattctgcaggaccaaaatacccattcctacatgtgggtggagagttaaattctgaagtatatatttttatcttgttaaaaaaacacttttatgtttctttaaaaagtaaaagaaccagaatgtagaagtttcagtaaaggaaaaagttacagtttgtttgggatacagtttgacaaatgtgctcccagctgcctgagagatagagaggccagatgtttgctttggttacattgatgactgaacaatcggtatctcatcatttcctgccttagagatgaaagcacctgggcactggggcagtaaattggttgcaggattggaagaagtccaaggacagtgtgggatgccaccctgtagctgtctagagacctagtgaaggtcagaaggctgggtgagaacaagccctgcactgatggaggacagggaaggggcttttctggctgggagtgtggtgaggcatttgagctgcagccagaaggcacctctcagattggtggggcttggggtgggggtgggaggaactgctttgcctgtgccgttggcctcactcatcctgaggtcccttcaaactccatccatactctgactgtggggccacttgcagaaggaatatgtggcaggttttttttgttttgttttgttttttgttttgagacggagtctagctctgtcacccaggctggagtgcagtggcacgatctcggctgactgcaacctccgcctcccgggttcaggcgattctcctgcctcagcttttggagtcgctgggcttacaggcgcctgccaccatgcccagctaacttttgtaattttagtagagacgggatttagtagagacgggatttcgaactcctgacctcgtgatccgcctgccttggcctcccaaagtcctgggattataagtgtgagccactgttccctggcctgtggcaattttttgagacgctcctgggggtccaaattgctaatagaggagaaacttactgtccctgtgttgactgagacaggaaggtttagataggtgaaagtggtctgggcgcagttgctcacacctataatccagcactttgggaggccaaggtgggagaatcgcttgatgccaggagttcaagactagcttgggcaacatagtgagatcctgtctctataaaaaataattttaaaaaattagctaggcctgtagtcccagctactcgggagactgaggagggaggattgcttgagcctaggagtcggaggctgcagtgagctgattgcgccaccatactccaccctgggcaacacagagagcctgtctcaaaaacaaaagaaaggtgaacatgagtttttttgttttttttttgacatagttttgccctgtcccacaggcgtgggccaccacgcccagctaatttttgtatttttagtggagatggggtttcgccatgttggccaggctggtcttgaactcctggcctctcaagtgatccacccacctcggtctcccaaagttttgggattacagacatgagccattgagcctggccaaacatgacctttctctttttttttttttttttttttttgagacggagtttcactcttgttgcccaggctggagtacagtggcacgatctcagctcactgcaaactccacctcccgggttcaagtgattctcctgcctcagcctcctgagtagcagagattacaggcatgcaccaccacgcctggctaattttgtatttttagtagagacggggtttctccatgttggtcagggtggtctcaaactccccacctcaggtgatccacctatctcagcctcccgaagtgttgggattacaggtgtgagcccctgcacccggccacgtgacccttcttaatagctattgttcgctgagtatttctctacgacactctttatgtgcattttgtcatttaattttaattttaattttctttttttttttgagacagggtcttactctttcacccaggctgtagtgtagtggcacgattttggctcgctgcagcttccgcctcctgggctcaagaaatcctcccacctcagcccccgagtttctgggactacaggcatgcaccactatgactggctaagtttttgtattttttgtagagatggggtttcactatattgcccaggccaatcttgaatcttgaattcctgggctcaagcatgagccaccacactcggcctcatttaatttttaattactttaaattttatcaacataatatatcacataaactgtaaaaagacaagaaactactgtggttcccattctgccagttctccccagaggtagcaactgcctttacatctgagctttcttccggcatatacctctgattctaggtaataggcacatgctgcttttgcaacttggcgttttacaaattatgttggcttgctctgtagctcccttccatcgccattatctctgcttctcctccctcattcttccagtattctactttctgcataaatcggtaatgaatgtttacattttctgcctacacaaatgatattcacagctgagcatagtggtgtactgcaattgcttgttatttttttcctaggaaagaattgccttttcaacactatgcccagttttctgtgtatctattcttattcttcctttattttccggttgcctctcagtacagttatcttcaggctcagtgctagtgagctgtcagtttcagttcaaacccctggcctcaagtgatccatccacctcggcctcccaaaggaggtgggcggtgaccctcttggacctcccttctggaaccctctaggcagtggccgcaggtgtggtgtgacagccctcagcgtgcttgtctgcccagactgggactgttgtcttcctttgttgggtcccttgttttctatatcctgtgtctcatcctttgtgatttattccctcattctgccagcttcctgagaagggactcctgggaattaactttctggagaccatgccagtttgagtgcatctaggccccctggtgggacatgctaactggggaatttaaaatgatgttacactgcgctgcccttgtgctggcttgtgcttctgtctcctgaggtgctagctctcagcctcatatgacttgtcttgatccctaaacccaagtcctgctctacttgggaagttcctttgagtcatttcaggggaatctcactccctacacttcctgtgctggagtgtttaatgttcactctttgggcctctagttttatcttttatctcctgttttctatctcttttacttttagctctcctctctaagtgatttcctcaattttttctttgacctttcactgctaacatgcttttatttccaagaactccttctttttccttttttgtaatctgacttttccctttttatagcacccattcctgttaaatggatacaatgtagtataatatttatatatattataataaattctaccgttttttttgataaattttcactttattgcccaggctggaatgcagtgatgtgttcatggctcactatggcctcgaactcctgggctcaagtgatcctcccacctcagcctcccaagtagctgggactgcaggcatgcaccaccactcctggcaaatatttttgtttttcgtagagatgggatcttgtgatgttgcccaggctggtctcaaactcctgacttcagctggacgcagtggctcacacctgtaatcctagcacttttgggaggccgagggcaggcggatcacaaggtcaggagttcgagactagcctggtcaatatggtgaaaccccatctctactaaaaatcaaaaattagctgggcatggtggcgcgcgcctgtagtcccagctactcgggaggctgaggcagaagaatcacttgaacgtgggaggcagaggttgcagtgagccgagatcgtgccactggactccagcctgggcgacagagctagactccgtctcaaaaaaaaaaaaaaaaaaaatcaaactcctgacctcaagtcatcctctcgcctcagcctctgaaagtactgagattacaggtgcgaaccactgcacctggcctaataaattctacatttccttcttcttgctgaatttctgttaccgctaaattactcttttcttgtggggtctttattggccatgttatggcgtctggctgcccttggctggttgctcactctgagagggaccctccaaagcctaggagtctcttccagcacgtggagcttgtcgactgggaacttcattgaaggctcatctggctgcagattctgagtccttcctccagaacaatggtccccaacctttttagcaccagggaccggtttcacagaagacaatttttctacagaccggcagatgaggatggtttcaggatgaaattgttccacctcagatcatcaggcattagattctcataaggagcatgcgacctggatccctcacatgcacagtttacagtggggttcgtgctcctatgagaatctgatgccaccacttatctgacaggaggcagagctcaggcagtaatgcttgcacaccctctgctcacctactgctgtgaggcctggttcctaacagcccacagacctgtactggtctgtggcccagggcttggggaccctgccctagagcatggtcttccagacactgggctgtgggtgaagacctggctgccagcatgctgctcactgcgatggaggaggctgatgggccagtgggtctcggcagttagcgtgcatcgatctagtcacttagaccagagcacagatgaccacacaacccacctctctcagtgtcctacctgtgccttttcaactgggtgggttggccccctagtccagtgactatccgtttcatgcttttccagagagtaaacctcctgtggtcacctggtgctggagtagctacccacagtgtaaagttggggagtgagggatgcagggatatctttcaccctctgtcccagagcacttggtgcagcctggcctcaacctggcaaagacctagggctgtcactgggtgggcgcaccccctcctcactgttacttaggactctggtttcttggtcctcttgctgtgtacgttaccactgggccatcagctttccagcttctaaaaggctgttgaggccaccatttccattcttcctggtttttttttctgtggttttagtcaggttttaagatggaagggaattaaatgtgcaggctttgttcctcatttcaacttggaggttcatatctgttatttatttatttatttagagacagagtctcactctgttacccaggctggagtgcagtggtgctaccttggctcactgcaacctccacctccctggttcaagcgattctcttgcctcagcttcccaagtagctgggattatggccgcacaccaccatgcccagctaatttttatatttacgtatatatttttttgagacagagttttactcttgtcacccaggctggagtgcaatggcttgatcttggctcactgcaaccttcacctcccaggttcaagtgattctcctgcctcggcctcccgagtaactgggattataatgcacgccaccatgcctggctaatttttgtatttttattttttatttttgagacagagtttcactcttgttgctcaggctggagtgcagtggtgggatcttggctcattgcaacctttgcctcccgggttcaagccatcctcctacctcagcctcccgagtagctgggattgcagcgcccaccaccttgcccttttgtatttttagtagggatggggtttcaccatgttggccagtctggtctcgaactccggacctcaggtgatccacctgccttggcctcccaaagtgctgggattacaggcgtgagccactgtgctcagctaatttttgtatttttagtagagacgtttcaccatgttggccaggctggtctcgaactcctgacctcaagtgatccacctacctccgcctcccagagtgctgggattacaggcgtgaaccaccacacctagtccaaatcttttttttaatatgggaaaatcttttttcctttatagtgtctgcttctggtgacatgcttaggaaaccatcatcctgatattgtataactctccttctgttgtcttgtggtcctctgtgatttaggtttttaaacacatagggtaaagggtcccacatacaagctgtgggctcctgtcccaggtgggcaagcaggctgcacacacaggcagcaatttactgggaggcttcttgggtggggtgaagtggagctgccaaaaatttattctgccctatgagagttcacttgattgatagatgttgtgtttctcaaaattagaaaattagaagaaactcacagaagtttccttcgagcagaacataaatcggctgagaggaatcatcctgcccccctgaggtcaggagggtgaatctgtgccccagggaggaacgcaccttcctgctttagacaccagcagaggacagagaagctggctgtcctgggaattcatgccctcattcagcaatgggaaagcagttggaccagggaagggggcctggcagtgtggcagggggagcagtggtaaagagggtggggtcaggggagaggcctcactgagaggggagagggtccttggtgggaaccagggcggttgtggaaggaagagtcagggcgtggagcagagcagagcgggagttggggtggggaggccagttcatgcctcatcaacatgcctgtgtgagtgtccttcttgcgggcggtggagctggcctcagggtacactgcaggtgactcagagctccaatgggagggtggctctgcctgagggagctgcacatgctcattgggccatcgtctgctgaggagggggcaacaataacctcaacacatggcggaggtgttttgggatgcatcctattgcacatttgggcaggttgttgcctgacttatttctttaacgcatacctagcacttcctgtatgtccagtgccttataatattaactactatcatcctcagggctacccgtgaggtcggcactgtccccaccctttgtgcaaaggaaggatagggaggcgctgccagatgggttgagggcagaccggggcagcttgcctcaggcctccctggccttagcaggctttaagtttgatgccctgtgctccttccctaggaagctcagtttgccagttttttgctttatcttagtctcattcagattacaaggactgggactggactcctgttgccagtttctcaatttggaataggaaggaggtgaggaacaacaggcccatgctgggcagaagccctgcagaccaggccaacagtgggcctctcctcactgcctggccctgtctgtgcaccttcgtcctggccacagcctctcagagcccctcctttatgaagaggttacgctttaggggagggagtgcctctcccaagacccagagctggtgagtggctaggttggaatttgagcccaggtccctcctcccctgtctgcttcctgccaggcccagctgcctgccccagcacacgccttctcccaggcaccctggcctccactgccaggacgtgcctgtttgaggcctggattcccccatggctgccacgctgattctccgttctgcacgtcgtgtcccatcaaaatgcatgacagtaccactccttgtgttaaaaagagccagttattgtgcctggcagtgatgactgcccactgcacacaaaagtggacgccgttgtctctgctctcagggtgttcttagtatagtggggctggcacacagaaaccagagattcctccaggaagtgccacagacatgggtgaggtggctacagggtttctgtgcagccgacagcaggggtgcctgggtggaagcagggtgggaggccctaacaggcctgatgggatagtcaggcaatgtgccaggtagtaggtcatcatccctggggccctggggagagtgtgtggggcaggcgcaggagcaggctcctcagtgggctcctggacaggctgcctgctctgctggtgaggagcgaggctcaaagcaagcaggggcctgggttgcttcccacactcagtggcagttgctcactggcagtcatgtgacctggggagctggcgagggcgtgggggtaggaatgggaacgggagacagaggccctttgggaggaattgccacagatgcagtgggagttggggcaaagatttgaactttggagaattaaaggtggcagtcagaaagtgaagggagttcccaagtttctgggatgggcacttggtgctgggagatgaagacacgaagagcttttcttgatgtatccctgctggctgctcaggcagggtcgggcaatgccattaagacacactgtgttctgggaacagttctggacagtaaggacatcctcagaccccttagtgggggagctccaagggcctgtaatgatgaatcggtcccctgggaggcttcagtctaagctagataccagttgaaccctgactgagtacacagacatagctatggcaaccagctagaccatggccaaaggcagagcattggagcccagttcacagcaagggactgtgtgctctgagccggtaacagtccttgtgttcagaggtctggctggtcgcaaccagggagtggcccccagcccccttcctcagctagagcgagcaccacccaggcagccttgggttctttggtggccgcctcataggcctgtactgtttgtgaacctgttgcttatgttggacaggactgtggcaggacagccatcaagggtcttcccttgtgagctgacaccagtctgctctttgtcctcctctggctggacaggccctcgtcttcccggcttgcttgtgtgggggaagagctcactgtgacatgtgggttctctgttctttgtctcaggctgtgctccttactccatgttgggggctgtctccttgtgtgatagtttcctttcatttcgtgacagtggctcgaagggttttgttttcaggagacagagactgaggagtagccattcgggtctggctgctcaggaaggcatgctggggatggcagcagagcccagctcagggagatcagaagggggctttgggagcagccagtgctgttctgaaggtgggcctgggtcctgcctgcagcctcccgcagcgggtgtgttaggtctaagggaggaaggaaggggacttgacctcagcaggagtgtgaaatgggtaccctcctggagtcaatgtccaggcaggggatgcctctgaaaagcgccaggccagctggagaggaaagggcaggcatctgcagggaagtgtgggggattagctgcagagttcctgggttctttttcgctttgtctctattttgtgacacttgatcttcaaactagaaacaggagcaaagacattttcaaaaatacagttgtcagaactgcaaaaccacacagggtctgttactggccaccaaacctgctgggcctccctgggtggatgctgtgggagagatgtgggagtgacatggcacagtgctgctgttctgagcggtagccttgctggaggagcgccttgccggaggagcaccttgctccttggccccactctgaccctccgaagctcatgtggaactggacatttaccccaactcggtttcctggtgttggcctgtcaagacttgcctgtttctggcctccagcttggtccatgctcctcaggctctgagtagctgacggtgcccacagtgtccatgtcatctgtgacattacccaggacaggacagggcccgtctgccagtacatcccctggtgtatggtgccaccttgccttcagctcaccaagcatatttcttcaacctggtcatcccaccacctcagagctattgcactaagctgtgtttctagatcttgtctctctgactgtgccaggtgtctctgctgcaccaagacagtgtctgtctggggcctgccagtctgctgacactctcaaaaacggccagtagcagctcaaaaggactgcttttgtatcaaagcctggctttgctctctgatcgctgctggtgggcacagagcccatctgtgtaactggttgtcactccccagactcttctgcacccttcttcctctctgactcctggccacatctgccacccacagcctccccactccttacacagccagcctccaggccgtcctgcttggcctgcaaatgctcccctgctgtttctactgctcttccctgagtctccctattggtcccagtgctttgggaggccaaggtggaggatcacttaaggccaggagtttgagaccagcctgggcaacaaagcaagaccctgtctctacaaaaaaagtaaaaaataaaaaaattagccaggcgtggtggcgcatgcctgtagtcccagctatttgggaggctgaggtgagaggatacttgagcccaggagtttgaagctgcagtgagctgtgtttgccccactgcgctgcacctgtgagagagtgagacattgtctcaaaaaacaaaagaagaaaaagaaaaaaggaaggtgggaagaacaagtatgcctttgaagggcatacctgccttgaggggcacagatgaggcaaccttcagaaaacaggcctgtgcagccacttctatcagaaatgctcactgacttcttggggcctagcagctatcgtctcagcctctgggtgtggagaccctgccccatgctaacctgagagcatgagtacagggtcctcccagcccacccatgcctcgcttccccaggactctgacccagtgccgcgcgtgagttggttgtcattatcctcctggattgttaactctctcatcttttgtggccctggtgacctttcttacttgtctgttccacacctggatgccttgtgagcagaaaccccttgctgcctcctcgcctcccttcaggcttcaggaagcagacagggaggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcctcagcctcctttgtagctgagattacaggcatgcgcaaccacaccctgctaattttgtatttttagtagagacagggtttcaccatgttggtcaggttggtcttgaactcctgacctcagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagaggtgcagcttccctgtgttgcccaggctggtttcaaacttttggccctacgccatcctcttgcctaggcctcccaaagtgctggggtcacaggtgcgagccaccaagcctggcctaattttagaacttttttttttgagacagggtctcactctgtacccaggctggagtgcagtggcgtgatctcagcctgctgcagcctcaatctcccgggcttaggcgatcctcctttctcagtcttctgagtagctgggactacaggcatgtgccaccacacccggctaagttttttattttttgtggagacgaggtcccactatgttgcccaggctagtcttgaactcctgatctcaagctatccccacgccttgccctccctaaatgctgggattacaagtgtgagccaccatgcccagccttcaacattttttaaagaaactttatacctgttagcagtcacactcccttttccttcaaccctcagctaccacttatactttctactgctgtagatttgcctattcggaattttccatataaatataattgtacaacatatgggttttttttgtttgtgcgtgtgtgtgtgtgacagttttcctcttgtgcccaggttggagtgcagtggcacaatctcagctcactgcaacctccgcctaccaggttcaagcgattcttccgcctcagcctcccaagtagccaggattacaggtgcgcaccaccacacccgactaattttttgtatttttagtagagactgggtttcatcatgttggccaggctggtctcaaactcctgagctcaggtgatccgcccgcctcagcctcccaaagtgcagggattacaggcatgagccaccgcacccagccacgtacaatatatgtttttattttgcagctggcttatttcacttagcataatattttcaaggttcaaggtccatgaaccatgtttggtatatactttattcctcttttgttttttttagatggagtctcgctctgtcacccaggctggagtgcaatggcacgatctcggctcactgcaacctccacccactgggttcaagcaagtctcctgtctcagcctccttagtagctgggattacaggtgtgtgccaccatgcctggctaattttcgtatttttagtagagatgggttttgcattggtctggggctatgttggccaggctggtctcaaactcctgacctcaggtgatccacctgccttggcctcccaaagtactgggattacagacgtgagccaccgtgcctggccaactttattcctttttattgtcaaatattccatttctggatggccatatcacatattttatagccattcgttagttggtggacatttacatagtttctactttttggttattatgagtaagcagaacaatagttaatgtataaatttttgtgtgggctgtgttttcatttctcttgggtatatacctaggggtagagttgctgggtcataccctacctctgtatttgaccttttgaggaattgccagatgtttcccaaagcaactgtactattttaaattctcaccagcagcttaaatgaggtttcaatttctcctcatcctctccaatacttgttattgtctattttaattgtagccattataatgggtgtgatttgcattgttttgatctgcatttgcctagtgactaatgatgttgagcatctttttcatgtgctttttggccatttgtatattttctttggagtaatgtctattcagatcctctgtccatttttaaattgggttgttagtctttttattgttgggttgtaatagttctttatgcatttggatataagtctgttattaaatatataatttgcaaatatataggggggattttatttatttatttttatttttgtttttttgagacagtctcgctctgtcggccaggctggagtgcagtggaagtggagggatgcagggggtgttagtgatgcattgtaatcatcccggagagcaggacacctctcataagaggtttacccaaggggggctgtggaaagggctagaaattgctcctggaggacgtggaaagccacataaggtttttgacagattagggaaaaggctgtgccactctttctgaagatgacagtgtaggcagcctttccattttgtgccaaaaataaaattttaaatacataaatcacagtagtttctaggacaactgggtaactacatacaaaatattgaggttgagccccaacttcataccctatacaaaacttaactcaaaataaaaaacaccagccaggcatggtggcgcgtgcctgtagtcctgcctaatcgacaggctgaggctggagggtcacttgatcccaggagtttgagattacagtaagctatgattgtaccaacatgttccagcctgggtgacagagtgagactctgtctctaaaaaactttttaaaaaattaactcaaaatgggtcaaaaacctaaatttacaagctaaaactataaatatcttagaagaaagcagaggcgtacatcttcatgaccttggattaggcagtagtttcttagatatgatgccaaaaaagcacaagctacaaaaaacgtagataaatttgacttcatcaaaattaaaaacttgtacatcataggacactgtcataagagggaaaaacaacccatgggatgggagaaaatatttgcaaatcacatatcaggtaagggtttaatatccagaatacataaagaactcctacaactcaacaacaacaacaacaacaacaacaaaaagcaactaaaaaataggcaaaatacagccaggcgcggtggctcacacctgtaatcccagcactttgggaggccgaggtgggcagatcacgaggtcaggagattgagaccatcctggctaacatggtgaaaccctgtctctacttaaaatacaaaaaaaggaaaaaaaattagccaggcgtggtggtgggcgcctgtagtcccagctactcaggaggctgaggcaggagaatggcgtgaacccgggaggtggagcttgcagtgagccaagatcatgccactgcactccagactgggtgacagagtgagactccgtctcaaaaaataaatacataaataaaataaataaaaataaatgaaataaaaaataggcaaaatacttgaataaacctatctccaaagaagagatacaaatggccaacaaccatgtgaaaagatgctcaacatcactagtcattaggggattgcaaataaaaaccacaatgagatgccacttcatttccattataatggctatgatttttaaaaaagacaataataagcgttggcaaagatgtagagaaattggaattctctttctttttgagacagtctcgctctgtcgcccaggctagagtgcagtggcacaatctcgtctcactacagccttcgcctcccaaattccggtgattttcctgcctcagcctcctgggtagctgggactataggcacacaccatcacacccagctaattttttttttttttttttgagatggagtctcgctctgtcgccaggctagagtgcagtggcgggatctcggctcaacgcaacctccgcctcccaggttcaaacaattaccctgcctcagcctcccaagtagctgggactacaggcatgtgccaccatgcccagctaatttttgtatttttagtagagacagggtttcaccatgttggccaggatggtctcgatctcttgactttgtgatccacccacctaggcctcccaaagtgctgggattacaggtgtgagccgctgcacccagccaatgcccggctaacttttgtatttttagtagagacagggtctcatcatgttggccatgctggtcttgaactcctgacctcaggtggtctacccatcttggcctccccaaagtgctgggattacaggggtgagccaccgtgcctggcagagaaattagaattctcatacattgctggagagaatgtgaaatggtgctgtggaaaacagtatgacagttcatcaaaaaattgaatgtagagttaccatacgacccagaagtttcactcccaggtatatatccaagagaaaagaaaacatgtccacacaaaaatatatacacaaatgtttatagcatcattataacatcataaatagccaaaaatggaaacaacccaaatgtctaccagctgatgaatggataaacagaatgtagaatatccatacaatgaatatcatgtggccacacgaagcaatgaagggctgatacatgctacaacatggatgaagctaaaaacattacataaatgaagcagtcacaaaggatgacatgttgcatttttataaaatgtccagagaatacgaagatctatagagatagtgtattagtttcccatggctgccataacaagttaccataaagttggaggctcctatctctgggtccatggctctgacttctgagcccatgtctctgccctcactttcttaaagggtagcacatgtttgaggctgcgtagttttatcagcctattcctgcttctaaaattttgggagttcttctttgattttgcctagtctataaactttctactccaagctggcagtgtttctgctggtagaacattctcaaaatccttgtggaacttctacatatatgatggaattcatagtattagatgaggtttctccacagatctttcctagataatttcatctctcttcctcacttctgtgagatgattgaggggattcatgagtcccatgtttaatctctttggcactagaaaaatttggaagatatgccacacccttggcattctctacagaacacactttcctaacagtaaatctcctagttttagcattttggttttttccaatctaaatagcctgagaatttcccaaatcattaagtctagattcctttctgcttaacagttcttccctcaatttctctctcttctttgtgtgtgtgtgtgtgtgtgtgtgtgtgtgtgtgtgtgtgtatttttaaaattctttttattgtacccttaatttatctctttcatgttgcttttttttttttttttttttttttttggagacggagtctcactctctcgcccaggctggagtgcagtggcgtgatctcaggtcattgcaacctccgcctcctgggttcaggtgattatcctgcctcagcctcccaagtggctgggattataggtgcccaccaccacacccagctaatttttgtatttttagtagagacagggtttcaccatgttggccaggctggtcttgagctcctgacctcaagtgatctgcctgccttggcctcccaaagtgctgggattatagacgtgagccaccatgcccggcctcctcttgcattttactacaagcagaaagaagaaaccaagctgagtccttttttttatttttttgagactgagtctcactctgtcgcccaggctggagtgcagtagcgcgatctcggctcattgcaacccccacctcccaggttcaagtgattctcctgcctcagcctcccaagtagctgggattacaggtgcccaccaccacgcccggctaatttttgtatttttagtaaagatgggatttcaccatgttggccaggctggtcttgaactcctgacctcaggtgatctgcctgcctcagcctcccaaagtgctgggattataggcatgagtcactgtgcccggcccaagctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgtttctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggccgggtgcggtggctcacgcctgtaatcccagcactttgggaggctgaggcgggcagatcacaagatcaggagatcgcaaccatcctggctaacatggtgaaacccccgtctctactaaaaatacaaaacaactagccaggcgtggtggcgggcgcctggagtcccagctactcgggaggctgaggcaggagaatggctgaacccgggaggtggagcttgcagtgagccgagatcgcggcactgcacaccagcctgggtgacagagtgagactctgtctcaaaaaaacaaacaaacaaacaaatttaatctcacagttttcaaggccagatgttcaaagtcagtaccatgggtaaaaatcgcagtggcagcagggaggctataggagaggaacctgtttcttgcatcttttagcttttggtcactgctggtactccttggcttgtggctgtatcactccagtcttcaagtccagcatcacgaggtaaatacattctctgtattccatcttcacgtcgccttctctgtgtgtgtgaactttccttctgcctccctcttaggaggatacatgcaattgcacttggggtccacccgcataacccaggatagccctccatctcaagatgtttaacttcatcatatctgcaaagacctttttctcaaataaggtaacatttacaggttccagggaataggacctgatttaaggactgttatttagcctgccacagacagaaagttgattattgattgccaagggtgctgtagggaaatggagttttcatttggagtgaagatgatgttctaaaattaggccaggcacggtggcccatgcctgtaatcccaacactttggaggccaaggccagtggatcacttgaggccaagagtttgagaccagcctggccaacatggtgaaatcctgcctctactaaaaatacaaaaatcagtagggggtgacagcgcatacctgtagtcccagctacttgggagggtgaggcaggagaatcacttgaacccaggaagtggaggttgcagtgagctgagatggtgccacttcagcctgtgtgacagagcgagactccacctcaaaaaaaaaaaaaaaaaaaagaaacaaaatgctttaaaattgattttggtaatgctgcagaactctgaatgtagtaccaaaaaccattgaatggcatgttttaaatgggtgaattgtatctcagccagcctattacatatatttttaatggaacgagtgaaaatgatgaataacaggtctgttttcccttggtggccaggtcagggccgtgtggtttccttgggtggggggcactgctggggctgccttgtccctacttggtttctgatggtgtgtcctgtgggctggggccaaggtcccatggggctatggatactatcatggaaccactctttctggaatttgatggtatttcaaaatctattaggaaaactctgagacatgaaagcacagaggcgtcatattcctctaatctggagtcagcagttgctgtggtttggtgacttttcccttggctgtctctgtgtccctcctgaagtgtcgagggcacatccccaccctcagggttgtatctctgctgagcatctccacactggcctgtgctagggccccacctgacaatcacatggagtcactattgtcatcaatgggaaggcctctttcaagtttcaacgcttttttcctaatagttggcttctttgaatcaggatccaaacgagggtcttttctcccctctggcccctcccagcctggtgaaggagcagcccagctgtcctgcagccctccccatgggctctgatgtctcccaagctgctgattcatcctgcctgccccctccttcttatgaactgggtgctaaatcggagagcagagagggtgccgtggtcttttagcaaaaatatatccgaagtattgccttaatttgtatttctgggcatcttgatattcccataagaccacaatttggaggtttggagagcaacaacagcctgacccttgtaaagctcctattatctttccgatggtttcatcatttaattagggcttgtagactaattctggcttttctcccacattcgttacatggagttttttttgtttttttttttttgtcaagaaaggttttctttcgtcagccagggctagatgattgtttgaaaccctgtgtgttcaggacctccaggaatgctgtttttctgatctttccagtctaaggagtccccccaagggccacagatgggttctctttgagtgacattttgagctcagggctgtgtatctggggtgttctggtccattgctgtcattcattttgatgcttagatggtcccatcctcatctagcaggagctcctgtgtctcttggggccctcacacaacctctttagtttttcttagtctgctggcatttagacccagattggctgctcctctagggagtgaaccctggggacttctgccggtaaagtggcatttggagcatgctacgtgggcgctggtctgttcattgctttgggcctttcagtgaacagaactaagaaaaaacatgtttttgaaataacagcaacaacaaaaacccataattttacactaatatttctaattcaaatttaaacttatatatagggtttttacttctttcattttaaacatgtgtcttttctgttactatgaatatcttggtttctaatattattagcatacttggttgctttactttaaaatcatttcagaataaacagtttatattaccactgataacaaaaggtagactaaacatttaagattaccttgaagttctaattgtccttaaaatgtatcccttttattgagaacattttgctttttgtttcatttttttaaaaagcctctcaaaagatttcttttctctatatgattctgccaccaacttaatattcagctcatttgttttagtttatttggaatgtttaggaattggacctttttctttagatttgctatacttttcattttagaaaaatattttaggctggctacagtgactcacacctgtaatcccaacacttttggaggttggggactgagcaaaagacaagccggccaacatggcaaaaccgtgtctctccaaaaaatacaaaaaattggccaggcgtggtggctcacgcttgtaatgtcagcactttgggaggctgaggtgggcggatcagaaggtcaggagatcgagaccatcctggctaacacagtgaaaccccgtctccactaaaaaatacaaaaaattagccagacgtggtggcaggcgcctgtagtgccagctacttgggaggctgaggcaggagaatagcttgcaccacccgggaggcggagcttgcagtgaactgagattgcaccactgcactccagcttgggccacagagtgagactccatctaaaaaataaaaataaataaataaataaattagctggacatggtactgcatgcatgtagtcccagctgctcaggaggctgaggtggggaggctcacttgagcccaggaagttgaaactgcagtgagcgatgatcgcgtcactgcactccagccagggcgacagagtgagaccccatctcaaaaaatatatatattttttagagaaataaaattcactgagttgcccctgagttgcccaggctgaactcctgggtgtaagcaatactcctactttatccttccaagtagctgggattacaagactgtgccactgtgcctagctttgatttgttttttttgttttttgttttttgttttgagacagagttttcactcttgttgcccaggctggagtgcagtggcgtgatcgcggctcactgcaacctctgcctcctgggttcaagcaattctcctgcctcagcctcccaagtagctgggattaccggcatgcgccaccaggcctggctaattttttttgtatttttagtagagatggagtttcaccatgttggccaggctggtcttgaattcctgtcctcaggtgatcctcctgtcttggcctcccaaagtgctgggattacaggtgtgagccaaggtgcccgacttgatttggctttatcttctcaatagtaaaagatttatgtgcttctgaagtgaaaacccataacactgtggatttagagagggcacatttccagcccagttcctgatacttgctgggttgtcgattttcaattttggtgtatctttccagtgtttctcatggcagatttaagcaaatatgtgtgtttacgttccacaggtcttatataaaaggtgtatgtcatgcagtgtatgtggcacggagcacgtgtttctatcctttctccttccttgtgttcactccacaatatgttgtgaggcacttgtgcaagatttccacatgtcaagcaagtgtggaaattctatgaagcttttaactttttgaggtggggtctcactctgtcgcccaagctggagtgcagtggagtggtcacagctcattgcagcattgatctcccaggctcaagcctcagcctcccactttgaggccactggcgtgtgctaccacaccagggtaatgtttgtttgtttgtttgttttgtagagatggtgtcttactatgttgcccaggctggtcttaaactcctggcctcaagggaccctcctgccttggcttcccaaaatgttggaataatagatgtgagcctccacgattggcctctatggagttttttaaggtttctgttttcttatctgtaaactggatgtgttagtagtacctgcctctgggtggttgggagaaatcaaggcgataatgcatgtgaattgatgactcctgtgtctggcactgtaaagtgccaagtgctagctgttactgtcatgatgttcattgtttatggtttgtaatactcagcctcaggtacagctggacacttatattttgatagccagcaggggagctggagcagaccaagtgaagatagggagtttcctgactctttagcccttttttctgcagcagttctaggggagttggtgtgctttggagcagaaaggggcataataatctgtccatctggatgggggtgggggtggatggtgaggagtcaggagtgaaagagcccagccagggggatcagaggcgcagtttcagatccagggctttctcccctggaaaggagttgttgtggttgacccattgcgttcagcccctagatgttcctagataaacctgcctttgggggaatgtaggaagtatcatcgcccacaagaaagctccttggctggcagcatgacagcttcctgtgcttgtttctcacatcaggcgtcccctccctccccgctccccactaagcctcctcacgctggtctggtagcagagctggagcagatggcagtggctgcgcctactgtgggtcaggagtggtgctgggcactgcaggatgatgatgcctgcccactgcattccaggtgctgggctggcagtgggtcttgctcagccctggtgttatgcagaagggctttggtgacatggtcctgagccttgtttgagtgtcttatgtctaagtaaaagtatcttgttgcttttgaaacctacttccccttgttttaccttttatggatgtggagaaaacaaattcatttaaagtatcgcagacctaaaaaatggtccagggccttaggagctgtgaggtgttgacctggctggcccccaggcccttctcccctcatacatggccaccttgcttctgttcctgagtgtcctcaggttcccacacctccattgcccccattctcataccactgtccttcagggacaggctgcctgtgggcccccttcacacgcacatcagctttcctatcagtaattgatggggatagccggaagctgggcgtgttgacagaactgccttggtgtccccttgttctggccaggcctcgctgcttatcccagcttttcctctcccctgggcctttcttcttcatgttgtcctgtgctaattccccgagctgaaaaaaagaagtggggtagagtttggagatagatgtgggatgataaagatttcaaaagtgtctttgtatttttacactcatctgagaccacttttcatcatccttccctctgccctgccatcttatgagtgtagtggatggactctgagtgtcacagtgactcaggaggaaggttgggtgagcagggcacggagccggggctttgccccttccaggctgccctgccagaaggatgggcacttcagcagaagacaaggatgcttctctgaaataagactttacctcagacatccgtgtattgaccacaagaccaactcacagtagtgatttccctgaaacacttgggagtgagtgtccttggggccaaagaggacaatgggtgggaggcagcccctgccagacaatctcagaaacacagcagcttgcatatagcgggccttggcagccagtggccttcacctcacctgagagtgggcttcaccctctgccttgcctgtgcgtaaatggagatgaacacagattctcccggaaagcgcagccaggggagggccgcccagattttcagcagatactgcgtcatcagtgaaaaggcagcaacaggctgggctgagaaatgaaagcccttctttacagatagtgcaaagacacagcggcccacccacggctgcctctgacaggccttgtgccctcaggccagcgcctcatcacccccaacctgcctgtcccctttgtgatgaagagagggcactcaagatggctcccagctctctcagctgagtgcctttccatcaggggagaggagtggccgttggaggctctctgtccccttcttgtttctttgtgcctgttattggccagcctagctgagcactgacggctctcttccgagaggcggattccagaggaggccgagcaagcgtctgaatctgccttgcaggatgggcttcagctcggtgccagcaggcgagggggcgggaagggggagtccgatgactgcgcttcttcatctggtattaaactgcttcctgtttttacttttaggacgaatacctttctctcgtggccaggctcattatccattttcgagacattcgtaagtaagattttgcatttctgggttgttgagatctctgtgagaggccagccctgacgctgcctcggcagagctttctgggcaggccgtggtgcctgagtcagaaggtctgtgtcacctcacttgcttctgggaagttcttcactgccttgcatttgactccagatccctccatcctcccagagccttggcctcaaaaatgctgattctagcatcatggaaatgctgtcctcaaagtggtctaaacgggttgctgcttcacttgctcacttaatctcccttttcatagggctgttgtttttacttctgggaagttctgtttaccctggaacagaaactctcttccctaaaagttgattttattgacccatggaggccagagacacttaggcatattttccctccagactagaagcttctgaggaggacctcctgagtctgcaccctggctccctgctgtgctgagggcccccgtgttaacctcacgttgtgcctcctctgattcagagggcccagtgtggttctgtcagccaggcagtggccccagctctacagaaatgagttgtcattgcatcctagggccagggtcttcgtgcttgtgtgtgttacgtggaagtatgtggacaccaagtgttcctggatggccacagcctgcgaaggaaactggggccagcagctgctctgtgttttcagccaacaatggctcctgcccactgccgctgcataaccaccagaggcaggcttctcttgacacaggcctgtcgttggagcatgtgcctggcgagtcctatttctattcccctgtgggttagggacaggcagctgtaccttcagtgtgttgctgggtcaaagggagacattgagcactccagagcctggtaggttttgcttctttccacactaacttttcaccagaatggccagcaaagtgaacttcactgatctcactctctgtggtgttggaaagtcactgggatgtgtaagaggagaaggagcagcccagatgatctggcccagatgcgctggcagactccgcatgttctgctttcagggacagtggcctggctggtgcacacagtcctgtggggctcatgaggtcatgggaagcagccgagcaggaggctcagggccccatgactgctacagaagttctccgctgggcactggggtcagctggactggcttccagctggccgtggacagcctcagtttcctcatctaggtaacagagacactgcctcaccagagtgggctgcaaagggaggcagtgtcaagtcttggcaccactccagccccgccgtgggttcctgtagtgttctattatttgtttgctcagggctgagctgagactctggacctgggaaaaaggaaagccagagtaggcccagggtccccaaccccagagtgcttcagccttgggggcagctccctaaggccccaggttgaccctggagctactctgcaccctctgcccccaggtctcttgtggggtcagcgctgccaagagtagaaacacttcccccagtagtggggagtactaggagctccgtggggattaaggcttgggcaaatgcctacagaactgacctacccatggaaatatgtggttatataaaactatgtttactttcgtttttttgtttgtgttttcatatagataacaagaaatctcaagcttccgtcagtggtaagagttttcccttttgagttaaagtttctcccaactttggatttgaggtggcaagaatgacatagtgcatgcctcatgtgcctgggttaacctgtcactagaggagaatgcttgcggagagaactctggagggaggaggctgaccagctgtgccctgacctctccagccttcgtcttcctgcagactgtgaagtcgcatgatcctccccatcccgtttcacacaaatgctgcctttgcccagcaaaaagataaacactcacaaagctattaagacattatccaaaagtgttgagctctctggtagagaattattatgctgttttcagtgtaataatatgtagtagcatttctgagaaaatgctgtgaattcacttttttaagttacaaagtttctttgtaaatttagaaatctggctgggtgctgtggctcatgcctgtaatcccaacactgtgggaggctgaggcaggcagatcagttgaggtcaggagttcaagaccagcctggccaacatggtaaaaccccatctctactaaaaatacaaaaatagccgggtgtggtggcatgcgttgtagtcccaactactcaggaggctgaggcatgagaatcgcttgaacctgggaggctgaggttgcagtgagttgagatcgtgccactgcactccaacctggatgactgagtgagactccatctcaaaaaaaaagtttagaaatccatatttttaaatttcagcgtttatcacatgaggggaattctgtcaattcagccttggtctctgctgactaagctgcaagggaaggggtttaacagatccaggctggccaactgcattctgccattgggaagggagtgcactgacctcacaggctgcacgccactgtctgccctgccctagacagtagagctgtacatgccagctgtctctgcccatgtgggtctcacctctcagccaggacagggattcttggccaactggggctgagcggcagcaagggcatgtggccagaacatctgggccccttggcattggagcatggggtcctgggtaccacccagttgtgtggcatggcggtcctgccaggacatacctgtctgtgggtagctgtttgctgtgaagtccacactgttgtgacaatggcatccttgtccttggttgtggcattgctcactgagctgctgacctggtgggcttgggacatttctcctcagtgctctgtggagccctcctctgcacccctaagctgttctggcatggtggccctgcacacaggggcccaggctgagttggactctgcaacagcacgagtggagctgtgtgtgcctgtggacttgtgccctccctgggagagcgtcccctggccactgtgttaccgcttgctcagaagggcccatcgtgctttgtacgctcacccagcaggagggctggacagccaggagaggcaggggttgccacctgccctcaaggcctcagcccatctttagtgtatctgcaggcatcagagaggtcatttgtcccttaacattaggactctggtccaggccaggctagaggtatgggtcatgcagtgaccaacacacctggcgtcctagccattcatatttgggagtctccaggagcctagtctcttactgcttggggctgtgaggggattgagcctgtaggtaggcgagatctgtgctctgtgagccttacgccctttgagccatggtcagtctggtaggccctttcctgagaagctctgcccttgtgttcccacagatcctatgaatgcactccagagcctgactggcggacctgctgcgggagccgctggaattggcatgcctcctcggggcccgggacagtctctgggcgggatgggtagccttggtgccatgggacagccaatgtctctctcagggcagccgcctcctgggacctcggggatggcccctcacagcatggctgtcgtgtctacggcaactccacagagtgagtaccacacttcttggaggatttgccgctttccttgcaaacgacaacacattttattcctgtgcttatgatggtatcaagaaaagcatggagaagctccaaatcgctctggtttttttgttttttaaatctttgttgtatgtggagagaaaaggcttccaattttcgttgagctcccagaagggttaagtgatgctgggccctcctcctcctcctagccctgggcaggagggtggggatggcctgagactccatccaaaggtttgtgttttgtggctgaaatagatacagtgtgtttcagagggttctcagctacaaggcagggctgagtgccagcaaccacaactccactgtctgcccgagctctgggcaccatctcttctagtgctgcccttgccccttggtcaccatgggtgtggcttgcagccatattatcttctggcttcctttctgtgaaggagactctgtgtcctctccacacggctgctgtggtgggaaactgggctgtgatcaggtgttataggtgaaccaaagctgctctaaaggggaggcaaagaacctccctcttctttccaggacctgtcttttgagacggggtctcgctctgtgggccacattggagtgcagtggcacaatcacggctcactgcagcctggacatcctgggctcaggtgatcctcacaccacagcctccaaagtagctgggactataggctcacagcaccgcgcccggctaatattttgtattttttgtagagatgggacttcaccatgttgcccaggcttatcttgaactcctgggctcaagcgatctgctcacctcggcctcccaaagtgttgggattacaggcgtgagccaacgcgcctgcccttaggacctatcttgatgtatccttgagtcccatcaacatttcttagagtgtgctgtgcccactgcaaagtgctttagtgtttttttcccctttcatgtaactttttatttttaaaataggagtcacaggaagttgtggaatagcatagagagttcccacatgccctttacccagctctccccaataatagtatcttacatagaacattgtcaaaaccaagaaattaatgttgaggcagtgtaatcacctcagttagagacttagcttggacttcatcagttttttttttttttttgagacagagtttcactcttgttgcccaggctggagtgcagtggtgtgatctcagctcactgcaacttctgccttccgagttcaagcagttctcttgcctcagcctccgactacctgggactacaggcgcctgccaccatgcccagctaattttatatttttagtggagatggggtttcaccatgttggccaggctggtctcaaactcctgacctcaagtgatcttctctcctgagcctcccaaagtgctgggattacagacgtgagccatcacgcccagccgacttcatcagtttttttacactcattcttgggctacatatatgggtatgtgtaggtctgtgagattttaccacgtgtcaaatcaagtagccatcaccacaattggcatgcggagccgttccattaccaccaaccaactctcttgtgttacctctcagagatcgcgccctccctccagccttaagcagtgacaattgctgatctgttgtgtgtctctgtagttctgtccctttgtgaatgttgtataaatggaatcataccatatgtgactttttgagattggctttttaaattcaatctgatacccttgagacccagccaggttttatcagtaattcattccttttcatcactaagtagtgttccatggaacggattttccacagtttgcttattcattcacccatgaaggacatttgggttgtttcctgcttttgcttactattatgcaaacaaagctgctgtggatatctgtgtacaggcttcagtgcttcaatatatttttgtcacacatccctcatgataaccctatgaagagggcagcatcgccccctctgctttgtcagtgtagcagctgctaaggagaactggagtcacaccccaggccaagagctgggatcgaagctgctgcctgaccccatcctcacactcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttcatctagtgccaccaagaggacagagcctgggtcagaggttttgccagggactctcaaagggtaggccaggggacattgtgatagttttcaggtgacccaggttagtcggaaaaggctgaaactgctggttgttcctatggctggggctgcagtacagagttggaagcaaagcttttcactctgcgcatttttgtttctcatgagttttatatgacgtgcatgtaaagccgactttaaaaataatttctactgccagttgtgtgatggactggggtgctgaggacatgttctcctcctggataactaggttctggttaggatgcactttggaatgctggcctgcagcagttggggaggctttgtcctcctgagcctcagctgctgcaaggtgggggaagaaagcttgggattcctgtagtcagccaggatttgtgctgggtcctgtgtcaccccccataccccccagaagcaggtgcagattggagcaggtgcggattggaggaacatgtccccagtgtaagacctgtgacagttgcacattaaggtcaagcaatcagcatacaaagatcaccagccttgaagggaaggagagacaccatgaaggtgaacagaaaaaatagacacatgtaggcatgcccagtgaccacacacacaggaactgttagttatgggccatggggtatataaagaaataaagtggagagccgggcacagtggctcacgactacactcctggctactcgggaggctaaggcagggggattgcttgaggccaggagtttgaggctatggtgaactatcattgcaccactgcactccagcctgggggatagaacgagacaccatctctgaaaaaatagaaaacaaaaaggaaaagaaagagcagaaattcaaatgaaaaagcatcatcaggagcaatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaagaaatgaggataagatcagaaattctaattggcatccaagcaaagccccggaaggatcaaatggagagaatggaagaaaacaatatgtgaggggataactactgagaaaagcccatctggccccaaccaagttagccatctcatctgctgtgagactgcagagcaccaaaggccagaggaatgtcttagaaataggcagttcctgcaaaggagcaatgagtacactcagcagtagagtcagaaaggtaatagaatattgttaaagcattgagaatagagctgccagtcacatttgtatgccagcaagactcaaggatgtggaaagcaagccatttttagataaacctagccttagagaccatcactaaaagattttctaaaggatatatctttttttatcctttttccaataagccttttgcactcttagatatattcttttgtttatcctttcctcttccctctcaggtgatacaaggtaaaatgggaaaagaaacgttgagcataggtgatagtaaatgtgtataaatctaaagcagtgattctcacccagggtgacattccaccacaggggatatttgacaatgtctggagacattttgggatgtcactactgtgggggtgctgctggtgcgtaatgggtggagaccagaggtgctgctaaccatcttacaaatacaggtcagtccccccaacaacatagaatcatctgggtcaagtgtcagtagtgaaaaggttgaaaatcgctggtgtaaataaaaatttacctctgtaaaataaaacagtcaggctaacctccatacagacttgccacattccaagcactatttcatttcttttctattattattattattattattaagatggaatctcgctctgtcaacaggctggagtgcagtggtgcaatgtcggcccactgcaacctcgacctcccaggttcaagcgattctcctgcctcagcctcccaagtagctgggactacaggcgcgcgccactacgcccagctaatttttgtatctttagtagagacggggtttcaccatgttggccaggatgttctcgatctccagaccttgtgatctgccctccttggcctcccaaagtgctgggattacaggcatgagcctccgcgcctggcctattattattatttatagagctagggtctccttatgttgcccaggctggtcttgaattgctgggctcaggcgatctgctctgccttggctatccaaagtgtgagattacgggcatgagccacagcacccaaccccagggactattttgagtgttttacttacataatagattatttaattcttagtccagtgtgtggagtaggtactattattgcattttctaacagggaaaactaaggcaatgagcagtgacagagttgaggttttgagtccaggcagcctagcttggaggctgtatccctagcctcaaatccatccagcctcttaatagaatgtctgctgtgaagagttaaaatagatcaacaaaatatgaaataaatgcaagtcagcagggagatagagcgtgaatatcggttctgtcgggtacatataaaacctactttaaaaagtagtaaatttgggaaatgctaaaatattgatgaggtttatactttaagttaaatatgcatgataaaattgaaaaattattgctaaaacaatggaaataattcataaaatttaagatcaatagaaaaaataggataaggcagaaatccagataatacaaagttcaatccaatcatccaacaaaaatgcaatcaaaaaagacaaagaagcttagaaaaggaaagacaaaggccgggcgcggtggctcaggcctgtaatcgcagcactttgggaggctcagtcaggcagatcacgaggtcaggagattgaggcgatcctggccaacatggtgaaacgccgtctctcctaaaaatacaaaaagttagctgggcatggtggcgcatgcctgtaatcccagctacttgggaggctgaggcaggagaatcgctagaacccgggaggcggaggttgcagtgaaccgagatcacgccactgcactccagtctggcgacagagtgagattccatctcaaaaaaaaaaaggaaaggaaagacaaatattaatagaaaataagtttaaaaatataagtaatcataataaatgtgagtggactaaacttttctgctgaaagataggaaatgtgagaacaaatggaaatgaaacagcacagttgttttattgttagaagaaacacacacctacaataaaacatgcggaaggatttaaaaataaaagatgaagaaaggccaagtgcagtggctcacgtctgtaatcccagcacttggagaagctgaggtgggaggatcacttgagcccaggagttcaagaccaacctcggcaaaataggagacccccatctctacataaaatttaaaaattacctgtaggtacacttgagatgctgaggtaagaggatcacttgagcccaggaggtcaaggctgcagtgagccatgattgcactattgcattccagcctgggctgcagtgagacccaatctcaatcaatcagtcaataaaattagctgagtgtggtggtacacacctgtagtcccatctacttgtgaggctgaggtgagaggatcgcttgcttgagcctggaacgctgagtctgcaatgagccacgatggagacactgcattccagcctgggtgacagagcaaaatcccgtctcaaaaaagaaacaaacaaaaaaaaggatgaagaaagatgtattgggcaattacttcaattacatctctttgttattgataaacagaccaaaaaattcatttacagaaaatttgaacaatgtaatgaacaacttaatttaagcatatgatggaacaatatgtttataaaaataaatcataaagcaagcttcaacaatttcagaaaatttaaaagtattgtcatactttttgttgttgttgttttgagacagagtctcactctgtcacccaggctggagtgcagtggcgcgatctcggctcactgcaacctctgcctcccgggttcaagcaattctcctgcctcagcctcctgagtagctgggattacaggcacgtgccaccatgcccgctaatttttgtatttttagtagagatgggtttttgccatgttggccaagctggtctcaaactcgacctcaagtgatcctcctgcctgagcctcccgaagtgctgggattagaggtgagaaccaccgcgacccgccggtcatacatgttttatgaatgtcaaataaagttagaaatctgtcacaaaataaattaaaaattttttacacttggccaggcacagtgacccacgcctataatctcaacactttgtgaggtcgaggcaggaggatcacttgaacccaggagtttgagatcagcctgggcaacaaagtgagactgtctctataaaaattttacaaattagttgggtgtggtggcatgcacctgtagttccagctactcgggaggctgaggcaggagggtcacttaagcccaggaggtcaagggtgcagtgagccacgatggtaccacttcagtccagactgggcaacagagtgagaccccacctcaaaaaaaaaaaatcttacacccatcagaattgctaaaatgaatagtgacagcctcaagtgttggtgacagagaaactgaatcactcatatattgctggtgagaatgtaaagtggttttaccttctttcaaaatgaaatatgcaactcagcagttacactcttgggtatttttcctagagaaatgaaaacctcgcataaaaacccatgcacgaattttaacagcagctttatttgtggtagcccaaatctacagttacccaaatgtccttcatgtagacggttaaacacactgtgaggtgcttgtaccatggaataccctggcagtactgttgctagaactacaacctgtatgctgaatgtaaaaagccgatcccaaaaaggttcatactgtatggttccatttttgaaatattatgtataattttgaaatgacaaaattttagaaatggaggatgctgcagtggttgccagagtttgcgggtcagggttgctgagagaggtggcaacacgagggatccttgtggtgtggggactgtgtagtgtattgactggtggtgactgaacccacccaggtggttaaattgtccagaacttagtacacacacccacacaagtgagcacacatcgtggttgtgataccttgtaagtttgtagaatgttaccattggaggaaactgggcaaagtatacaaaggatctctctatatttctttaatacagctttattgagacataattctcattagcatacaattcacccatctgaagtgctccactcggtaggttttagtgtaatccacagagttgtgcagccatcagcacaattttagaacatttttatgttcaccccaaaagaaacctcacctcagaaaatcttgtaattgactgttcatataagcagttttcataatagccacaaagtagaagcagcgcaaatgttcatcacaggaaatcggtgtagtagaatattatttggcgataaaaataacacagaaaaactgataacatgccacgacatgggcgaactcgtaaatattatgctaaagaagctagtcacaaaagagcacatgttcgatgccattcgtacaaagagtccggaagtggccaatccatagagacagagaggagattactgattgccagagtctaggcttcttatttatccaaaagacttagttgtcccttttcttttgtctttggttattatagagtaactcatgataggaaatcccaaaatcaacacaaatgctacttcgtattctatctttctgtctgtggtaaatggaacgttcagattccagcggcagccgtggcagtggggcttttgctggctgttttgtcccttgctgtgcagccctgcagcgtttctgggaatctgccctgtggactgactggcgactctggtcttttctcagcccagctgcagctccagcaggtggcgctgcagcagcagcagcaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaaattgcatcatcaaaatcagcaacaggtaccaggtcccctgttcctgctcttggcctccctcctgcagcgtgagccctgggctggcatcagccacaatgctgggtgcagtgcccggagccagccgagggttctcttgacacgtgtgcctgcccttttccatgggcttctcaaaaagtctgggacaaggccgggcccagtggctcatgcctgtaatcccagcactttgggaggccaaggcaggcggatcatcaggagttcaagaccagcctggccagcatggtgaaaccccatctctactaaaaatacaaaaaattagctggacatggtggcgtacacctataatcccagctatttgagaggctgaggcaggagaatcgctagaacctgggaggcggaggttgcagtgagccgagatcgcgccgctgcgctccagcctgggcagcagtgagactccgtctcaaaaaaaataaaaataaaaaaggaaaacaaaagtctgggacaggcaggagaaacaggccctgactcactaggaaggttctgtgatcgagcccttccatttgggcttgggcatctggcggtgggcctcctgtgtagttcaggggctgcgagggattcaaacaagagtgagctgaagcaagaagtgagacgaacactctgaggcttgggactacttgagccattgtgggccattttggctgaggacacatgtgcctcctgtttacctctgtgtcttgggttctgggctcagtgttagtcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgttctgtctctagatacagcagcagcaacagcagctgcagcgaatagcacagctgcagctccaacaacagcaacagcagcagcagcagcagcagcagcagcagcagcaggctttgcaggcccagccaccaattcagcagccaccgatgcagcagccacagcctccgccctcccaggctctgccccagcagctgcagcagatgcatcacacacagcaccaccagccgccaccacagccccagcagcctccagttgctcagaaccaaccatcacaactcccgccacagtcgcagacccagcctttggtgtcacaggcgcaagctctccctggacaaatgttgtatacccaaccaccactgaaatttgtgagtacctgtggcccacagtggagcacatgcagcccgtggctctgtcagcagtagtttctaggctctttggctagagatagcatatcctattcttcaagtgctgagacttcaggcagcccccaccccttgccagccctgccgactctagcatggctcagcagggaagcatgtgttttgcattttgtgttctgagagctgcttctgcaccccgcacagggtactgctgctgctactggggcaccaagtcgcattccaagcagtgtggctgattgcagcagttctgtgggccctttcagggtgtgagcacttcgactgatgagcaccacatgaaaggatgtgccagctccgtcagtgtctggtggtttgccaactactcagagttaatgttctaagcaaatatctttttttttcctttacactctgccaagtctcaggagaacaaagttcattactatatttttgagaggagtattaatataaaatactgttattcctagtttcattttgtatctctgcacaaagccagtctactcagtgacaggcacagaggacagagtatgatcaccaggatgaaggtagctgcatcaaggggccatttggacaactctttggctcccttggtttttgtggccttttctgtttgtgattcatgagtggaatggggcctgaggcaagtgtgggggtgaacaagaggcctcataggcagactggaagtctaggagagttgtgaggagcagatatgctcactcatctgtcacctgggagtcgacacactgcctgaccccggggactgtgcagactgaaacccttgtgtgctgcatggtggaatgtgccctggcagggtttgccctagtggcttggagatgtctaaggaagagcccgctgcatgttggaatgtgccctggcagggtttgccctggtgacttggagatgtctaaggaagagccccctgcatggtggcgcgggcctgtctcgtccttctggaggcccctccatgcagtggctccacagttgccccttttgcccaagtttgccccccacccccacttttttcttttgaagacagggtctctgttttccaggctggagtgcactgatgtgatcagacctccctgctcaagcgattctcccacctcagcctcccaagtagctggggctgcaggtgtgcatccccacacctagccaaatttttgtatattttgtagatatggggtttggccgtgttgcccaggctagtcttgatctcctgggcttaagcgatccactggccttggcctcccagaatgctgagaatacagacaggagctactacgccctgccctctgctggccggctaacccagctttccttcaaggaatcaggctgagtgaagctcttgtggaccatcagcatgcttggcccagaggatgagcaggctaggctgtaagctctgcattggaagtcgtcagtgcttgtgatagctggtgctgagggatgtgtggagacatcccagtgggagggccacattgccacttgccagaattggatttgagctaatgggatcctagatggccagtaaggtgacatcacagcacatgaggtcatgaaagtcccattcctcacctcaagaaaggctccatttcctaagcttccacaggaagactaggctctgctctctgacccaggtggttccaaatcacattctctctttctccctcaaggtccgagctccgatggtggtgcagcagcccccagtgcagccccaggtgcagcagcagcagacagcagtacagacagctcaggctgcccagatggtggctcccggagtccaggtgagggcctgggggtggagggctccatagtcatcagcaggtgcatgttcacctgcgcatgtagtgctacagtgagggttctggttggattaggggctgggggctaagttggtaaagcaggggcttctctcccccttgcactctgcaagacacccctggagtccttggggtgggcagctgtgcttggtcatgtctaggacccaccagccgcatagtgcgtgtcgtttccagctttgctcgggcatccttcattatccctcttccttgccactctgagtgactctgggaacatgtatcagagagtagaaggctgcagttttctcctcacctctcatcttccatttgagagtctgagtacagagctgaccagggtggagggcagctttctagacactcggaagcagatgggagccacatgcagcaggagcgtgggagaaggcatcctggtgctcgcctgcactcagggactccggcgctgtgtggtgagaagcgtgccactcccacattgctgagcttgctggtgtgtcacatgtgtggaatgtgtgtgtgtctctgtgtgtcacgtgttagtggaatgcagatggccttgtctggcctcctagtgtcctgggattggaggcccagggtttctgtaccttttcctataacccctcctctccttcttgtggggagacgtacagtctggggcttcagtttttcctcttttcacatgatggtggaaacactgttggtcctgactcggaaggggcgttggctttagaaagagtcagaatgtgctagttgatgtggtaagactgtggctgggtcccagcccacagctggcagtgcgcctgcactttgctgtcgtcttaagggtacctggccttgtggttttctgcaggcctgctgggcgcagcgcctgggtgcacagtgcctcgtggcaggcttcatctcacgcttggggggtgctcagtaatgtccttcatggtgcctgctacctcttttaagtccctgggaagctgcctgaggagggaatctgaggtatttggctgcagctgaggttagcatcctaccttggcagggcaccaaatgacttggggccagggtccccatgtcacattcttacttagatggagccctgtatgaaacacaccacagaactcacatttacttacagctgggggaggctgaccacttcgtgtgatgaggttggaggtctctgccacctccctgtgtgtctcggcatgtcctcaggcctcgtgggggggctcccttgtcctggtctcatgcagaggaaggacgtggtgtgttcagagtcagcttagtggtggcacatagtgactgcccacccagtggaagctgctacctttgcctctttggaccatcgatcctctgttcaggacctcacttcctggaaactttttttattttttgagatggagtcttgctctgttgccaggctggagtacagtggcacgatcttggctcactgcaacctctgcctcctgggttcaagtgattctcctgcctcaggttcccgagtagctggaactacaggcgcgtgccatcacacctggctaatttttgtatttttagtagagacatggtttcatcatgttggccaggatggtctccatctcttgacctcgtgatctgccggccttggcctcccaaagtgctgagattacaggcatgagccaatgcgcccggctggaaacttctgtaccgcaggtcaagcccagcaggaaagtgagaactgctcttttctttatttctttctgtcttttttttttttttttgagacagagtctgactctgtcatccaggctggattgcagttttgcgatctcggctcactgcaacttctgcctcctgggttcaggcgattcttgtgcctcagcctcccaagtagctgggactacagttgcacaccaccacacctggctaatttttgtatttttagtagagatagggtttcaccatgttggccaggctggttcgaactcctgacctcaagtgattcacccgcctcagcctcccaaagtgctgggattataggcatgagccatcgcacccagcctagaacttctcttctcttctcttttttctcttttcttttctttctttctttctttcttttttttttttttttttttttttttttttgacagagtcttgctctctcacctaggctagagtggctggagtgcagtggtgcaatcttggctcactgcaacctctgtctcccaggttcaagtgattgtcctgcctttgctcccaagtagctgggactacaggcatgcgccactatatccagctaatttttttttcctcttgtatttttagtagagatgggccaggctggtcttaagctcctgacttcaagtgatccacctgcctcagcctccctaagtgttgggattacaggcgtgagccactgtgcccagccgaactttccttttctttccatttcttggtatttggaaagtgaatagccatggagcagccagtgttttcagctggtgcaggcccagctggtatgttcgttaggcttctagctcaaggaagtgtccactctgcagtctcactggcatcccatcaccgtccagaagcaggatgccagctgtgtgtgctcatggcccatgctgagcctgtccttgggccactggtcttcctgtcggtttctccaccccttgtttcaggtggaggtccccgcccgactggcacaggaaggaggatggagagtggttaccactgtggttcgttgctgagtgagtttgatgttttaaggatcattgcccacctgccctgtggcaccatgtgctgccatgcaggggattcccaagtgctagtggcagaggagccttgtagtttctcaaagtccagcagtgggtagggcgtatctatgaggtgcttctcagtccagatgtggcaccttgaaattctgtaacccgcattctgctggttttctctcagagcttggtcttgccttgttgcaagcagtgcagtttcttgggggctaattgggcaccctcactgccttgttccaccaatagcagcgccccctgctgggggatggggagggttgggcacagcaagccctctgaggggccatctggattcatgatcttcttttgaaacttgaattggcacagtgaccagctgaggctacggtactctgatctaaaaactttaaaagtatgtgtggtaactgtagaacccagaaagtggagaggaacagaagtaagagaaccattccatgagagagaaggtctggtgtcctttctggttgtttcccatagtcaaggtcatgctatcctggggttttttgtgcagcatcttccacatcaataggggatgaaatgttctcctttaattagaaagccctggtcggcacgaaggaactcttgtcatacccctctgtgaatgtctcttgccatcctcagttaccatcttgttcttggaccttgtaataatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgcggaaacaggcctcttgagttcatgaatgaaattctgggattgggggcccccatgcaggcagccctccatgccctgtctctcaagcccatcttagagccgaagagaggcgccctgtcaggcccttgcagtactgtggtgttggatgtggtaaagggtagcctgggactgagtattctagaaaaattgctcagccttgtgctgtgcacacctggttctctttccagtgttatttatgtagctgagaagggcaatgtcacccacaaggggatttagcaggacacagcagacttctttttctcccctataaaaccaagacatgcaggcacagtggctcatgcctgtaatcccaacgttttgggaagccaaggtgagaggatcacttgagaccaggagttcaaaactatcctgggcaacacagcgagaccctgtctctacaaaaaaataaaaataaaaagttagctgggcggagtggtgcgtgtctgcagtccctgctactcgggaggccgagttgggaggatcgtgcaagcccaggggtttgaggctgcagtgagctgtgatgacagcattacactctagcctgggagacagagcaaaactcttgtctctttaaaaaagcaagaaacaggacagaatgcatctcattttctttttttttttttttttaaagacagagtctcttgctctgtcacccaggctggagtgcaatggtacagtctcagctcactgcagtctccacctcctgggttcaagggattctcctgcctcagcctcccaagtacctgggattacaggcatgtgccaccatgcctggctaattttgtatttttagtagagacggggttttgtcatgttggccaggctggtcttgaactcctcgccttaagagatgtgcccgctttggcctcccaaagtgctggaattacaggcgtaagccactgtgcctggccatgcatctcattttcaaacagtccctatacctttgtcatttaacgttctattcttttagtatgtgaaaaccaaactctaatttacaagtcacaaagaattatccaagacagactcccattgtggacatgtatgtggcattgctgattcacagctactgtactgaagccttggccaccctggaggaccctctctctttttgctggacccttctgcacagtgactgcagtagggagagtcagacctgggggtgggggagaggttttttggattcctctctgggtagatgtgtgttgggaagtagtgaaatgttgatagctgcctggctcatctgatccagtaaacataactggtgcgtttgggttgaaagaaattgggctttccttatcagttctcagttataagaacatcagtcagcagtacattagacttaagctttgcattccttgcgtttttttgtttgtttttctcttcctggaaaaaagtttgcttctctcataccatctgacttacttccaggcttttctcccttgtggaacgagtgccgttgagccctgctgcactctcagacgggctcctccgaagtgccgcaggtggtggtaaatcgactctcacccactggggtcgctccttcgtgtctccccccggtcggttcatctgttgctctggctgcaggaggaacgagtgagcttctggtcggcgtctgccatgccgtgtcaccccggcttctggcacctcctgtgcgtgcccaggattgtgaatgtgggccgtgtgtgtgaggccacgggtctccctgcagccactctcctgctggagctctgttactggcacctgtcgctgcctgcaccgaaggctggcagcacctcctggagcttgggacccagagcacagcctcccaccatgagatgtgttgtttttctgtggatcagtcctcctttctttctgagcctggcgtgttttgttctagtttgttaccgtcctaagtgcctgtaggccctgctctccagggacgagactcgggctctacccccaactcagaacccagagcaagagtggtcgggcccgggcccacaacagtgctcagctgtcctgctgcctttgtagttcaagaagtgtccattgatgaggggaatggtcctggctcatgctggagttcctgactcgcatccctgtggagatgaacttcctcgtcagggcggaggcctgccaagcagtccccccaggcttctcttgctcacctttgcccatttttattacgaaagaaaaccagttccttgatagataccaggaccatcagcctcaggcctggaggaggagaggaggatgatttgggttcgggctgtaagaggtgtgccactgagaaggagggatgctgtgagcaggcttaactgagctcatggttcagtgggagttgagtgttctcatcacaggctttggtggaatgtactcttgacatctgtccccaggagcctggtctccagaaacaccagctcaggccctcaaggtctggctctgatggttctgtgggctataggattctgatctgttagcgaggtgtgttcagaagtgtgttgaggacaccagtgcaggagagcaaccagtagaacagaaaggtctggaagcagcattcttggcaaatcttctagattcccaatgcccagacagacctggaggtgctgtgggcttgaacatgtgggtggcctcccctcccaggctgccccgagctgcccaagctttccttgccctggtgctccttcttgcagaggctacacgtgccctctccacctgcccaggcactgagtttctttgttgcgatcaccttgtctgttgtccctctgtcctcaaagatgatcacggaagccttggcccaaggtgggatgcacataagagcccggttcccgcctaccaccgctgtgtccgccatcccgtcaagctccatccctttgggcagacagcccatggcacaggtatttacggggcagcgcccagggcacggctgggagctcggggcgtcctctgagcgcctttgtaaagcgcacctgtcattatcatcgccggtgacttcttttatggtggctttcagagtgccaaacccacagtccctttttttttttttttaaatgaagccaagcccagcttgtgcttgttgagaggatatgaataaatatctgggtcttttcagcttaaaatagttatactgtacgcattttcatggtaaaaataaaacagcagctaagcaaaagttttgctttctagagctgtgctatctaatagtgtagccactaagcatgtgtggctgtttacatttaaattgactaaaattaggccgggcacaggggcttatggctataatctcaacacctcaggaggccgagatgggaggatcacttgaggccaggagtttgagaccagcctggttcacatagcgacatactatctccaattaattatatacattttttaatggaaaatatatatataaatgtatatatattttaaaaacaaaaaaaaaacctaaaagtcaactaaaattaaataaaatgaaaaaatgcagttcttcagtcgcaccaaataaattttaagccctcatttgcccacagggaagctagtggctgctgcagtggacagcacagactccagaacgtggccaatgtggccaaagtggtattgggccatgctgttgtagagtttgatgtgtagagtgtgtaatttgtaacacagatcccctttctaggtagaggtagacttctgtgtacattatgcttttcagagacaggaattcccggcttcttttattgtatgaaatttggaattactccatggcatagtcatttttttaacaaatagttaccacatgcattctgtgtgccaggcactatgctaagattctgagaataaaattatgctgaagttctctcatcatacaggctttccattttagtgggtttgtcgtgaaaacatcaaatttgccaaaagaactttacaattcagtttctgttttaggggaaatgcctctataatcctagcagacagtggtccctgtccatccctgaacgcccaggtgcaggcactgccaccaccctggcttgtgcagtggcgtctctgcagctctgttctacacaggaagaagtggaggctgagccaggatggcccttggtccatgtggccccaagcctggtgccacacaccacacactgccaagaaagtggcctgggcccccactggggcatgtttagcttttgccttccctgcatactaaccccctgggttaccccagatgtgccattcacatagttactgactggaacttagtttctttggcagggacttcctttttagtagttgttgaattacagcgggaggaagtgcctggaatctgctggtagaaaggctttggtgaaagagctctccagaggagcggaagttgggggtcaggaattaggttgtgtggctgtggtggaaaggaggccagtgtgggcagaagccagggtgcagttccccatggcctggaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctcccagcttcaagcgattctcctgcctcagcctctcgagtagctgggactacaggcgcctgccaccacatctggctaatttttgtatttttagtagagatggggtttcaccatgttggccaggctggtcttgaactcctaaccttaggtgatccgcccgcctcggtctccaaaactgttgagattacaggtgtgaaccactgcgcccagccttgtactgtgtttttaaagcaggtttgttcatgcttgttagctgcaagaaaggaaactggaaggagttgagggagggagaaaagcgaatagagggacaccctggagtggaagcctccctactgcccaggcagctgctctgcagccctctctggtcctggccttccccgcagagggccctccccagctcagccctctacgtccggctgcagtaccaggctcttggtacagtctcccacacctggctgtgggccagccttggggacgtgaggcatgctgggccccgtgtaccaagggcattcacctgaccacaccaggtggctccagaggtgtgcctctgcttttgtgtcagtatctttcaatccagtcccttccgagaaaaagagagcttatctcaggaacgtatctgttgatctcaccaggaattgccccactgtgtcccatctgagctctcaggggccagaacctgctgtctccagtgtgtccagatggccactctgtggccactgtccctccagccacttgccctcagcagtcagcaggacacagtctggagactacactgcccatttgctcttgctctttccttgtggcaacaaattaggtccaagaaaacaggtggagctgaaagagggaatgtacgtgccccatgggctcttctccagagggcagggcccaggctccctccctctgtcttgacggctcatggctgcatcttcctgttacggtgggcatgcctcacggactcaggctaccaggtcaagcaggattctgtgctgggtgcattctggacacagtgctcagcacgggggcccagggggtggcatggcccatgccacaatcctcccttggcagatgtaagcaggcagtgtctttctcactaggggcttgtcctttgactagagaggcactgttgcctccctgttccctgctccaatcccagacctgacatgagaccaaggactgggaggtttctttctcgcctctctggctgcctccccagagcctagagcctgtctttggatgagtctttgcaggggctgcttctcatcccaggtgctggacttggactgcccaccactgacacctgggcacagggcctggcttcctgctctcgtgctcttggaaatgaatgggtgcccttcatttgtttttcttcccactagaaatctccctgcctcccatcctctgggctctgctggctgccagctgccagggtgagacccgtgttccactgcaccctggggagtgcctccaggggacacactgagtgccggagccaggagcaaggaacggttcccagtatgtgggggcgggggtggggatcgcgcagtgccgccagccttgcctgagggttcctctgtgagatggagctccctggaccagcctttttgccctcccacctcctctctggcccactcggtgtccacctgccttcagctccaggctgctgtgtgggtccctttcccagaaatgcagttcaggccattgttgctggggtggtggtgttgctggggtgttgatgtttagcgtgcctgagctcccttcatcactaggatgaccttgagcaagtcacttccctctgagctccctgttcccaacctgtgacacacaggtgacaggtggtgtgcactcagaaactccttccctaggatgtgtgacattcttgtcctggggcctttgctagctgtgacacaccggcgcccgacctctctggctgcctccctaatgccagttgtgtcttcagatgagtctttggggggctgcttctcatcccaggtgctggacttggactgtccaccactgacacctgggcacagggcctggctttctgctcttgtgctcttggaaatgaaagggtgcccctcgtttgtttttcttcccactagaaatctccctgtctcccatcctgtaggctctgctggccaccagctgccctgacctggggcagctgaagaactgagatagacctaagttctgggtgggtgcttggaggccccacgggcgtggctggtgagattgccgcttcagggccaaagtgggtgccgggcttcctgaggttcgagagcagatgagaactcttgagtggcaatgagggctgtgtggtggccttctctgcttggcagcctctgcccagcctgcagctgccttgctcctcagagaagcgctgagctttaggccacagaaaagagctgaccatcttctagaagggacagctgctcaggcacaggcgcctctctggaagaggcagtcaggtagaggcaaggggaggggccctgaccttcaagcaggaagagaggtgagcttgtgagacagctttctggggtgcaggtagagagtagcagcaagtcaagcatgggtcagaaaaggcagagttgggctgagcatggggcccagagtctttgcttcccactcctcggtgccgtctgtggttctctgtatggaattttctggccttgggattttgttgacacctggataagtctagaacatgtgttccggtgtctgggacatgcccttactcctcttcagctagggctctgtgcaccccagcaccgtgaatgcacaggactttggtgggagaaatctctgtacttgttcaactcagcatttagcaaatgaagtcacatcagtccccgtttctgaccttgctaacctttgcgagaatcaccgcgagccattttgctccattaggtagagtgatgaggcccggcaggccgaggctggggctcctgcactctgtccctcctctcccaggcagaggtgtcttgaccacaaagcagtgggaacagtccattccatcggttgatgtcccactgggccagtggctttggatagggacctctgacccagctgtgctggaagtaccctgttgtggtcacgctctgtgccttagccccccaccccctggtctcccagcacacgtggttcaggaacggcctgcacccagcatcccttgcagcactgtcaggcacagcccatggaacaggcaggacagaaagagcatttcgctccaggagcttggtccacgtggtgctgaaagggcagtgccaccctgccctctgctgcctggtggggtggtgaggagggcagcattctgtttgtgggctctgggcctggtccccaatttaaggagcttagaaagcagctgtcctatcccagtactcacagcactgtggtggaagtgcttggggggtggtgtgagccgtggcccgagacaggcgttcatggccagagtgccccaggagaagcactgagttggtctacagaaatggatggtccaggggcctggctcctaggcagactgtgaggggatgcttggcatgcagggggttgactagggtgtgggaaatgtagcagggccttcagggttcccccagtgtgacaaggcatccctctttgctgagagtccctctaggggaggccagacgcccagggctggcaggcagctgttctccccatcaaagcagccatctgtgctccaccccaggaaggtgtgggtgttttacatatgcttatccctgatgcctgggtggtgtggtttcatccctagagtttacggatgaagacagtggtgtccctggtgcagacactggggtgattgatcttatttgtgtcgtggccagcaaggcctggggagcagagcaacagccttgctttgcatacacacagggcctcagaggactcaggtgcacacctgcatggcagaaccaggctctgggcccaggtgtctgacactgagtagctcgcctctcccaggggcgctggtgtgggccgatgcaagtgccaccatgggtgtgtgtgtggctccctgggccacctcactccaattaagcaggtccaggtgggacagcctgggaccagccctgcagcagcatgtgttaaccacaacagatggctgtagccaccaggcttgtccttggtgcagtcagcctgggggctgcgggggcttgtggaagcatgtgggaagacggtcccactggtcagcagagcagggtcctcaccgacccacagaggagcatgtcacaggacaggcaggcgtgtcagggaaggccaggctagtgccagccaagggcattgcctcccagactgcccttttcctcacactcccacgacacagccctcaaagcctgtgcccctgtgggtccctggccaaggagcaagggctgccctgcctgggccccccccgccagccccttggtcacctcatgctgtgtgccaggctgggggagtgtgcctgtgtgtatgtccaggtggcatttggatgaagacacaggtgtgtggtgaggctgtgcgggaggatgggcctatgcgtgcggtgggcaggtggtgtggaggcaggcgggcgggcgtgtggcagcgcgccggctgagcccctccacttccaggtcagccagagcagcctccccatgctgtcctcgccgtcaccgggccagcaggtgcagaccccgcagtcgatgccccctcccccccagccgtccccgcagcccggccagcccagctcacagcccaactccaacgtcaggtaggcctggcctggggtgcccctccccacctggccctcgaggctggccctgcctggaccccggctcacatgtttctctcacttggctgcagctctggccctgccccatctcccagtagcttcctgcccagcccctcaccgcagccctcccagagcccagtgacggcgcggaccccacagaacttcagtgtcccctcacctggacctttaaacacacctggtaagttgggcctgaggtgctaaggtcactcctcacctttatgaggcctcagctcatactgggtgtgcgagctctggggccctcagagctcaagttccccacccgagggtcgagggctgtggcctcacccgcctgtgtcctgcagtgaaccccagctctgtcatgagcccagctggctccagccaggctgaggagcagcagtacctggacaagctgaagcagctgtcgaagtacatcgagcccctgcgccgcatgatcaacaagatcgacaagaacgaaggtaggctgcagccagggcaggggcctgcaccctggggacaccaccaggcttgtgtcttagtgtgtaccctcttctgtcccagacagaaaaaaggacctgagtaagatgaagagccttctggacattctgacagacccctcgaagcggtgagctttgcccacagcccacggagggtccacaagggcacagatagcccagccatggatgggcacttggtgatgatgtgggtttaacaaaggcaccaggcagctctttggaccctggccagaggcctccaaggctccactctggtgtgtgctggggcttcaagcccaggcttcatcttggcccatgcccagcctttgccctattcctggctgctgctgtggccctcatgctgggccatcacagccagacctcatccagtcagcagccaggggcccagcttgcagtggcctgaccatcagctggcccagatgggcctgagcctgacctggagttctgcccctgacttgctggtgaccatgggcaggcgactgcatctcagttaccccatttgtagcccacgtgtgttgtcatgaaaatgaaacaaggtggcgctggtgagaagcaggtggaaggcagggctgctggccacaggctgctgtgaggatcagagctcgggcagtacctccaaactgcatgggcattggcatatacctccctttcacctcaactcaggctatcccccaacccctgtctagaagggtctctctgttctgcttgtctggatagaatgccagtcactattgggtggtcctccaggtcttcatgggttgatcctttgttagggttatagggatgagtggggcagggactggcctacatgacaatgaggcattcacagcctgatcaggggcctggccactgtcccttctcttgacccatcacctcactctgccaaccagggacaagcagctcctggggttgagggctgcctgccttcaactctgggtctgggaacagctggtcaactggtaggagctcctgcagaggtttctgatggctgaggcccagtggcagtagttgggatcctgagcctgagaactgccatgtcttccactctttcagcccaagtcctctctctctgcaggtgtcccctgaagaccttgcaaaagtgtgagatcgccctggagaaactcaagaatgacatggcggtggtgagtgggatgccagacacccctaggggaaccagggctctcctaagagctcctgggagtgctgctgagagggccttcaaggtcagggcatctgggcgggggccgggcctgaccttggaccctgcccacgaggcttcctggccaggtctgctgtgctgggtgggaacatgggagaagtcaccctctgtctacggcccccgtgggtgcctccttcacccatttcagaggaggcagggactgtagggaggataggctgtgggggtgggggattattcccaggatcagccaacattgtctgcacaagggtggaggctgtgagagaggcctcgggaatctgactgtgagtgaccatgggcctggggtgtgaaggccccctaaatggggaaccctcgggtcccgggctgctgaccgtgcccatcctgtctccagcccactcccccaccgcccccggtgccaccgaccaaacagcagtacctatgccagccgctcctggatgccgtcctggccaacatccgctcacctgtcttcaaccattccctgtaccgcacattcgttccagccatgaccgccattcacggcccacccatcacgtatgtccagctgggctgggctttgcggagggcggccagccctgggccgcgtgtgccaggtgtggtcaccatgccgcctccccagggccccagtggtgtgcacccggaagcgcaggcttgaggatgatgagcggcagagcatccccagtgtgctccagggtgaggtggccaggctggaccccaagttcctggtaaacctggacccttctcactgcagcaacaatggcactgtccacctgatctgcaagctgggtgagtgtccagagggccgggactggtgtgggaaagcaggccctgaccgcagccccaggactctgccatccaagccagatggcacagcgcccagaacccaccctgtgttcacgccccgccaggctgtctgctctatcctcacacacaccgggctccagacagcctggccatgcctcagtccccactgccagagcccgcacactctcacctccccaacacagatgtggctttgcttgcctgggccctagggaggtggtaggcaggacctctgggcacccatcaatgcagagcactccaggcttcacgtttggaaatctgagagtcagagagacctcctccaggctttgccacaagcttcaccagaacctccctgggtgtggagtcctgttccagagcagggctgtgaggcagggcaggccggggcttgtccaggtcacagatagagccttctgtgttgcagatgacaaggacctcccaagtgtgccaccactggagctcagtgtgcccgctgactatcctgcccaaagcccgctgtggatagaccggcagtggcagtacggtaggtagacccagaggagctgtctggggacccagggcaagcaggggtcattgtggaaaaccaggcttccactgcagcagggacagcctctgtgtgctcctgcccctccccagctcaggcccctccctcccctcttctggctcctcctgcacagacagcagcgggttttccagtggtcgcctgagagaaaagggtctctgctcccactgtgtcccttcgccccttcaacttgtgtcacgtcagctgtccagggtggttgtgttcagtgggtgaggggtgagtaagcccatggctcagggacagtccccgctcttcccagaggccactagcttcccagaggccactaccttggcagggctgccaggttccactggtagcttgggcacacagggcccaatctgggtgctgtggctccagagagaaccacggtggcagggggcagtctctgagcccagagctggcacacagcagagctggcacacagcagagctggcacacagtagagccaggctgggtccccaaggttgttagaggcagagccctagatcctgttcagatttggttctcactgacgatgaggctctgggaggagagcccaaaggccgggcagcgtgcaggacacatcacctcctggtgcttcggcccgcgcctggggctaccccttcccagagcactgccgggtgtgccaggagcgagcgcagcgccggccgccttaggttcacgcccactgctctgttgcagacgccaaccccttcctccagtcggtgcaccgctgcatgacctccaggctgctgcagctcccggacaagcactcggtcaccgccttgctcaacacctgggcccagagcgtccaccaggcctgcctctcagccgcctagccaagactgcagggatggcccgcagcctcatcggggccaaggacacacgcctcctgtcagacacttctaggtgttggcttccttagagagcctggggttaggttagctttcctgcttttatcttctgccttggggacctgccaaacgaaatcccacacctgtacagaactgggataggcgcagtggagcgggttgcttggggggcgttggccgacttcttagagaaggccctccatgtgacttcctcccaggagccagatgcgatcctcaggctgctctcaccgtggcctgtccacggtccaggtccatctcagcagcgtgagggtgcactcagggtgttgttagagcgtctcgtgtgtgctagacgcacccctactcgttcctatagaacacagaggacataggaaacccttaaaacacacatgggattctctggtcacagttttgggttcaggctatgctgctttgggcaggtggagcaccccccgaggaagcctgcaagtccagggcacaggctgccttttggagggagggctggcccataggtgctgctggctccccgccaccagctgggcctcagccctcacggcattcctgctgagcaccgtggggcacccagggagcaggggcgtcagggatcctgctgccggcacccctgtgccgctggcatgagggccgtgtccccactgtgaaggatgaagagcaaggccctcaggacccgtgtcctcagagcaccacacactgagcacccagagacagcgggcctggcagcgggccgggccatgcagggagcgcctccctatgttgcctgccactctgggcaccggccagcaccctctggtgagaagaggtcccccctttttatgtgcactaccccaccatctgtgattataataaatttattattcctgtgtttgtcagttgttca

SEQ ID NO: 555 - DNA, 80034 bp, Homo sapiens; identical to SEQ ID NO: 554

SEQ ID NO: 556 - DNA, 7560 bp, Homo sapiens
tctcgtgcaagtggtttattgatggagtgctcttaggagaaggggagtgagggaagcagcgtaggacagaggaaaaaaactgagtaagaatgtgctctcagaagaagactgacttcagcttgattccatgaggagctctgggaaaggaagttccttgatgtaagaggtcagtcttttgtacctccatacaagaggtagcaattcttttctagagatggtctcaaaattagaatacatcaaaatcacttggagggtttggtaaatcagaatgctgtgccaacccccagagattctgattcagtaggtctgaggtggggcctgaggatttgtatttccagcaagttcacaggtaatgctgatgatgcactttgaaaacctccactctagagaagaggacagctctgaggtgttagcacccacagcatctcgcaaaggggatcaggaaagcacctactacatgaaggcacatgccagggacagatggattggaccccaagctggggctatgtagactacatctttaggtcagaacatctagattcacagtatcttgtatgttcctgttgtcatctcacatctcttgccaacgcattgttgaaacattcttacttggtcttgttattggacttcaagagaagggtctgggagatacatgaggctttgaaaaggaagtagctgcaagttgctaggcaaatatagtggcatcagttgcaatggagtggaaagtccttaaacgagtgatcaatatttagtggcaagactctagaccaaccctggaaattgcctgatgtttgtgaaattaaaagaaaatggctttgatggcaacttttaatttcataagccacgccagaattcataacagtctctgctcctgaggatcaccaccaggtgaaggtgaatgaataaatgttaaaatggaattcgtttcttttggtggggtacgtcaggtagaacttggagaataccttgtacccctgggccttaatgtccatctccaggcagtgcatgaggtcgctgttgtctaggaccgccttccagggcccaaacttgacaacagacttgaacatcttcttatcctgcagaaaacacaggacctctgaataatatgcatcctgctcctcagtttccaccaggcacacaagcacgctggacttccgtgctgttatggcttctgcacgtgccaggcgcaccatgagctccaggttctcgctgtagcccggcacttgcagcaaaaactgcttccgagacacctgctcaccaaagatctgtggcatgtcctccagcagcttgaccaaaggcttgatttcgtagaactgagcctcacggtacacttcagggatgtgctgtgtgggcacttgcccagtgcgcaggtagtccaggatgggtctgaaataggtgctggggcggtcgatgaagaagcggccctccgcgtccgtggaggccttggctaagctagagaacatctctgccagctttgagcccggaaacttcctcagggtacccagggtggtggtgtggaactcacccccgacgttcagctccacaacagtagacatctgggggcacaagaggcagagtaaaccaacacgccatctcccctgagcgcattacttatttttatccaaaggataactggataaaaaacttaggggagccataatgattggcttcagctagtgaaaggcccatcttactaaagagggttatatttatgctgtgttgctccagggggtgggctttttttttttttttcgacggagtctcgctctgtcacccaggctagggtgcagtggtgcaatctcggctcactgcaacttccacctcgattaaagcaactctcctgcctcagcctccctaatcgctgggactgcaggcgcctgccatcatgcccaactaatttttgtatttttagtaaagacgaggtttcgccatgtttgctagtctggtctcaaactcctgacctcacgtgatccgcctgcctcagcctcccacagtgcccggccgagggtgggcattttaaagaggaagaaagatttctgtttgaaaaaagaatacccattcaagcatcttaattttaggtcatagaatgttatgggaggaggccaggcacggtggctcacgcctgtaatcccagcactttgggaggatgaggcaggcagatcacctgaggtcaggagttcaagacaagcctggccaacttggcaaaaccctgtttctactaaaaatacaaaaattagccaggtgtgatggcacgcgcctgtaatcccagctactcaggaggctgaggcacaagaatcacctgaacctaggaggtggaggctgcagtgagccaagatcaccccactgcactccagcctgggtgacagagtaagactctgtctcaaaaaaccaacaataacaacaacaacaataacagaagaacgttatgggaagaggctgccatggaaggaagtctcagcaatgatacttccaaagtctgtggcctttggcaagcctttttccctcttacagcctcagtttcctcatctataaaatgaggatattggccgggcatagtggctcatgcctgtaatcccaacactttgggaggccaaggcaggaggatcacttgtggccaggagttggagaccagcctaggcaacatagcaagaccccatctctgttgttttttaaatagatttaaggaaaaaaaattttttttttaagtaaaggccgggcatggtgcctcacgcctataatcccagcactttgggagaccgaggtgagtggatcacttgagaccaggagttcgaaaccagcctggccaacatggtgaaaccccatctctactaaaaatacagtaattagccaggcatggtggcacgtgcctatagtcccagctgctcgggaggctgaggcaggagaatcgcttgaacccaggaggcagaggttacaatgagctgagatcatgccaccgcactccagcctgcgcgacagaatgagagtccaactcaaaaaaaaaaataagaagaagaaagtaaaatggggacgtggagttgttatgaagtcaagagtttccaacctgggatgctcaactctgatctaagatataataaaagctgggggtgaagtaggagggacaattccaacatttcagaaagactaaagaaaccatacatgtgttcattcaggaagaatttcttgggtatttactatgtatccacatcctgtgctgggagttggggacaaacattcttatttcatatagattagaagttctggttaacagttcacatgcccttgattgatttaaaaatggaattttttcttttctttttttttttttttgagacagagtctcgctcagtcgcccaggctagagtgcagtgatgtgatcttggttcactacaacttcagcctcccaggctcaagcgattatcgtgcctcagcctcccaagtacagatgtgcaccaccatgcctggctaatttttgtatttttagcacagactgggtttcaccatgttggccaggctggtctcgagctcctgacctcaagtgatctgcccacctcggcctcccaaagtgttgggattacaggcgtgagccacagccccggccagaaatgaatttttttttaagagatgcggtcttgctctgttgttgcccagactgggtgtgcagtggcatgatcataactcactgcagccttgaacttgggctcaagtcatcctcctgcctcagcctcccaagtagatgggactacaggacattcaacactgcatctggttatgtaaaaaaatttttttagagacgggtcttactatgttgcccaggctggtcttgaactcctggcttcaaggcttcctcctgcctgagcctcccaagcaggtgggattacagatgcaagccaccacgcccagcaaaaatgaaatttgtttgatgaatgtttttcaaaatataggcccatgagacttaaataataacgggaacattcttcgtaatgaaaaggccggtaactctacatattgtgggtgtaaaactgcttcacaaactgcgaagtgcagtgcaaatgcaagttaagtttggttgttcaacaaaacttttagaggccacctctctgtgccagaccctgggctgagcactaagactggttattaagtgatgatgtcagaatctgaactcaggtccgttttactccaagcttgagctcttagtcattacataaattaccttcagtcttccaataccttcactcttcattcccttagtgactcattcattcaacaaaatgtatgttgggcctattacatgcaaaccttgtgccaaacagaagaacaggacacagtccctgctttcaaggaactcacagtggagacagcgaaatagacggcttaagcatgtaggtgctgagagggaagactgaaaggtaggaggggtcaggtctttttgtggatgtgggttggaggctgtcagagaaggtttcctaagggatgtgatggccgctgctgctgaggaatagatgcatagtgttagaggaaagatttaaccacaagagtggggatggggacagggctcaggaatgtccctcagtctgatttaggtgtgtcctcattctcaactggtctgtgggctctcctaagattaaagtactggagttaatagagccaaagtcaaccgaactgctggagaaatctgattgccatgacaacatctcctaccaggggacagttctgctgactggaagggagaaggcagaggagaggacgcatcttgacagcagccaaacaatagagctgagaaaaataagcccagaacctctgattctttctcccataaacctcaaggccccttggcagggctgtttggttaaccctgaagtcacctctgtaaagctcgcagttaaatgcaaagctgcagagtttaacccttgaatggaccaatatgttctcattactcctacaccactgaaagctctcaggtcctcctaatgtccccatgttacaggcaaggaaagctcagacagaagtcacacagctaggatgtgatgaagttggagctgagatgatacctgtattagcatgactccaacacagtaagggtgcctcaccgccatccttcccaacatcctgcccccctactgccaatactttgatatgtgcccagggccctttgctttccgtctctggaactaagcttagtcatctgtgaaatagggaggcaaaatggaccaaaagaatgctaagcttccccagctctgaaagtctaacagatccaatcacatcaaatatcctttctgaagctaatttccagatgcttcaaaaaaacaggctgggtgcagtggcttacgcctgtaatcccagcactttgggaggccaaggtgggaggatcacttgaggccaggagttcaagactagcctggacaacatggcaaaaccctatctctactaaaaatacaaaaaattagctgggccctggtggtgcatgcctgtaatcccagctacttgggaggctgagaattgcttgaacccggaaggcagaggttgcagtgagccaagattgcactactgcactccagcctaggtgacagagggagaccctgtctcaaaaaaaaaaaaaaaaaaaaaaaaaaaaaaaagtttcctgcactgacatcttcagctccatttctttatcaaacaagacctcagccgtgttcctaagcttctttttgttttttgtttttgtttgcttgttttttgttttgagacaaggtctcactctgttgcccaggctggagtgcagtggtacaatctcggctcactgcaacccccacctcttaggctcaagcgattctcctgcctcagcctccagagtggctgggactacaggtgtgtgccaccatgtccagctaatttctctattttttatacagacagggttttgccatgttggccaggctggcctcgaacgcctgaggtaggtggtccacccacctctgcctcccaaagtgctggaactacaggcatgagctaccacgcctggctgagagtacgttttctgaagtacaaatctgatcctgtcactccctgcattaaacacttgagtaacttttcattcccttccagataaacagcagactccataacaaggtttagaggccctttgcaactaggctgctacttcacccctcgcaatcaactaccagaactgcctgctgctccccactcctccaatccagagctgggcaagccccctcacctccagaagctcactcacttggccatccgcactcctttctctgaccccactcatccttcagatgaattcctctgggagtccttcggggtgggttgtctcactgtgatcccagaaagtcctacactactatacttccactggcctggcagttcttcccttgcaattccctgtttcttcattgactgtgaggttcctggccaagtgctgtgtttcatgcctgtaatcccagcactttgggaggctgaggtaggaggattgcctgagcctaagagtttgagaccagcctgggtctcaccaacatggcgagaccccatctctattttaacaaacaaacaaacaaacaaaaactctgtgaggctcctaagggaggggaatatcctctgatttacaggagcatctagtattctgttcaaggccaatcttgccctacctggcatcatgcacagtgccttacacttccccagtaattcattcaggcatttatggaacacctagggtggtcctggcactaggcatgtggctttgtcaatagccaacaacaatgacgtgatcatggccctattagagagagccacgctgccctgctgctggatctgctttctcttcctccaggtcttcaggatgactctcagtgcaggagagaacccgaatgttctgctcccagagtgcacgcagccttttccccatcctcctccccaactcccctcacccaagctggggaccaggcaggcaagcagagggatttgggacccagccagagggcaggggcaggctgaagacccagccaaggggcaggggcaggctggagagggctgcaggtgagggaaagatcctctggccgagctggttggatgggcttctcccaccgggagcaagggagaaggtggggcagaggaggagtcgtgggctaggacaagccggtggggaagagacaagggaaaggaactaaagacccaatgtagagggaggaagcaaaagggcaaagaggaaaggctggacagagccaaaccagaaagggacaccgaggcgcgaaaggagagtgatcccagcaggagggacggcaaagattgaagagagcgaccagcccgaggtgaagggggacagcgcgccagaagcagggggctcgggcgtctgggagggacgggcaggagaaactggaagggagggaagaggcggagggaagaggcggaggacagaggcgcggggacgcagctagcctcgcacttaccgttggccgcctgggccggggggactggggcagaggggtctggctcgtcatcctgcccactggccgctccactgcgcagccctgccacatgcagatcacttgggccagcggaagt

SEQ ID NO: 557 - DNA, 64505 bp, Homo sapiens
tctcgtgcaagtggtttattgatggagtgctcttaggagaaggggagtgagggaagcagcgtaggacagaggaaaaaaactgagtaagaatgtgctctcagaagaagactgacttcagcttgattccatgaggagctctgggaaaggaagttccttgatgtaagaggtcagtcttttgtacctccatacaagaggtagcaattcttttctagagatggtctcaaaattagaatacatcaaaatcacttggagggtttggtaaatcagaatgctgtgccaacccccagagattctgattcagtaggtctgaggtggggcctgaggatttgtatttccagcaagttcacaggtaatgctgatgatgcactttgaaaacctccactctagagaagaggacagctctgaggtgttagcacccacagcatctcgcaaaggggatcaggaaagcacctactacatgaaggcacatgccagggacagatggattggaccccaagctggggctatgtagactacatctttaggtcagaacatctagattcacagtatcttgtatgttcctgttgtcatctcacatctcttgccaacgcattgttgaaacattcttacttggtcttgttattggacttcaagagaagggtctgggagatacatgaggctttgaaaaggaagtagctgcaagttgctaggcaaatatagtggcatcagttgcaatggagtggaaagtccttaaacgagtgatcaatatttagtggcaagactctagaccaaccctggaaattgcctgatgtttgtgaaattaaaagaaaatggctttgatggcaacttttaatttcataagccacgccagaattcataacagtctctgctcctgaggatcaccaccaggtgaaggtgaatgaataaatgttaaaatggaattcgtttcttttggtggggtacgtcaggtagaacttggagaataccttgtacccctgggccttaatgtccatctccaggcagtgcatgaggtcgctgttgtctaggaccgccttccagggcccaaacttgacaacagacttgaacatcttcttatcctgcagaaaacacaggacctctgaataatatgcatcctgctcctcagtttccaccaggcacacaagcacgctggacttccgtgctgttatggcttctgcacgtgccaggcgcaccatgagctccaggttctcgctgtagcccggcacttgcagcaaaaactgcttccgagacacctgctcaccaaagatctgtggcatgtcctccagcagcttgaccaaaggcttgatttcgtagaactgagcctcacggtacacttcagggatgtgctgtgtgggcacttgcccagtgcgcaggtagtccaggatgggtctgaaataggtgctggggcggtcgatgaagaagcggccctccgcgtccgtggaggccttggctaagctagagaacatctctgccagctttgagcccggaaacttcctcagggtacccagggtggtggtgtggaactcacccccgacgttcagctccacaacagtagacatctgggggcacaagaggcagagtaaaccaacacgccatctcccctgagcgcattacttatttttatccaaaggataactggataaaaaacttaggggagccataatgattggcttcagctagtgaaaggcccatcttactaaagagggttatatttatgctgtgttgctccagggggtgggctttttttttttttttcgacggagtctcgctctgtcacccaggctagggtgcagtggtgcaatctcggctcactgcaacttccacctcgattaaagcaactctcctgcctcagcctccctaatcgctgggactgcaggcgcctgccatcatgcccaactaatttttgtatttttagtaaagacgaggtttcgccatgtttgctagtctggtctcaaactcctgacctcacgtgatccgcctgcctcagcctcccacagtgcccggccgagggtgggcattttaaagaggaagaaagatttctgtttgaaaaaagaatacccattcaagcatcttaattttaggtcatagaatgttatgggaggaggccaggcacggtggctcacgcctgtaatcccagcactttgggaggatgaggcaggcagatcacctgaggtcaggagttcaagacaagcctggccaacttggcaaaaccctgtttctactaaaaatacaaaaattagccaggtgtgatggcacgcgcctgtaatcccagctactcaggaggctgaggcacaagaatcacctgaacctaggaggtggaggctgcagtgagccaagatcaccccactgcactccagcctgggtgacagagtaagactctgtctcaaaaaaccaacaataacaacaacaacaataacagaagaacgttatgggaagaggctgccatggaaggaagtctcagcaatgatacttccaaagtctgtggcctttggcaagcctttttccctcttacagcctcagtttcctcatctataaaatgaggatattggccgggcatagtggctcatgcctgtaatcccaacactttgggaggccaaggcaggaggatcacttgtggccaggagttggagaccagcctaggcaacatagcaagaccccatctctgttgttttttaaatagatttaaggaaaaaaaattttttttttaagtaaaggccgggcatggtgcctcacgcctataatcccagcactttgggagaccgaggtgagtggatcacttgagaccaggagttcgaaaccagcctggccaacatggtgaaaccccatctctactaaaaatacagtaattagccaggcatggtggcacgtgcctatagtcccagctgctcgggaggctgaggcaggagaatcgcttgaacccaggaggcagaggttacaatgagctgagatcatgccaccgcactccagcctgcgcgacagaatgagagtccaactcaaaaaaaaaaataagaagaagaaagtaaaatggggacgtggagttgttatgaagtcaagagtttccaacctgggatgctcaactctgatctaagatataataaaagctgggggtgaagtaggagggacaattccaacatttcagaaagactaaagaaaccatacatgtgttcattcaggaagaatttcttgggtatttactatgtatccacatcctgtgctgggagttggggacaaacattcttatttcatatagattagaagttctggttaacagttcacatgcccttgattgatttaaaaatggaattttttcttttctttttttttttttttgagacagagtctcgctcagtcgcccaggctagagtgcagtgatgtgatcttggttcactacaacttcagcctcccaggctcaagcgattatcgtgcctcagcctcccaagtacagatgtgcaccaccatgcctggctaatttttgtatttttagcacagactgggtttcaccatgttggccaggctggtctcgagctcctgacctcaagtgatctgcccacctcggcctcccaaagtgttgggattacaggcgtgagccacagccccggccagaaatgaatttttttttaagagatgcggtcttgctctgttgttgcccagactgggtgtgcagtggcatgatcataactcactgcagccttgaacttgggctcaagtcatcctcctgcctcagcctcccaagtagatgggactacaggacattcaacactgcatctggttatgtaaaaaaatttttttagagacgggtcttactatgttgcccaggctggtcttgaactcctggcttcaaggcttcctcctgcctgagcctcccaagcaggtgggattacagatgcaagccaccacgcccagcaaaaatgaaatttgtttgatgaatgtttttcaaaatataggcccatgagacttaaataataacgggaacattcttcgtaatgaaaaggccggtaactctacatattgtgggtgtaaaactgcttcacaaactgcgaagtgcagtgcaaatgcaagttaagtttggttgttcaacaaaacttttagaggccacctctctgtgccagaccctgggctgagcactaagactggttattaagtgatgatgtcagaatctgaactcaggtccgttttactccaagcttgagctcttagtcattacataaattaccttcagtcttccaataccttcactcttcattcccttagtgactcattcattcaacaaaatgtatgttgggcctattacatgcaaaccttgtgccaaacagaagaacaggacacagtccctgctttcaaggaactcacagtggagacagcgaaatagacggcttaagcatgtaggtgctgagagggaagactgaaaggtaggaggggtcaggtctttttgtggatgtgggttggaggctgtcagagaaggtttcctaagggatgtgatggccgctgctgctgaggaatagatgcatagtgttagaggaaagatttaaccacaagagtggggatggggacagggctcaggaatgtccctcagtctgatttaggtgtgtcctcattctcaactggtctgtgggctctcctaagattaaagtactggagttaatagagccaaagtcaaccgaactgctggagaaatctgattgccatgacaacatctcctaccaggggacagttctgctgactggaagggagaaggcagaggagaggacgcatcttgacagcagccaaacaatagagctgagaaaaataagcccagaacctctgattctttctcccataaacctcaaggccccttggcagggctgtttggttaaccctgaagtcacctctgtaaagctcgcagttaaatgcaaagctgcagagtttaacccttgaatggaccaatatgttctcattactcctacaccactgaaagctctcaggtcctcctaatgtccccatgttacaggcaaggaaagctcagacagaagtcacacagctaggatgtgatgaagttggagctgagatgatacctgtattagcatgactccaacacagtaagggtgcctcaccgccatccttcccaacatcctgcccccctactgccaatactttgatatgtgcccagggccctttgctttccgtctctggaactaagcttagtcatctgtgaaatagggaggcaaaatggaccaaaagaatgctaagcttccccagctctgaaagtctaacagatccaatcacatcaaatatcctttctgaagctaatttccagatgcttcaaaaaaacaggctgggtgcagtggcttacgcctgtaatcccagcactttgggaggccaaggtgggaggatcacttgaggccaggagttcaagactagcctggacaacatggcaaaaccctatctctactaaaaatacaaaaaattagctgggccctggtggtgcatgcctgtaatcccagctacttgggaggctgagaattgcttgaacccggaaggcagaggttgcagtgagccaagattgcactactgcactccagcctaggtgacagagggagaccctgtctcaaaaaaaaaaaaaaaaaaaaaaaaaaaaaaaagtttcctgcactgacatcttcagctccatttctttatcaaacaagacctcagccgtgttcctaagcttctttttgttttttgtttttgtttgcttgttttttgttttgagacaaggtctcactctgttgcccaggctggagtgcagtggtacaatctcggctcactgcaacccccacctcttaggctcaagcgattctcctgcctcagcctccagagtggctgggactacaggtgtgtgccaccatgtccagctaatttctctattttttatacagacagggttttgccatgttggccaggctggcctcgaacgcctgaggtaggtggtccacccacctctgcctcccaaagtgctggaactacaggcatgagctaccacgcctggctgagagtacgttttctgaagtacaaatctgatcctgtcactccctgcattaaacacttgagtaacttttcattcccttccagataaacagcagactccataacaaggtttagaggccctttgcaactaggctgctacttcacccctcgcaatcaactaccagaactgcctgctgctccccactcctccaatccagagctgggcaagccccctcacctccagaagctcactcacttggccatccgcactcctttctctgaccccactcatccttcagatgaattcctctgggagtccttcggggtgggttgtctcactgtgatcccagaaagtcctacactactatacttccactggcctggcagttcttcccttgcaattccctgtttcttcattgactgtgaggttcctggccaagtgctgtgtttcatgcctgtaatcccagcactttgggaggctgaggtaggaggattgcctgagcctaagagtttgagaccagcctgggtctcaccaacatggcgagaccccatctctattttaacaaacaaacaaacaaacaaaaactctgtgaggctcctaagggaggggaatatcctctgatttacaggagcatctagtattctgttcaaggccaatcttgccctacctggcatcatgcacagtgccttacacttccccagtaattcattcaggcatttatggaacacctagggtggtcctggcactaggcatgtggctttgtcaatagccaacaacaatgacgtgatcatggccctattagagagagccacgctgccctgctgctggatctgctttctcttcctccaggtcttcaggatgactctcagtgcaggagagaacccgaatgttctgctcccagagtgcacgcagccttttccccatcctcctccccaactcccctcacccaagctggggaccaggcaggcaagcagagggatttgggacccagccagagggcaggggcaggctgaagacccagccaaggggcaggggcaggctggagagggctgcaggtgagggaaagatcctctggccgagctggttggatgggcttctcccaccgggagcaagggagaaggtggggcagaggaggagtcgtgggctaggacaagccggtggggaagagacaagggaaaggaactaaagacccaatgtagagggaggaagcaaaagggcaaagaggaaaggctggacagagccaaaccagaaagggacaccgaggcgcgaaaggagagtgatcccagcaggagggacggcaaagattgaagagagcgaccagcccgaggtgaagggggacagcgcgccagaagcagggggctcgggcgtctgggagggacgggcaggagaaactggaagggagggaagaggcggagggaagaggcggaggacagaggcgcggggacgcagctagcctcgcacttaccgttggccgcctgggccggggggactggggcagaggggtctggctcgtcatcctgcccactggccgctccactgcgcagccctgccacatgcagatcacttgggccagcggaagtgcccctggctgcccgcccctaggtgggaacaccgaggctcaaggcgggacggggctgagccaggcgtggcttgcagtgagactgggccaagtgcagaaagaaatggacagtctgtctatttggggcttctaaaagttgttaggccctgagaagggctgactttggagaccgagaaatggagcagaccccttaaggactgaccttttgatatagattaatttccttccttttctttctttctttcttttttttttttcagagacagggtctcactctatcgctcaggctgaagtgcagtggcggatcaggctcactgcaacctcaacctcctgggctcaagtgatcctcccacctcagcctcccaaagtggtgggattacaggcctgagccacggcaacttgcctcttcctatattttcttttacgcttaaataaattacttaaacatattgcttgaatcccgttattaaagttgacattagttaatgcccctctctgggcctcggagttcccagtagtgaaatgggggaggcagaaggaattgacattgactgacattgacaaccagagactttctattccctacagtcctagggagtgaaagatccgcaacacccattttacagatcagaaaactggcgctctaggaggtagggtggtgttaaaatgtaaagtctgaggatcaacaaaacttttttaagagtatacttgagtaacaggcaattcttgaatcggggaacaccagatggaaagaggttgagtgttcccatgacaatgcatcagaggcaaatatttatggggagaatatggaagcaagatattttgttggggacaggcatggtggctcacgcctgtaatcctagcactttgggaggccaaagcggacagatcatttgaggtcagaagttcgagaccagcctgaccaaaatggtgaaaccccgtctctactgaaaatacaaaaattagctgggtgtgatggcatgtgcctgtaatcccagatactgtggacgctgaggcaggagaatcgctggaacccgggaggcagagattgtagtgagctaagattgcaccactgaactccagcctgggcaacaaagattccctctcaaaaaaaaaaaaaaaaaatatatatatatatacacacacacacacacacacacacacacacacacatatatatatatatacatatatatatataaaattggttacagttaaaaaatctccttttttggtttcctttgttgaaaagtccacagctacttaattgtatgttagttggctgcttgtggttggctaatgttaagtttcgtttctgtctaacattagcatttaccagaaatgactctattagtcagggttctacagagggacagaactaacggaatagggttggacacggttgctcacgcctgtaatctcagcactttgggaggccatggcaggtggatcacctgaggttaggagttcgagaccagcctgactaacatggcgaaaccccatctctacaaaatacaaaaaattagctgggcgtggtggtgggcacctgtaatcccagctacttgggaggctgaggcagaagaatcgcttgaacctaggagacggaggttgcagtgagctgagatcaagccattgcactccagcctgggcaacaagagtgtaatcccatctcaaaaaacaataataataaaataaaactaatggtatatatacatacacatatatttgtatatatatattccattacttttttaactccccgttatatatatacatatgtgtgtatatatacacacacacatatatacacacgtgtgtgtgtgtgtgtgtgtgtgtgtgtgtgtgtatatatatatatatatatatatatatatatatatataaaggggagtttattaagtattaactcacacaatcacaaggtcccataacaggccattggcaggctgagaagcaaggagagccagtccgagttccaaaaatgaagaacttggagtctgatgtttgaaggcaggaagcatccagcacgggaaaaagatgtaggctgggaggctaggccagtctctcttttcacatttttctgcctgctttatgttctagccatgctggcagctgattagattgtgcccacccagattaagggtgggccatcctttcccagaccactgactcaaatgttaatctccattgggaacaccctcacaggcacacccaggatcaatactttgtgtccttcaatccaatcaagttgacagtcagtattaaccatcacattgacccaagttaagttttgcttatgtttgcaaatccagcaaggctgagttcccttatgaggcctaactagcattgtctagccagggattcttcaggcctgatctccattttaatttactataacagtggccagtgtagactatttagccagcccagggcagctgcttggagtacaaagcatgcccactggtgaaaagagttaggtatctgttttgtggggttgttttcctagagttaaaatataactctaaaggagagggagcataatttcccactccttaagtgtgggttatgcgccgtgacttcttccaacgagtacaatatgggaaggaggaaaaagagaagaaactttacattggggaaactgatcaatactactccagccaggtgaccaaaatcagttgccaacagttatcgatcatgacaacagtatgtgcttgctgtaaaccagaaagtatctgagacaagtctcaaccaatttaaaagtttattttgccaaggttaagaacatgcccacgatacaacctcaggatgtcctcaggtcatgtgcccaaggtggtcaggctacaacttggttttatatattcaaggagacataagacactagggccacgcatggtgactcacgcctgtaatctcaccactttgggaggccaaggcaagtggatcatttgaagtcaggaatttgagaccagcctggccaacatggtgaaaccccatctctactaaaaatgtaaaaattagccgggcatggtggtgcgtgcctgtatccccggctagggctactaaggaggctgaggcaggaaaatcacttgaacccgggaggcagaggttgcagcgagctgagatcgcaccattacactccagcctggaagatagagtgagactccatctcaaaaaaaagaaaagaaaagaaaagaaaagacatcaattggctaggcatcagtggctcagtctataatcccaagggagtggatctgggaggccaagatgggaggatcacttgaccccaggagttcaagtccagcctgggcaacatggtgagtccccatgtctacaaaaaatacaaagcttagtcaggcatggtgacatgtgcctgtagtctcagctacttgggaggctgaggcaagaggatctcttgagcctaggaggtcagggctgtagtcacctatgatcacaccactgcaccccagcttgggcagtggaatgagatcctgtctcaaaaaatatatatctctgttggactagagattgtaaataaatatataaggccaggtgtagtggctcacacctgtaatcccagcactttgagaggccaaggtgggcagatcatttgaggtcaggagtttggcactagcctggccaacatggtaaaaccccaattctactaaaagtacaaaaaattagctggcgtggtggcatgcgcctgtagtcccagctactcaggaggctgaggcaggagaattgcttgaacctgggaggtggaggttgcagtgagccgagattatgccactgcactctagcctgggcaacagagcgagaatccgtctcaaaaaaaattaattaattaattaaaatataataaaaatgaagataccaattaatacatgtatgacgtacactggttaggtccgaaaagactggacagctggaaggggttgtgggggcttccaggtcataagcagattcaacgattttctgattctgaggcatggaaactcatgcctgtaatcgcagcactttgggaggctaaggtaggcagatagcttgagcccaggagttggggaccaacctgggcagcatagcaagaccccatccctatttttttttttttgaggcagagcctcactctgtcaccaggctgaagtgcagcggtgcaacctcagctcactacaacctctgcctcccaagttcaagcaattctcctgcctcagcctcccgagtagctgggattgcaggcatgtaccaccacaaccagctaatttttgtatttttagtagagacggggtttcaccatgttggccaggatggtctcgatctcctgaccttgtgatctgcctggctcggcctcccaaagtgctaggattacaggcgtgagccaccactcccagtcagaccctgtctctactcttaaaaaataaaaataaaaaagcaaggattttctgcttgccaatgggttattatctaaagacctgagatcaatagaaagggatgtctgggttactataaagggttgcatagaccaaggttttatcatgccgatgaagcctccaggtagcaggcttcagagagaatagattgcaaatatttcttatcagacttaaagactgacagactttgtgcatgactgacagactgttctgtcagtcttaaggtctctgttttgatggtaatactggtcagctgtgcctgaattccaaaagggggaagggtataatgaggcatgtctgacctccttccagtcatggcctgaactagtttttcaggttaactttggaatgcccttggccagaaggaggggtccattcagatggttggggggctgagactttcattttttgtttatagtaccgagtatatacccttgatgtgatgtgaggaaaatgatcttcctccccaaaactcataacctcagttcaatcatgagaaaaacatcagagaaatttcaatagagggacatcctataatataactgaccagtactcctcaaaactatcaaggtcacccaaaagaggaaaaatctgagaaactgtcacagtcaagagcatcctaaggggccaggagcagtggctcgcgcctgtaatcccagcactttgggaggctgaggcgggtggatcatgaggtcaagagttcaataccagcctggccagcatagtgaaaccccatatctactaaaaatacaaaaattagccgggcatggtggcatgcgcctatagtcccagctactcgggaggctgaagcaggagaattgcttgaatccgggaggcggaggttgcagtgagcccagatcacaccactgcattccagctttggcaatagagcaagtgtccatctcaaaaaaaaaaaaaaaaaagcagcctgaggggacgtgacaagtatattgttatgtggagccaggcatggtgactcacacctgtgatcgcagcactttgaaagaccgagatcagcagatcagttgagcccaggagtttgagactagcctgggaaacatggcaaaaccccatctctgcagacaatacaaaaattaactgggtatggtggcacacgtgtgtagtcacagctattcgggagggtaaagtaaaaggatcacttgatcctaggaggcaagaagagacaaaccaggttattaaatgacatgcataaaaatgaggtcaggcacagtggctcagcactttgggaggccgaggtgggcagatcacttcaggtcaggagttcgagaccagcctgaccaatatggtgaaaccccatctctactaaaaatacaaaaattagctgggcatggtggtgcatgcctgtaatcctagctactggtgaggcttaggcatgagaatcgcttgaacccgggaggcggaggttgcagtgagccaagaccatgccactgcactccagcctgagcaaaagagcaagactctgtctccaaaaaaaaaaaaaaaaagagagatgtatgaaaacaaaacaagggggtaaggacggcttagaaatcctgaagtcgctgacacgcccagataactagtgactatagttacacctgctaagatttgggtgcatggggcttggctttggttagctcccttggtcttatttcaccaaaggaagaaacctcccggttatgggcaccctatttactgctgtcacctgacaggatttgcagggtaattccccagaactagtatattgatccagattttctgtttttacccagaggtcactggttggttcacaggaataagcagggttaatttaaaatgtgggaaaaacttaaaaacaactaatgaaactggaatgtaatgtcaagtgtatgataagttttgaaacttaatttttctctctcctgttctcacttttgtcaaaaagagattatgataggactgagttgtttgcaaaataaactttagtcttatggttggcctgattatttgcataaagttcagccagaataattatttttactagggttttttaataggttttgatggaactcagttccacaaggaatctcagacaagactttttttttttcttttttttttttgagacggagtctcgctctgtcccccaggctggagtgcagtagcgcaatctcggctcactgcaagctccacctcccaggttcataccattctcctgcctcagcctcccaagtagctgggactacaggcgcccaccaccacgcctggctaattttttttgtattttttagtagagacagggtttcaccgtgttagccaggatggtctcgatctcctgacctcatgatccacctgcctcagcctcccaaagtgctgggattacaggtgtgagccatcgcgcctggcctttctgtgagaaaatttctttagagcaagagctctctctgtctccattcctggacaggaatataaaacctgcttgcttcttttttccccccctccaattgcatgttctttctttgccaccaatgcaaagtaggaaaaaaactcagttttccagtgacattagcacatttgaccctggcagttcaaaataggcattagcacctccattttctatatgaggaccccaaggctcccagagatgaagcacctctttgagtcagtcagaccaggagacgagagagcagggctctagtttcggctctgccaccagtttgcagtaccaccttagacacgtccctgcccctctctgggcctcagttctccacctgtaatatggtgggggtttgtgtattttctgagatggtctctgtgatcctgccttgcttgatgctatggcaacaaaagaattcaaacagccccttgctattgcctatcactggatcttgtttccctttggcctgactccaagagcaagcactgcttccttctgccctcccctcactcactcccctctgttcttcaggagacaatgcggccagcccctctcccctccaggcggctgggctttaggccagccagccaaatggcagctgggactcagatgaaagggccctcagaaggctgcttgtggcagagtgcccagcctagcccagcccaggcttggcagcctggggctcagctgtgccacgaggcatcctgtccacccgctcccatacaaggctccctctgtgagtcctgcagagaaggagacccctgccaacccacaaggaccctcttcccctccctctgctccatacctgcttgagaaatatgcaagtctgtagagaatggtccaggactacatcagattgatctgactgtgccaggcactttggagagctttatcccattgactcttcagaataacgctgatagcaagtaatggtttttttttttttttttttgagacagaatctcactctgtcacccagactctaggctggagtgcagtgtcactaacatagctaactgaagactcgacatcctggaatcaagcaaccctcctgccttagcctcccaagtagctgggattaccgctaacacccagctaattttttttacttttttgtagagatggtgtctcactatgttgcccagactggtctcaaacccctgagctcaagcaatctttctaccttggcctcccaaagtactgagattacaggtgtgagccaccatacctgcaatctctttttatttatttgtttattttttaaaatttattttattttttttgagacagggtcttgctctgttgcccaggctgcagtgcagtggtgtgatctcggctcactgcaacctccgcctccagagttcaagcaattctcctgcctcagcctctcgagtagctgggattataggcaccagccatcatgcctggctaatttttgtattttttttttttttagtagagatggggtttcaccatgttggccaggttggtctcaaactcctgatctctagcggtctgcccacctcggcctctcaaagtgctgggattataggcgtgagccacagcacccagcccgtaatccctttttagagaggaggaacacatatttgcctactgtgtgtcaatcatggcaccaggcactggggaaagagcagtgaaccaggggacaagagctaacctcaaggggcccattgtcagctgtaattgaataaccacagaaatgaatatctggtttcacagtgtgaccagtgctctgagaagaaagtggaagaaactatagatatggatagacatgctaaagagcccataggtaatggtggatcacagataatggtggctcacagataatggtgaaccaatgtgtcctccttccctttgggaagtcccccactccacccagggaattctttatttagaagcaagtcccctgaactctgggagcctcatattcttcagttcaaaaatgggagttttgatgcccctaccatttctgggaggaatctgggaggccctgtactgtcagtgccaggcacagggaggcactgggaggaagtatggctgggcttccttcaaaccactccacttgattgggtcccagccccagcaagctcctttctggagggagcaggcagccagagcttctggataaggttagaacctgctcagtttcagccttgactggaagaacagagagcctggctggaagccaggcatttccccagttcaccagctcttgggtcttttaaccccaaaaatgcctcttgcaaggcacaggagtcaagatgcccaggctaggaaatggtagtaaaaggtaacctttgtttcacaggcattatctcatttaatcttcacaacaaccctataaggaagactaaaggaagattaaaaccacccccattttccaggtgatgaaattgaagcttagaaagcctattttgctaaaccacgattcaaatccaggcattctggcttcaggaactgctctgttgtccacaccctgcccttccaggccaggacagtactgccctactcccagccttgccctctttcctccacatcttctctgggagaacataaagtgatctacttctttttttttttttttttttgagacagcatctcaatttgtcacccagtctggagtacagtggtgcaaagatggcttaatgcagcctcaacctctcaggctcaaccatgtcacccccaacaggtacagcaccatgcccagctaatttttaaattttttttatagagctgggggtctcactatgttgcccaagctggtctcaaactcctaggttcaaatcatcctcccaccttaggctcccaaagtgctcagattacaggcctatcccatgatgcccaaccatagtctacttcaaatctaccactaggctgctgtcagacctggggcctcagtgtcctcatctgcaaaatgaggagggaagagttgggcttgagtatggttaagatcccttccaactctatcagtctttgttctttctagcataagtggtgtcagcataagcccttgaaaggcatgaggtaccatttccattcttaggattagcccctagagcacacatgtgcaaagacactatgtgcacaagaatgttcgttgcgtcattgtttgcaaaagcaaaagaccagaagcagcctaaatgtccatcatttggggactggttaaataagaatatatccatatagtagaacactcttctattattgaaaatgaggtgaatctctgtggctaatataggaaggtcaccaagataacaaagacaggggcagggcacggtggctcacgcctgtaatcccagcactttgggaggccgaggagggcagatcacttcaggtcaggagttcaagaccagcctggccaacatggtgaaaccctgtctctactaaaaatacaaaaattagccgggcatggtggcaggcacctgtagtcccagctactcaggaagctgaggcaggagaatcacttgaacccaggaggcagaggttgcagtgagctgagattgtaccactgtactccagcctgggcaacagagcgagactccttctcaaaaaaaaaaaaaaaaattagccagctgttgtggcacatgcctgtaatcctagctacttgggaggctgaggcacgaggattgctcgaaccagaggtagaggttgcaatgagccgagatcacaccactgcactacagcttgggtgacagagtaagactccatctcaaaaaaaaaaaaaagataacaaagaaaataatagtgtgtgtgtatgtgtgtgtgtgtatatatatatatacacacattatatataatacatatatgcacaccattgcatttgcaacggtaatttctggaaagatataaaggagacttagtcatcattacctctggaaagaggaccaggaatacatcatgggacaaaaattacttttttgtttctgaaacagggtcttgctctgtcacccaggctggagtgcagtggatgccacacccagctcttttatttatttatttttttgagacagggtctcactctgtcacccaggctggagttcaggggcgccacaatcacagttcaccacagcctcaacctcctggactcgagagatcccccgacctcagcctcctgagtagctggaactacaggtgcatagcaccatgcctggctagtttttaaattttttgtagagacgagaacttcctgtgttgcccaggctgaactcctgggctcaagcaattctcactggctttccaaaatgctggaattacaggtgtgagccactgtgcctggaggaaaattacttttcattgtatattattttatactgtcttaatctttctctctctctctctctctctgcctctctcctctctctgtttttcacccaaacactctgtatgggtgtttctttctttctttctttctttcaagtcatgtgtggaggacagattgtgcgacctgggttcaagtcctggccttgacattaactacatggtcttgtacaaatctcgtctttttgctgggctaagtaatctttcaggtcccttcagtgcagaggtgggaacggacagcccacgtgttttcaagacagtctgagtcatccccaaacagactatagccaagcaggggaccctgctcaccgcggcctcagtgatctcaatccctcttgcctgagtttatgggccatgagctctccgaggtacactgtagtgaacatgtgtaacatttccaccctgcttttattcactctcctttgtaaagaacaacggctttgcttcgggggccaccctcttctttactctctaccgccaccatcttgccaccatatgtagcctgagattgaagttaacctacaaaggaacatagaactaagagttgatgagaacctgattgccggctatcatttgagcactgatgaagctctgcctaaggccctacccctggagtttccggttaggtgaccgagggtttttctttttgacttacgccactttacaatgggtatatctgtcacttctggcattctaaagaggccagtggaagtggagagcatgctgtaactcttctacctgtctctccagatccactccagccttttctactctgggaggctgatccttttggggtgcatccacaggcttccatgcaccctggcttccaactgagtttggccaatgggagcttagcgggagatcagaggcaagaggaggcagaagccagaatattccttcccgggccctctccctgtcgagttcctatacattggctgcatccctcttctgaaggtcccagcccgtgatagctgtctccacacagctatcatctcagttctgctaactgcccccttcctcaccctgttactaaccctcagggtctgcactatctcttgttactctccccaaaccctgccaaagggactctttgtaaagagtcgctttatgggccaggcgcggtggctcacgcctgtaatcctagcactttgggaggccgaggcgggtggatcacttgaggtcaggagttcgaaaccagctcagccatcacagtgaaaccctttctctactaaaaatacaaaaaattagctggccattgtgttgcgcacctgtaatcccaactacttggtaggctgaggcaggagaatcatttgaacgcaggaggcagaggttgcagtgagctgagattgtgccaccacactctagcctgggcaacagagcgagactccatctcaaaaaaaaaaaaaaaaaaaaacagtcccttcatggccgggcacagtggctcacgcctgtaattccagcactttgggaggtcaagggaggcggatcacttgaggtcaggagtttgagaccagcctggccaacatggtgaaaccccgtctctactaaaatacaaaaattagctgggtgtggtgatgggtgcctgtaatcccagctacttgggaggctgaggcaggagaatcacttgaacccaggaggaggaggttgcattgagcagagattgcaccactgcactccagcctgcatgacagaatgagactgtctcaaaaaaaaaacaaaagagtccctttatgaaagtctcctgaaatacccagcttgagagagctatctatgttctgcctgcatatctatatgtgtttcaagtgtgagtgtgaatgtgtgtgcacacatgtgcatgcattgtgtctatgctgtacacttgacagtctcaaactgggacaagaggggagctgattttcacaggtgctcaccatgtgccagactccatgcagggtactttgtatgcacgattgagtttcatcctcacaattctataaagtgggtatttttagccacatttcacaaaagataaaaccaaggcccagagaggtgaagacactcacctaaagtcccacagctaaataaatagaggaaacaggattcaaaacccatatacatctggctgtaaagcctgtgttctttagcctcctcccggcactgctttcccaaatgcctggctcattctcatactttagatctcagcttaaatgttacctttcccaagaggccttccgtgaccactctatttgaaggctgtcatcaatgattctttttagtaagacattacttttccttcaggacatgcctttgtttactgaatgtctgccccaagctccatgagggcagccagtctccacatctgtgattttgttcaccactgtgatcctggtgctgagcacatgtggctgctacatgctaggccccggataaatcgctgctaagtgaaaacatggcaaaggaaaggaacagacatgtattaattgcctgcccaatgccaggcattttacacagtttgtcttaggaagtacatgctgttgtcccattttgctaatgaggaaaccaaggccaaagaaggaatatgactttcccaaagtcacggaaccatgagccagggttcaaaaccaggtccctctgagccacagctgtgctcattccatggtgccctctgtcccctactcaggtgtccaccacaggatgagaggcagaggggccaatcagtaaaactcatgtgaatcattcctggacaatcagaaactggggagcaaatagtgcctgctgcaaccactcccccggggccagccactctcagacctcgtgggcacacgccctcccagcccagccaggacacatcctcttccctgtttgccctcaggctctaggcccagctccacctattctgtgacctccacaaacactgtttctgggctctctttgcagggctacttatggctgataacttgctctccaagctcccaagggccagctccaaggccctgagcaccagggactggtgcactcctgagccctgtgagtaggccagttcaccagctggtgccaataaagaagggacctcctgctgagcccccagaactatactcatcccaggctggcacatgggaggaccttttcctacctcctccctttgctttcagaccctgcccatgttccactttaaaatcactgcctccagccagcctggccaaaatggtgaaaccccgtctctactaaaaatacaaaaattagccgggtgtggtggtgggtgcctgtaatcccagctgctcgggaggctgaggcacgacaatcgcttgaacccgggaggcagaggttgcagtgagccaagatcgcgccactgcactccagcctagtcaacaagagtgagaccctgtttcaaaaataaataaataaaaaaaatcattgcctccctaatgggaggcttctgggatgctgaataaagttctttttcttgagctaggtgctggttccacaagtgtgctcactttgtgaatattaacttaggtgcattcctctgtgtgtaagttacatttcaataaaaagttgaccaaaaaaaaaaaaaaaaatcagtgctacctgactcttgccccaggcttccccaccagaccagcatggattaaggcactctgccccccacaccatcctttctctctacttccccaaacatatccagaggcccttcccatgtaagggtttctgactgaaaattggccagcaaagacaggacagaacgaagtagccaacatgggcagcgtcccaagtcttgggacctcgggtgtcctgttcctggtggacagctcctcctgccttctctgagacatcttttgaagccccataggcctttccctggtccagttcgagtgagaggttctcgcatcctctccctattcttaccccaaacctctttctcaggccatgctgatggcctctggcctgcagggccaattttctggtgcccaggaccacgtgcaaacaattattgtttaccaactgtccactgtcactcagaagggcatctcccatggcctggacccaggacctctcccaacttgtcctccttgggttcctggagaggaatcaaccgcaccccatctggctccccgctcactggctccccagcccaagtgcgtaggccccagctggttaccccaagtgaacagcttctccaccatctcacacagcccagacacctggacccaagagagggggtgacctgcatacctaatgggtggtggcagcagaactccccacagcaaacacagcaggggtgtcagagagggatcctggggacaagcaacagaggccaatgtcaccccctgaaacagaaagagaatttcttagaagactatcagtgttcacaaaggacgaggaccaggagttcagagggcccaggccaggagcctgactggagccacactgcagaactggatggctactgctgctgtggtcacggtcaggcccggatgtaccaggggctgccagcaaaagaatcccatctcttgcaagggattccatagcgggagcaagggccaggaattggcgccctgcctaaaactcatgggaatttccccagaagggagaatatggggctaggagggaaggagtagagtctggactttagattacaaaaaaaaaaaaaaaaacacaaaaaaacaggtgtctctgaccacagggttgggctgaactgaatttcaagaggaccttgaactgggacagggttggtgccacccctactacatatatatccactaacaaaacttgaatcatgccatttaaaatatttatttaaccaggccaggtgcggcagttcatgcctgtaatcccagcactttgagaggccgaggcaggcagaccgcttgagcccaggagttcaagaccagcctggaaaatgtggagagatcccatctctacaaaaaatacaaaaaaaataaataaaattagccaggtgtggtggtgtgctcctgtaatcccagctactcaggaggctgaggcgggaggattgcttgagccccagtagttgaggctgcagtgagccatgatctcaccactgtactccagcttgggtgacagagcaagactctgtctcaaaaagaaaaaaaaaaagaaaagatttatttaaacatgtatgagcctggggcaacatggtgaaactttgtctctacaaaagaaaaaaaaatagctaggcatgttgatatgtgtctgtagccccagttaatcaggagactgaggtgggaggatcacttgagcccaggtggttgaggctgcagtgagccagtctgggagacagagtgagaccctgtctcaaaaaaaaaaaaaaagtgtactcattttttccacctggtatcgtgacgatttcccccatatgaagggctcttctgtaccactttttaaaatggcgacagagcattgtgttgtatgaatgtatcataaatctactaagccacattttacttctttcttctctccttccttctgtattttttctctctttctctactataatagtgctgcagtgagcatccttgatagctaaggcactgtgcaaggagtaggcacttttttgagctcttattcagtgtttccaaattactaagaaagctgtgcccaccatccaggcacacagagtgtggctgccctgtttatgtttttgccccatgttcagagtctgacctccaacagacttccggggctgcaggcaagggctgaaaccagagctggccgctggccaggagctgagaaccaagccaaggctgcccccgtttcccgtgtcatgtcttcctggaatctgaagtacgggcattttttctggctgattcaaagtaccctcagaaactcacttcctgctccatgttctttttcctttctcctgtcttctccttctctcttccttgtctcttttctttctttctttcttctttttttcctttctgtttcctctttctccctccacttcttcctgtgtctcttctctctttaactctgctcctctttctctctggctcttttctctttgtgtgtctctctgctgttttcttcctcttttgccttctttctgcaccttttaattttctccgcctggaatccagcctcatttctgtgtcttttctctgtctcttcggtggctgtctgtcctccatccaccactcctgttctgtgagtcatcccttccccagggagagaaggcaaccaacattctccttgctaggccttgattttttattttattttattatttttttttttttgagatggagtttcactcttggcccccagtctgcagtgcaatggcgtgatcttggctcactgcaacctccgccttccgggttcaagcaattcttctgcctcagcctcccagtagctaggactacaggtacgcatcaccacgcccggctgatttttgtatttttagtagaaatggggtttcaccatgttggccaagctggtctccaactcctgacctcaggtgacccgcccgcctcaacctcctgaagtgctgggattataggtgtgagccaccgcgcccggccactaggacttaatttgaatggaaggtgattttgcctctcacaaaggacaaagctaacagatctccgaagtgggagttgcctggtaagccaggttgacccaggcactctgggcttcaaggattgggagacacacagtctgtcaagcttccattagaggctctatcaccccaggggccagcacactgggtctgatgactcaccagggcggcactggcgcagtggcagcaggatgtaggtaggggcactggagtttatgatgttgctgcagggagcaaacctactgtgtgtgggtgggctcagggctggatgctggagacccaagaacacagcagacccagtctgcatgaaactgagagactggactagctggatttcctaggccgactaagaatccctaagcctagctgggaaggtgaccgcttccacctttaaacacagggcttacaacttagctcacatgggaccaatcagatagtaaggagagctcactaaaatgctaattaggcaacaacaggaggtaaagaaatagccaatcatctgttgcctgagagcacagcgggagggacgatgatcaggatataaacccaggcactggagccggcaatggcaaccccctttgggtcccctccctttgtatgggagctctgttttcacgctatttcactctattaaatcttgcaactgcactcttctggtccatgtttgttacggctcgagctgagctttcgctcaccatccaccactgctgtttgccactgactcccatccctccggatctggcagggtgtcctctgtgctcctgatccagcgagactcccgttgccactcccaatcgtgctaaaggcttgccattgttcctgcacagctaagtgccttggttcatcctaatcgagctgaacactagtcactgggttccacggttctcttccgtgacccacggcttctactagagctataacactcaccgcatggcccaagattccattccttggaatccgtgaggccaagaaaggcttgccaccatcttggaagtggcctgccaccatcttggaagtagctcgccaccatcttgggagctctgtgagcaaggacccctggtaaaaaaaaccaccttcacaaaattatcacagtgagaggaatctgacatggctgactccatcttgcttctggtgtcacaggctgactgtctttgctcattcctgggcatatgccaagctaactttgggagaaatttcgttcatagtttaaatgataatggctggacacggtggcttactcctgtaatcccagcactttgggaggccaagcgggatggatcacttgaggtcaggaattccagatcagccttgtcaacatggtgaaaacccatctctattaaaaatacaagaattagccaggcgtggtggcgcatgtctatagtcccagctactcaggagcctgaggcacgagaattgcttgaacctgggaggcggaggttgcagtgagccaagatcccaccgctacactgcagcctaggcaacagagtgagactatctcaaaaagaaaaaaaaaaatagaagaaagagaaaagaaaaatccctaacctatgcgctttgaacgagattgatttgagtaataactccatctcctacgtggcatggccaccttcgtgttgaagcagcatcattgtctggggtaaatatctgaggttcattgcctcatgccaaggaaatcaaggacacggactcacacaaggagtgagtttaagagagaagtttaataggcaagagaaagggaaaagttctctctcctgcagagagaaaggctcccgagtgggtcttctggttctgtggtgaaatgcatggggttttctagacgagtttgaggaggtggtgtctgatttacatagggcacaaaagattggtcagacccggtgtgccatttatatagcttgcgaagaagctggccaccccaccctaatttttcattatgcaaatgatttccctacctggccggtgccatgttgcctgcttctttactgcacacatggttgacaaagacaagggaagaggggctgggcaccgtggctcacacctgtaatccctgccttggcctcccaaagtgctgggattacaagtgatccacctgccttggcctcccaaagtgctgggattacaggagtgagccaccgcacttggcctctgttacacttttaaatgcacacaccctatgttccagcagcccaacccctggcattttcttctaccaaaatactctcatgtgtactatgtagtaagatatttgttgcaatgttgcttgtattatccacaaaataggaatatactcaatatccattcattagaatggttagataaaatgatgatgtctcttgctatggaataactgtcatcgctaaaaaagaatgaggtattcagataaaccaaaagtaggttagtagtgctaggatgacaggtgtgagccactgcacccagcctgtgtgtgcttttcgtatgaaacaattaaacatactcaataaaacaaataccatccttgcttgcaaagagctcagaatcaagtgaggggatagactgagacagagggaatgccaacagaatccttcgtgacagggctggcacaagcacagtggaggggccccctgaaccagctcgtggggtgtcagggaaggcctcctggagcaggtgacattttgactcgggtcttctaagaccaaaaggtgttggtcaagtggagaagcaggggcaggattcttctggtggaaggtgaggcaaagtggtgcagcccacatgcagctgacagagaaggaagggtttcactcagggaactgatggcagctttgtcttgggtggatcctctgaggaagtctcttctggctcgaggtgacagacaccctgaatagctcttagggaaagtctggaaactaatacaatgtaaatgaagactttccagtaggctcagaatttcagctgaggccccaaaggcagaaacaaggccagagttgctgatcctaaagtgaagctggaccacccacctaggattccccagaagggagaacagagttaaaacccacctcttcacctacttcctgaccacaaagagaggcgacatccccagaagctggaggggaaatttctctggacagagttgtcaacgtgctccctcagcctgttccccagcccacaccccaaaacagggagtagagggcgctgctctccctcacctctaaccaggtgagcgaggctttaggagaactatctggggagtcttggaggtggagactctggggtctggaatctgcctggcacctagcagggtgtggaggggctgctaggaaggggctgcactgccagctgtgtgcttcctgtgacccacatgtggaccccgcagaaaaatcttcctgaaaaggacctggtggaagagagcttctatctaggggtgaggggactccggcagaatgagactggaggtgtgaggagggttgtagtagctgaggggcagtaagtgagtataacccccagtaggttcttccgcccactgcacagacaaaaccaattcactgagaccacgcagcattgtaataaagatatagtttaattgccacaaggccagccatgccgcacaggagacggagttatttctcaaattgttagcagtagtgaatctgtacgggtctgtagtaacctccattcttgcctcctcagaggaaagaattagtcggaggggcataaggcagagggagtgaccaaggcaagttttagagcaggagtgaaagtttattaaaaagttttagagcaggaacaaaaggaagtaaagtacacttggaagaggaccaagcaggtgacttgagagatccttgtccggtttgacattggacttggagctttacaccttggcatgcttccggggttttgcgcctcccctcccttgatatttccttggtgtgggctgtccacatgcacagtggcctgccagcacttgggaggggcccgcatgtgtagtatgtttactgaaattgttcacatgctcatttcaggcatttttctcttaccagtcaagtgttcctagaggaaggtcacacacaagttaagctgtgccattttgcctcgtaggtgtgaatgctcaagcccactcacccaactcctgagatctttttttgagacagggtctcactttgtcacccaggctggagggcaatggcacaaacacagcccactgcagccttgacctcccaggctcaagcaatcctcttgcctccgccctcaagtagctgggactaccaacacatgtcaccacgcccagctaatttttttgtattttttgtagagacaaggtttgccatgttgcccagagtggtcttgaactcctgagctcaagcaattgcctgccttggcctcccaaagtaccagtcttaggttctacgatagtgatgttatctgcaggagtaattggggaagttgcatatcttccctctgcctctggaataatggttggcaatcgtttatgtctgcaccttagcagaactcaggctcaacatcctcctgacctggttggtctttcattagctttacaaaggcagttgagttttggagaagggctgctatcatttaaactataaactaaatgtcttccaaagttagcttggcctaaacccaggagtgaccaaaggcagtttggaggttaaaggcaagatgagggttggttagatcagatgtcttttgcggccctaattttctcactgttatagttttttcaaaggcagtttcataagcagccctgggggagacagcccctctttataagggtactactgaggagagatgtgagggttttcataacgcccgtcaaagtgctcccaaaagcccagagtactcaggtcctcctcagacgttgctgcccctaccgcttctcccccaccccacccaggaagagtccgaggcagcctgtgtaggggcaggaggagcagaagagctgggtgaggacgcagggaggctgccggtcctctccccagtcagcaggtgtcccagttagaggcagcctcaggaggggagcgtttgccagaataatggcctgcacttagacacaagctggaattacctgacagtaaaccggggaggactccgagaaaagcgagtgatctgccgagatttcccccagaaacagcaaaaaaggagtccacagaatcagttcgcaagggcaggagcaggaaagaaagagatcggctcagtgcttttccctgctaagtcaagcccctttagtaaaccagctacagaacatcgacgctgtctatgtggtgagggtgtcttggaaagatgagaggatttgacaattgtgagccggaaagctcgcgtgttggcgggaggccagggtccccgccactccaggcctgggcctgcccggcagcgccctctgctggccggagccgcgacggcgggggccccgcctgaaccggagccctgagcctggggctgggagtccaaccttcccagagtttgcagttctttggggacaggcatacatgcatggattgagccacccacgataagaggcgcaccttgcaatgagaggagagcctatcctaaaggggaagggggctgatctggcgaaaatgtcagcgcgggggctgaggctggacttaagggggcgaggttaggaagaggtgagcaaagatttggaagttatggtggagtttgggagagagtgcaggcatgctggagaatcatcagtatatatgtatgtatgtatcttgctatttcatgcctctgaacttttgctgaggcttgcatttattcctagaaaacatttctcacttttccttttctgttgttataagtacttaatctattcaaaaatattagatgatgaatatataaatattcatgtagccattactaagcttgggaaataagacctaatgaatataaagtactcatgtacgcttccttttttcccctccctccacccagatggctccttcaatttgctttttcattccaacgtttaagtttgtgtttactacctgtgtaggtataaagaatatacagatacatgaaatcataattttgggggtttttttgagacagcgcattgctctgtagcccaggctggagtgctgtggcaatgatcacggctaactgcagccttgacctcctgggcacaagcaatcctcctgcctcagcctcttgagtagctgggaccataggcgcatgccaccacacccagctaacttaaattttttgtagagatggggtctctttatgctgcccaggttgcaaaaatattttttagtagagatggggcctctcactatgtcacccatcttggtgtcagactcgtggcctcaagcaatcctcctacccaggcctcccaaagtgctaggattacagcccaccatacccagccagaaaaattttaataggtatatattttattaaatatactatatcctggccaggcacggtggctcatggctgtaatcctagcacttttggaggctgaggtaggggcatcacttgaggccaggagttcaagaccagcctggacaatgtgacgaaacttatatttctttttttttttttttttttgagacagagtctcgctctgttgcccaggctggagtgcagtggcacaatctcagctcactgcaagctccgcctcctgggttcacgccattctcctgcctcaacctcccgagtagctaagactacaggcgcctgccaccacacctggctaattttttgtatttttagtagagacggggtttcacgatgttagccaggatggtctcgatcttctgacctcatgatccacctgcctcggcctcccaaagtgctgggattacaggcgtgagccactgtgcccagccaaattatatttcttgtctctacaagaaataaaaaaattagctggacttggtggcacatgccggtagtcccagctactcgggaaggctgaggtgggagaatcctttgagcctgggaagttgaggctacagcaagccgtgattatgccactgtactccagcctgggtgacagagtgagatcttgactcaaaaaaaacaaaacaggccaggtgcagtggctcatgactataatcccaacactttgggaggccgaggcaggcagatcacctgaggtcaggagttccagaccagcctgaccaacatggtgaaaccccgtctctactaaaaatacaaaaattagctgggtgtgatggctcacgcctgtaatcctagctactcgggaggctgaggcaggagaatcacttgaacctaggaggcagaggttgcagtgagctgagattgcaccactgcactccagcctgggcgacagagtgagactccgtttcaaaaccaaaaacaaacaaaaaaataaaataataaaataaaaacaaaacaaaaatacaaggcaccaaagcaatgtaacaggcgcctgcagtctgagctaatgaggaagctgaagtgggaggatggtttgagccttggagctcgagaccggcctaggcaacatcgcgagacttcatctcaaaaaagaaagaaaaaaaataccatggcatataaaaacaaaattgaaagggatgagtgtaataggcacaataatggcccccaaagatgccaccttcctaattcctgaacctgtaaatgttaggttacatggcaaagggaaattaagggggcagatggagttaagattgctaatcagctgaccttaagatggaaagattatcctgaattatccagcagtacccaatgtaactggaagagggagaaccagagaggcagcatgaaaaggtgttcctggctttgaacacagaggaaaagattacaagccaaagagtgcgggcagcctctaggagccagaaaagacaaggaacgaattctccccagagcctccagaaaggagggcagccctgctgaccccttgattttacgctggtgagacccatgttggacttctgacctccaggattataaggtaataagtgtctgttgctttaagcccctaggtttgtgttcatctgttacaacagcaatacaaaattaatacaaggagcgtgaccggcagcgaatccgtatgggtctgccgcaacctcagttcttgcctcctcagcagaaagaattcgactgaggcacataaggcagaaggagaaaccgagacaagtcttagagcaggagtgaaagtttattaaaagctttagagcaggaaaggaaagaaagtacacttggggctgagtgtggttgctcacgcctgtaatcccagcactttgggaggctgaagcgggtagatcacgtgaggttaggagttcaagaccaacctggccaacatagtgaaacccagtctctaataaaaacacaaaaatcaaccgggtgtggtggcatgtgcctgtaatcccagctactcgggaggctgaggcaggataatcgcctgaacctaggaggcagaggttgcagtgagccgagatcgtgccactgtactccagcctgggtgacagagcgaaactctgttgcaaaaaaaaaaaaaaaaaaaaaagaaagtacacttggaagagggtcaagccaatgacttgaaagccaagccaagtgcactgtttaaccttttgacttggggatttatacattggcaaacttctggggtcttgtgtcccttctccccctattcttcccttggggctggctaccggcatgtgcagaggcctgctagtgcttgggaggggagcatgcgcagtgtgtttcctggagttgtgcactgctcactcaaggcattcttcccttaccagtcaaacgtccctaggaggtcatttaccagttaaactccaccattttgcctcttagtatgcatgtgggggcctacttgcccagttcctgagatcttattaccagtttcaggtttttcttatctactgggagactgccggtccctgatgccagatgcaaccaattattattttagcgtaacagcttaacaaccacttgaccctcacctgatggtcacctgactttcctggttgagaggtggggcctctcctgccctgctcatgtctgaccagctatctactgtaacagtcacggaaggtgtttgagtgagggatggatggggggttcttcttgtactgcagaaggattggttgtgaagggaggcatcatggagatgccagaatgggagcccgtcactgtgaacctggctggaaaggggaaaaggggaagacacccccaaaggatggcagcaggtggattcagagctggaacctcagaaggccgggaagaatggcgttcactggctgagttttgtggatgaactcgtggatcttgacgcatgtctcctccttctctagcaaagccccctcgcagcacctgtgcagagcggggagtgggtcctcaaacacttcctggactctggcctgggtcccagactgggggccagcactgtaggcagaccaagagctggcccgagggagggagactccggagctcctctgacagggcctggccgtggcagaaggaggtagctgagcttgctggagtccaggggttggcaatggcagcctccctgctgagcgccctctgtggccagcacttccttggggaaaactcagcaaaaatctattggttgagaaaatggaggcaggagagaagcacaccacgggtagacagaccccacagtcttcattcattcatcctttcagtcagcaaactaaggacactttcctaagctccttgggtatagtagtcaaaatgaagagtcaaggcttggttcttaggctgagcacagtggctcactcctgtaatcctagcactttgggaggccgaggcgggaggattgcttgagatcaagagttcaagaccaacccagacagcatagcgagacccctgtctctaaaaaaaaataaaaataagacctggttcttgccctccaggggctcccagataggaaagagagagagagacatgttttggtatgagtctagtcgcagaattttggagtccaaagccttatagtacatgatacctgtggattgagggctggagccccagaaggccaggaagaatgggaaggccgggaagaagtcctcccaggggaaggaacaaagcatgactggaaatataagttggagtctcagtttcctcattggtgaattgtaggggttgggttgctggattactgtggagccttggagttctgacaactcagacatttgagattggctgatgagggggtgctttgttgacatcgcccctctctctacctctcagcaaacctagaaggccttaggctggcccccagggctagttgcatcagctagaggaagggctgtgttttcccagaactgggggaggggtgtgacaggggggaagttgggggtggggctggacgggaagacctgcccctgctcctggtccactctggtcagcccttcataaggtgcctttgtaacagtagagttcgcagcagattctccgaacagcagagatattccagagtaagcaggaaaggtctgggcctcttagcatgacttaaggactccagagaaggggccccaccactccctcaaataaatagctttccttagctggttgtttggctcatcatgcctcaaaaccctccattcagaggaactgtgttttttcagcttggaagatcctgcactttccagataggagactgaggcctacaaaggcagactgacttgcttaagatcatgtccaagttagttctgtccttttattttttatttatttttttgagacaaggtttcactctgtcatccaggctggaatgcagtggcaaaatcatgactcactgaagcctcaacctcctgggctcaagcaatcctcccacctcaggttcctgggtagctgagactacaggcgagtgccaccatgccaggctaatttttattttattattattattattatttgagacaagtcttgctctgtcgcccaggctggagtgcagtagtgcaatctcagctcactgcagcctccacctcccgggctcaagcaattctcctacttcagcctcccaagtagctgggactacaggcatgcacctccaccctcagttaatttttgtattttttgtagagacagggtttcaccatgttgcgcaggctcgtcttgaactcctggactcaagtgatccacctgcctcagcctctcaaagtgttgggattacaggcataagccactgcgcctggctcaaattttttttttgtagaggcaaagtctcactatgttgcccaggctggtctcaaactcctgggctcaagcaatcctcctgccttggcctcccaaagtgctgagattacaggcgtgagccactgtgccggccagtttttttttgttttgttttgttttgttttttgagatggagtctcactctgttgcccaggctggaattcagtggtgcgatctcaactcactgcaacctctgcctccctggttcaagcaattctcttgcctcagcctcccaagtaactgggattacaggtgcgtgccaccatgccaggctaatttttggatttttagtagagacggggtttcaccatgttggccaggctggtcttgaactcctggcctcaagtgatctgcccgcctcagcctctcaaagtgttgggattacaggcgtgagccactgtgctggccagttgtatctttaaggagaatattttgtgatcagtagcacttgctcttccctctacctggatagcagatcttccaaaagctgagaacattcaggtcttagcacagctgtttcttcttcctgggcataataaccatgtttggaattgggcatcttcagaggatcttgttgaaatgcagttccaattcagtaggtcctggctggggcctgagaatctgcattcatgatgagctctggggtaacttgatggatggggctggtctgcagataacagtgagtagtaaggtttgttaccttcttttcttcttcttcttcttttttttttttttttgagatggagtcttgctctgtcgcccaggctggagtgcagtggtgcaatctcagctcattgtaacctctaccgggttcaagtgattcccctgcctcagcctcccgagtagctgggattccaggcgcccaccacgatgcacagctaattttttttgtgtgtgtatttttagtagagatggggtttcaccatgttgaccgggctggtctcgaactcctgacctcaagtgatccacctgtgctgggtgtgagccactgcacctggcctcgttaccttattttcttcctagtacaagtcacaatgtgatgttaaccatattgatctgtgcattgttggtcattgctctcttccaactagttataagctgccctgagtgcagggaccatgcctacctcatgtcctgttatatccccaggcccagcagagtgttggcacatagtgggctcccaatacaagaactcccctgagggacaaagcagagggttgaagcacacaacaggggttgagtgcctggggacaggagtggggcagatcatgaaaataaggctcctgtttttcttctctttttttttttttgagatggagtttcgctcttgttgccaaggctggagtgtaatggcacgatctcggctcactgcaacctcggcctcccaggttcaggcgattcttctgcctcagcctcccgagtagctgggattacaggcatgcgccaccacgcccagctaattttgtatttttagtagagacggggtttctccatgttggtcgcgaactcccgacctcaggtgatctgcccgcctcggcctcctaaagtgctgggatgacaggcgtaagccaccgcatccagcttgttcttttttttcttaagagacaaagtctcacactgtcgcccaggctgagtgcagtggcgtgatcatagctcacagcagtctcaacctcccagactcaagtgatcctcccgctccagcctcccaaacaggtgggactacaggcatgtgcaccacacctggcaaattgtgtttattttttgtagaaaggaggtcttgcctatattgcccaagctggtctcaaactcctgggctgaagcagtgctcctgcctcagtctcccaaagtacttggattataggcgtgcacccagccagcccctgattctttaaaaatctttaaatatatataatatatgtataatatagcttatatatgtattatatatataaattatatgtgtattatatatatataaaaatacatatatataaaattatttttttttaagagacaaggtctcactatattgctcaggctggtctcaaactcttgggctcaagcagtcctcccgcctcagcctcccaaagtctgagattacaggtgtgagccacggcacctggccagctcctgatgcttgaccccagtagttctggactggtgtgacaaggcaaagaaaaacagcctgaagcccatagctatcaggtgatgtgtgtatatatataaatcattttttaggccaggcatggtggctcatgcctgtaatcccagctttgggaggccaaggtgggcagatcacctgaggttaggagttcgagacgagcctggccaatatggcgaaactccatctctactaaaaacacaaactttagccgagcatggtggtgaatgcctgtaatcccagctactagggaggctgaggcatgagaattgcttgaacccaggaggcggaggttgcagtgagccaagatcgcaccactgcactccagcctgggcaacagagtgagactctgtctcaaaaataaaaaaaaagatattttattggctacatttatgaaattgtctcccaggcaggagaatcacttgagctcaggagttcaagaccagcctgggcaacatggtgaaaccctatatctacaaaacatacaaaaaattagccaggcgtggtggtgggtgcctgtagtccctgctacttgggaggctgaggtaggagaatctcttgaacccaggtggcggaggttgcagtgagctgagatcacatcactgcactccagcctgtgcaacagagcaagactctgtctcaaaaaaatttttttaaatcacttgttaaacttggaagcttttcccaaccttggctgaattcattctgtagcttcctggggtcaagcccagccagggttacttaggatttggcagcctcaggcaccacttgttcatcttgccccttgcaccacattcccacactgttcccagcctgtcccttgagagcgttgaccccagtccatctgcggccagttcagtttgcccagcttggggcatccagatcatccagatactctgggggtgaggccataggcaacgctgccaaacccattctagtaagcacctcattcagcctcagtttccctgcaagagggcgggagggaagacttaagaaactgaatgaagcctgaggtctagtccaggctacttcccttctgttacttcccttcccttctttgctggaattttcttttcttttctttctttctttttttttttttttctgagacagggtcttgatctgtcacccaggctggagtgcagtggtgcagtcttggctcactgcaaccttcacctcctgggttcaagcaatcctcccacctcagcctcctgagtagctgggattacaggtggcaccacaacacccagctaatttttttttttttttttgagacagagtctcgctctgtcatgcccaggctggagtacagtggcgccatctcggctcactgcaaactctgcctcctaggttcaagcaattctcctgcctcagcctcccaaatagctgggattacaggcgcccgccaccatgcccaggtaattttttatatttttagtagagacggggtttcaccatgttggccaggctggtctcaagctcctgaccttaggtgatccacttacctcagcctaatttttgtatttttagtagagaggaggttttgccatgttggccaggctggtctcgaacttttggcctcaagtgatctacctgccttggcctcccaaagtgctgggattacaggcataaaccactgcaccctgaccctttgctggaattttctatctgcaatggcttgagtggaccagataacctgtcaacccttggatgtggcatttttgagcaggaagaactgagtccctgtggaaccactgtcccactatatctcttaaagagaccctgccaccctctactcctataacttgtctgcatctatgcctgtccccgtagaacactccttctgtcttctaatctgacacgtggctagcagcattttatctggaccttctgtctgccagggagacatggaggcagcctgggtgcatagcctgctgggagggagggaatgacggagggaggcctcctcatgtgctctgcccacagctctttttttcaccaaattactatactaattcattcactctctcccttttccaccaacacactcatgttctcccttcctctttctgtcattccctccagttcaaggccaagaacatgtctgggaatagacttgcctcaaaaggggttaaaatacacacatagccaggcacaggggctcatgcctgtaatcctagcactttgggaaggtgaagcaggcagatcacttgaggccaggaatttgagaccagcctggccaacatggcgaaaccccgtgtctactaaaaatataaaaattaaggctgggtgtggtggctcacgcctgtaatcccagcactttaggaggccgaggcaggtggatcatttgagttcaggagttcaagaccagcctgcccaacatggtgagaccctgtctgtactgaaaatacaaaaattagccaggcatggtggtgctcgcctgtaatcctagctactcgggagggtgaggtaggagaatcacttgaacctgggaggtggaattgcaatgagccgagatcacgacactgcactccaacctgggcaacagagcaagactccatctcaaaaaaataaaataaaatgcccaggcgcagtggctcacgcctataatcccaacactttaggaggccgaggtgggcggatcacgaggtcaggagattgagaccattctggctagcacggtgaaaccctgtctctactaaaaaaaataaaaaaaattagctgggcgtggtggcgggcgcctatagtcccagctgctccagaggctgaggcaggagaatggcgtgaacccgggaggtggagcttgcagtgagccgagatcacgccactgcactccagcctgggcgacagagtgagactctgtctcaaaaaaaaaaaaaaaatagccacatgtggtggtgggtaccataattgcagctagtcgggaggctggggcagagaatcacgtgaacccaggaggctgcagtgagccaagatcacaccactgcactgcagcctaggtgacacagcaagactctgtctcaaaaaaaaaaaaaaaaaaaaccacacacacacatgcagaataacacggaaaggcacaaggacgctgcactcaggagtttcccaaagtctgagctagagaggaattaacaaaggtcgccctcttggttatctagatggggtcaatgaggcccagggggcccaggtctgctccacaccactgggcaacagaagcaggaggcagctactcttggggcaccctggcctgcccaccacactggagtcagtgctcccagccctgtccacgcatggatcatgttttccagttctgagttggtgaccctgaggctaagtccaaaatgcaagaattaaggcagagagtaatgcccgtagggacctggacctggatacaagagttacaaaatcggggctggaagagccttcgtgcagaaatctccaaactcctcgtttgacagcgtggatgctagagcccagggagcctgcttgcaggtggcccggaggcagcaccagaacccagttacagtctccagccttgtggtctttgcctgtgcccactgctcaccaatcctggatgttcgaataccagggaagcccccaccttttttaaaaatagagatggggtcttgctgtgttgcccaggctggtctcaaactcctgcttcaagtgatcttcccacgttggcctccaaagtggaaaccccagtttcttgaggagaaaaaattcaacaaatttttccccaaataaagattagagaaaaacaaaacaaaagtgttagagggctaaaaatgaataaatcaggctgggcgcagtggctcacgcttgtaatccagcactttgggaggccgaggtgggcggatcacctgaggtcaggagtttgagaccagctggccaacatggtgaaaccccgtctctactaaaaatacaaaaattagccaggtgtggtggtgcatgcctgtaatcccagttacttgggaggctgtggcagaagaattgcttgaacccgggaggcagaggttgcagtgagccaagactctgtctcaaaaaaaaaaaccaaattttttttgtgtttgaaacagggtctccctctgtcacctaggctggagtgcagtggcatgctcgtggctcactgcagcctccaccttctgggtccaagcgatccttccacctcagcctcccaggtagctgagaccacagacgcttgccaccacacctggctagtttttttttattttttgtagagatggggttttgccatgttgcccatgttggtctcaaactcctggactcaaacaatccacctgccttggcctcccaaagtgctgggcttacaggcatgagccaccatgcctggccaggttacattatttaacctaatacattaatttagaaaaattactcttttccatttgtaggttaggaaacagttttatgcaaattcttcattctgctgcttgattgaggtaatgttggattgttatgtcttgctcacagtaaagtagaggaaaagcaccctgtataatgaatattgtcaggatgtgagtatggcaccatcttttctttcttaagtaataattctagaaaagaacgtcaccttatagtcaggcctgtgaggtatttttgaacacctgtcattatatacaactcctgggtggccacatggtcccttgccacaccagaggcctcactgccgcctccctccaagccagggtaactatttttctttttcttttctttcttttgaaacagagtcttgctctgtcacccaggctggagtgcagtggcttgatctctgctcactgcaacctcggcctcccgcgttcaagcgattctcccacctcagcctcccaagtagctgggactacaggcatgtgccaccatgcccagctaatttttttgtatttttagtggagacagggtttcatcatgttggccaggctggtcttgaactcctgatctctatgatccacccgcctcggcctcccaaagtgctgggattacaggcgtgagctaccacgtccggcctgggaacctgctttttgaggtgactggacattataaacaaagaacctagaatgtactaggaattgaatctaggctgagtgcaatggctcaggcctgtaatccactgcagtgcacttcgggaggccaaggtgggaggatggtttgagctcaggagtttgagaccaacatgggcaacatagggagacccagtctctgcaaaaataataatttttaaaaaactaggctgggtgtggtggctcatgcctgtaatcccagcactttgggaggccgaggcaggcagatcacaagatcaggagttcaagaccagcctgaccaatatggtgaaaccccatctccactaaaaatacaaaaattagccatgtgtggtggcgttcgcctgtaatcccagctacttgggagactgaggcaggagaatcacttgaacccaggaggtggaggttgcagtgagccgagatcgcgccaccacactccagcctgggtgacaggtgagactccgtctcaaaaaaaacaaaaaaaacctggccagatgtgatggctatttgtggtcacagttatctgggaggttgaggtgggaggattgcgtgggcccagaaagtggagattgcagtgagccataatcatgccactgcactccagcctgggtgacagagccagaccctgtctcaaaaaaaaaaaaaactagtaaatctaatggtcatcatacagccaatagttactgagcatttgcagtgatgaaatgtagagtggcaagtccaggcatggagaaataaatgaggaatgcagggagcagagtcagaaggcagaatctgctagaaagaaggcagtgcctgcttattttattattttattttattttttgttgttgttgttgttgttgagatggaatcttgctctgttgcccaggcgggagtgcagtagtgcgatctaggctcactgcaacctccacctcctgggctcaagcaattctcctgctcagcctcccgagtagctgggattacaggcacccaccaccacgccaggctaattttttgtatttttagtagaaacagggtttcaccatgttggccagctggtgtcgaactcctgacatcaggtgatccacccacctcggcctcctaaagtgcttgggattacaggcgtgagccaccgcgcctggctcagtgtctgcttattgagtcccgcagtctcctaggcatttcataaatatcatctctcaccccatcacacccgtagggaagagtcaggacacatttcaactcctctttgccaaggaaggaataatgtgtgttccttggcttattgctttaccgtctcaggtctcagtttcctcatctgtaaatggggtctacctaccacatacaattgttgttctgctctaagaactttgtatattgccgggcgcggtggctcacacctgtaatcccagcactggccatcatggtgaaagcccatctccactaaaaatacaaaaattatccaggtgtggtggagggcacctgtagccccagctactcgggaggctgaggcaggagactaacttaaacccaggagacggaggttgcaatgagccaagatcatgccactgcactccagcctgagcgacagagtgacaccctgtctcaaaaaaaaaaaaaaaaaaaaaaaaaagctcaaggttaaaaaaaaagaactttgcatatataacttagcttagaataatatgtcttcagttattgtttgcccttatcattattacaacatatgaggatgtcgaggctcagggaggctggtgctctctgtttccctccaccacttgcagtacacagagggttaaggtggaagctttgccctctgcagctggcccagacctggatttggctgcctgttctgccctggagaagcaaggccaactgtcaacacagggtgacttcaggtcatctgtggctatgcatggccagcctgccaaggggacttgacaagagggaagatcactgctttcctctcaggtctgatggaactagggcaggcctactcctgtcatgtccgagctatgagaccttgggcaagtacctctccctttctgagtctcagttttgtctcagttttatcttgggatacttatgtttttctgtctcagggcccctgtggaaactgagttggcacaccactctgctgtgccaacataagcatagttaaggccagtaactctgggtggggtaaatattacaatttaaaggggaggggttatagggaagtagaatatttttttctttttctttttttttcgagacagggtcttgctgtgtcacccaggccagagtgcagtggtgccatcacagttcactgcagccttgacctcccgggctcaagcaatcctcccacctcagccacttgagtagctgagacctcagatatgtgccatcacacccagctgattttttaaaattaattttttgtagagatagggtctcatatgttgcccatgctggtctcaaactactgggttcaaatgatcctcctgcctcagccttccaaagtactgggattacaggcatgagccaccatgccgggctgggaggcggaattttgttcagtctaaagataagctttttcatagctctggctgtagtgggagggagcagaggagtgaatgattgtcagttgggagggtgcagagtgggctcctgccctagggtggaggtgagggtggcttaggtgagacaacacagaggccctgttcagccccacgtcccctccctgtgctccctcctcctctctcctctcctgcaggcgtgggaggtatcatcattcagcagatttcaccagaggcagtggaggaggcaggtacctgagccagaattcagaatgtcttattctccacttgactctgccactaacttgttgtgcaactttgggcctttccccaggccttcattttcttttcttttctttttctttttttttttttgaggcggagtctcgctatgttgcccaggctggagtgcagtggtgcagcatcatctcggctcactgcaagctccaccttctgagttcacgccattctactgcctcagcctcccgagtagccgggactgcaggcgcccaccaccacgcccggcttattttttgtatttttagtagagacagggtttcaccacgttagccaagatggtctcgatctcctgacctcgtgatccacccgcctgggcttcccaaagtgctgggattacaggcgtgagccactgcgcccggccattttcttaaatatctaataaaaaatatatagcaaatgcagtttgtaaactatgacaatatgaccacgcaaaagattattatcttccaagactgctggtccaaggaaaggtcagtaataaagtggaagcattgtagcttatggaatgactggttagatttgggagaagccttagcaataatctagaatctgcatagataatacatctgaggattgggctttgtggtttacaaagcattttttttcctcttttgatcccagccgcttgtctggactgatacaaagcatttttattagtttgtcttattcaatcctcacaccacctcaaatttacagaggatatggatctggttaacttgtatgactatgtaacctcatgtcagtccacagcactgcctggaggtgggtagaggtggtcctgggctggaatcccagccccagtgggaccttgagcaagttactttagctgtctgcacctaaatttcctcactggcaaaacaggaatactggtggttcacacctgcaattccagcactttgggaggctgaggtgggaggattgcttgagtccagaagttcaaaaccagactgggcaacatagcaagaccatctctacaaaaattaaataaataaaacatttacaagggttgtggtgaagattaaatgagatcactcacgaaaaagctcagcagaccctgatgtgcagtaggtgctcaataaatgttagccagcaaaaaacaaacaaaaaaaaactcagctaggaaattgcagtactgggcttctgactccaacctcagtgttccttgccccacatcaagctgtttcacttcaaatcctctccatttcacaatggagtcaccccaggttgaaggagtgaactgtgctttggagggctgccctaagcaggcagcaaagagacagcttggtctccagtgacctgaaagaattatttattgccctgaagtccagtataccagttgccaaagggaaaagcttccttccaactggctcagcaagctgacagaggaagagtcgggttcttgctggggcagtcatgcagagctgggatgacaagtagaaggctggcagatctgtctctgggcagatggatcacctgatacagatgctggggcctgagccctgggattggcccaaaacagggctgtgttgacccaacagctgggcattggcatcctgtcaatctgccgagagcctagaaatagtgcgggggcagtctgctggtctcattgtgtcagaggaagcaaccatgcaggtgctaaccaagcgttaccccaagaactgcctgctgaccgtcatggaccggtatgcagccgaggtgcacaacatggagcaggtggtgatgatccccagccttctgcgggacgtgcagctgagtgggcctgggggccaggcccaggctgaggcccctgatctctacacctacttcaccatgctcaaggccatctgtgtggatgtggaccatgggctgctgccgcgggaggagtggcaggccaaggtggcaggcagcgaagagaatggaaccgcagagacagaggaagtcgaggacgagagtgcctcaggagagctggacctggaagcccagttccacctgcacttctccagcctccatcacatcctcatgcacctcaccgagaaagcccaggaggtgacaaggaaataccaggaaatgacgggacaagtttggtagaccttggacactagggaaggtaatggtggccatgctggtgggtgtgagtctacaaagggacattccaggagaggagagggggcagtggtgcaacccactgggagaggaacagcctgactttcagacagagccactcttgggtcagggtattgggaccacaacctaggagggcctaagactaggcctgtgttactatccttctgacctcaaattggcaattgcaatgaagtgatatggaaacagagggaaaagtggcctgtgagggcatatctcatatgcacatatatgtgtttgtgcatgtgtgcatttattagtatgtgaatgcttgtaaatgtgtgaattgaatgagtgtgttctcatcagtgactttgttaagaatttaattgaagaggggccaggcgcggtggctcacaccaaagcactttgggaggccgaggcgggcggatcatgaggccaggagattgagaccatcctggctaacatggtgaaacccaatctctactaaaaatacaaaaaattagctgggcgtggtggtgggtgcctgtagtcccagctactcgggaggctgaggcaggagaatggcatgaacctgggaggcagaggttgcagtgagctgagattgtgccactgcactccagcctaggtgacagagggagactccatctcaaaaaaaaaaaaaaaacttacctaaggcatgcacattgatttaagtgaacattgtgaattccatttgtgtgacagtgtttcccaacattttttcaagtcacagaacatggaaaattattatatggcacatggggatacataggtgaggctgcttgcagtactgctacaacaggctgggggtactctgaccatcccaggttggaacccaccaaacgggaagccgagggaccagtcatggcactctaatccattccaggcaaactggagtatgcagacatgcctgttgggaagccctgttgtatgtacatatgaatatgtgttccagtctaagcctacatgtctatgcacagaggggctggggtggtgagtgtggatgagcagcaagctagacaagcaggtggtggcagagggtaggaggtgggaaggggccctagcatggtcaccactagttcactcatggataaagactagtattaatagaaattggaccacagcacctgccagttttgattctgtgccacctgccagccctgctcccacaaactggtctcattagttgtaaacaacatccacgtccattgcaatctcaaaaccacctgatgcagctatgtaggaaaagattctcatccccagtttactagtatggaaattgaagccagagaggtgaagtgactcacccaaagtcacacagtaaggagacaaaagtaagactggcctcaactttgagctgagtgttctttccatcgtacccactgtctgccattttgtgttatcttcataatctgtgtgaaggctgctctgtaattatgcggaataaacatgggacccccaaacacagagcctatggagagctctgctccaggcattttctcagccatttttccttctcccgcttcaaacccaaactgtcaacctcaacccttcttccctctcccgttgaggctccctgagttgcctcacagaggttcttcttgaattagatggggctgtgtcaacagctctgggttcacgttctgattctatcactaatgagctgtggggccttgggcaagctaattcatttctctgggtttcagcttcttcactgaataataacagtggttgtaaaactaacaactggcatttgaatagttttaagatcactttgcatatccattatctaatggaattatcatccccccccacctttttaaattttgagacggagtctcaccctgtcccccaggttggagtgcaatgtgcaatctcagctcactgccacctccacctcccaggttcaagagattttcctcagcttccaaagtagctgggattacaggcgtgtgccaccacacccagctaatttttttaaaatctttagtagagaccgggtttcaccatgttggccaggctggtcttgaactcctgacctcgtgatccacctgcctcggcctcccgaagtgctgggattacaggcatgagccaccgcgcccagcctatcattcccttttgcagatgagaaaactggaggcctgagaagtaaaatgagtccaagtttactcagtaaataacagccaagatgtgaaccctggcctaattagtctaattcttttcctctacagtggtattccttagagccttagacttttgcagagtgggctcaaagtgggaactgggcatggcagagtgggtagaaaccacactctgactcactcagttgcttcaaaggccagagcagcaactctacgccataacgtttcaacacaccctaacctgattttcattcagaggcaatatggtatagcaacagttaaaaatctgggctcttgttctggctcttccattgacttctgtattatcctagacaactttttttttgagatggagtctcaccctattgccaggctggagtgcagtggcgcgatctcagctcactgcaacctccacctcccgattcaagcaattctcctgcctcagccacccgagtagttgggactacaggtgcacgccactacacccagctaattttttgtatttttagtagagatggggtttcaccatgttggccaagatggtctcaatctcctgaccttgtgatcctccccgctcggcttcccaaagtgctgggattacaggcgtgagccaccgcacccaaccttttttttttttttgagatggagtcttgctcttgtcacccaggctggagtgcagtggcgccaccttggctcactacaacctctgcctcccagattcaagcaagtctcctgcctcagcctcccgagtagctgggattacaggctcacgccaccatgcctggctaatttttgtacttttagtagagacagggtttcaccatgttggccaggctgatctcgaactcctgacctcaaatgatccacccaccttggcctcccaaagtgctgggattacaggcgtgagccaccacgcccggccctagacaacttatcttacctttctgtatctgtttccctgttagtaaaatatagcagagaaatcaaatgagttattccagctctgacaacctaggattctccttacagtgctgaggcactgccagttttccaacagcaacatcagcattgttcttcctgcttcaatgggcatgtgacagtatcttggttgtttgaattgatactgacttggccttttaaaaatttcttcactccacagatcccttcacatgatagaagacagactctttgatgaggtcggcggagcagttcactagccaatgatgagagcagaaaggcctagacctgcagccagaagtgaaggcggctcagttctccgggatgcttctctacctcctgagcaccaattcctggattccagtcactggctcacctttagaatgtctgttgctattcactgctcccctcgctcctcttaacagcttggggaggtgaccagtggttcaggagggactagacaattacctgtccagtgtggtatggtaggaagagtgtaggtgttggcacgtgaccaaaattcacatccctcctcatggcagtcattcagtatgtgtacttgtacaagttatttaacccattggagcctaaattccctcatctataaaatggggataatattatctacctcacaagcttatgaaaactaaacatgatgaatcaaaagcacttggcatgtgagggctattaaaatagcctgattttttttttctccccctctccccaatgtatttgctctggcccttgctttttaccctccagagctaagaggtagcagagtctcttgggatgagtgattcaccctcttacttggcgaccactgatgagatcaacaacaggtgaactataaacctattatttattgcagaactaataaaaaatccaaagccttgtatttgtacatctttattatttctaaagcactttcctcaacctaatttcagtttttacaattggtactcaagaaaatagagacagaaatcatttgattttgcccagaaaccatctgcttatatttataaggccacctaatttgaaatcacatatagaccaggcgcggtggctcacgcctgtaattccaacactttggaaggccaaggcaggtggatcacaaggtcaagagattgagaccatcttggccaacatggtgaaaccccgtctctactaaaaacacaaaaatcagctgggcgtcgtggcatgcacctgtagtcccagctactcgggaggctgaggcaggagaattgcttgaacccaggaggtggaggttgcagtgagccgaaattgcgccactgcactccagcctgatgacagagcaagactgtcgtctcaaaaaaaaaaaaaaaaataccacatatactttatctccaaaacctaatctgattataaattctaagctaggaaacaaaaacttttgggacaagtacttttttttttgacggggtctcctttgtcacccaggctggagtgtcacccaggctgcagtgaactgtgacacaaccacaattaattgcatcctcgaattccagggctcaatagatcctcccacctcagccttatgagtagctgggattgcaggaacgtgccaccacgcccagctaatttttgtattttatgtagagacagtgtttcaccatgttgcccaagttggtctcgaactcctgggctcatgcaatctgccctgcctcagcctctcaaagtgctgggattacaggcatgagccactgcatcgggccaggacaagcatttgataagccataaaaagtaacctcattccagttaggtacagtcttttgcttctaattgcaccaagctccactgtagacagtattagctcctgagtccattttctccaggataacccacctaagagcaaagacaacttggcaacataagatttctgttttccttgtctggagtctcctccttcgaaaccaccttctatatcattcattatagacagctcagaaatacaaacctgactgtatgatttaaaacgccttaatgacttaatacctacaggatgaagtcaaaattatttggcaagagtcacagaatcctccataatctggctcactctaaattcactttgcactaggacaggggcaggcaaaccttttctgaaagggctacatattaattaggctttgcaggccataggtctctatcacaactactcaattctgctcttgcagcatggcagtcgccataaacaacatgtaaacaaatgagcatggctgtgttccaatgagactttattggcagtgggccagatttgggtagtctgctaactctaaactagaattcaacctcatcttaaaatctttcagatgggtgaatggaaactgaccattctctgatgatgaactatttttcttacaacaataaagagtcagagtactcatggtacgtattttaattacaaggtgtcaacatacagattagcataagcttcaactgtcataagaaacatgttccatcaaattcagaaacagcaggtatcagtgaaactggagcaagcattttgaagacttcaacgtattggatggaatttttcaaaaatttcaccatatgttttcttatctataaaaggaaagatcataaaagatttattttaaaaatatgttttaaaaattgtatttcctaaacgaaaattaacactcactaatcttatgattgaaatcctgctgtggtctgaatgttcatgtccccccaaagttcataaattgaaatgtaacccccaagataacgatattaagaggttaggactttgggaggtgattaggtcacaaaggctctgtcctcatgagggggatcggcttaggggaccttgtttgcctcttctaccatgtgaggacacagcaagatggcatcatctatgaagcagagtgggccctcagcagacaccaactgtgctggtaccctgatcttggacttcccagcctccagaattgcaagcaataaatttctattacttatatattacccagtctattctgcaattatacaggtggtaagaaaaacaaagttaaaaaattttttttaattacccagtttaaggcattttgttatagtaggccaaacggactaagacaaacccctaagaatttccttattttcttgtccttgactatggcttggtaatcactgaaggattttctttcattgactgaagaataactttggaggaatctgtgatgacaaccaaatgactgccaagagggacaaggtgctgccaggagtatcctgactgaagaggtgaaggaagaaataaacacagaggggcacaggtcagctaggagaggccaacagccaatgtggtcaagctctccgggctcccactgtctgtgcatgaggctcttggcacaactgccactaatctgcagctcagaaagagaatgagccctgaagctatacacactcctgcagacacagggaactcatggaactatgtctaggcaaagagccagaggtctgagactgaagactcctcaagccactgggcctcactcctagtaatcaatatatccaagatgacttccagctctaacatttaacggttctgggtattatgcattcccgatacatccactattcatggctttgtgctagtctttaagctcttctttggcaaaaaaagaaactgtatctttctgatccaccataaatatcatatatgtgactgaaggctgtgggaatattaaagagtaataaaattttagagctaaataagaccttagagatcattcagtgtaatgaaatttaaatgttttatatcacgcatttacattaacagaagaatttttttttttttttttttttgagacagggtctcgctctgtcacctaggctggaatgcagtggtgtgatcacggctcacggcaccttgtcctcccaggctcaagtaatcctcctgcctcagcctcccaagtcaatgggtctataggcatgtgccacctcacccagctaattttttaattttctgtagagatgaggtctcactatgttgccgagactggggaaaatctatttatgtttacaagttcaaattttttctatactcattcatttacacatttaataaggctatgtgtgccaaacccctggggaaaccaaaaaaaactgtcgtagtagttaaactcccagcctacagatactcatatatgtgcacatctgtgttgtgtatatgtgtgtaaaacacaggtgagaaaagttatattacaactattaatagattcatagcagactagagatagagcaccctgagggaatgcctgactgtagctgggtgaaagcttcactgagataataaaagcagaaatttgctaggtggatggggtggaaacaggggcaagaggaagaataacatagcaggaagaaggtacaacatgtataaagtaatatagggcaggttcgggacaaagcatttcaccaggcaaatgatgagtgatgaggaatgaggaagtattccatacggttcatatccactattatgcataagtaagtgcctgctatgtgtaggctctatacaagaggctggggaaacaaagacgaagctacaatccatgaagaacacacacatgtgtatatcatatggtagataagaatgtgggtaaagtgtttctaccagaggacaggcaattagctaacctggagtaaatgagccatcctaaggagtctggattttatccactaggcaatggatgacttatttattttattttaattttattttattttttgagacacagtcttgctgtgacacccaggctggagtgcaatggcgcgatctcagctcactgcaacctccgcctcccaggttcaagcgattctcctgcctcagcctcccaagtagctgggcttacaggcacccgccatcatgcccggctaatttttgtatttctaatagagacagggtttcgccatgttggccaggctggtctcaaactcctgacctcaggtgatctgccccgctcggccccccaaagtgctgggattacaggcgtgagccactgcgaccagccggatgactattttaaacagatgtgatcagatttgctgtcattggaaataagaccaaagcaagtggtgagttaagaggcaagtgcaacagtccaagcaagagattaacaaggcctgaaccagggtagtggtagtgggagaggagagttcaaagttaagaaatatttaggaagtagaactgataagacctgatgactaatgggaagtgaaagagaaagacttgatgattctcaggcttctggcttgagtgtccaggtggacagtagtgccattctctgaagcaggacacagaggagcaggaggtttgggaaggcagaggggatatgagttttgtttgctgtccaaaggacacggaggtagtcagaaactggatatattaattcaagagaattttggtctatagactaagatgtgggagtcaacagaatttagaaggtatctaaagccatacacatggataagattaaccagggaaaataataatacagtaaacacagattatctaaaattaacttgaaataccttcttcaggaaaatcctctggatgtaatttcatatatccaaacatttcacggtccctcacagcatacaggtagtcttcacgttttacaagataatatccagcaaaaaaaaaggccgtaatatatagaagctggcgatgcaaacctgaaattcaaatgacaaatcccaaagaaagcaaaaattagtccatgtgtattaagagttacatttttggctggacgcagtggctcacacctgtaatcccagcactttgggaggccaagacaggtggatcacctgaggtcaggagttcgagaccagcctggccaacatggtgaaaccctgtctctactaaaaatacaaaatttggctgggggtggtggcgggtgcctgtagtctcagctacttgggaggctgaggcaggcgaatcattggaacctgggaggcagaggttgcagtaagctgatattgcgccattgcactccagcctgggtgacaaagcgcctggcctgttatggcatttcttaaaaaaataaaaataaaaaaagcactgggctcagtggctcacgcctgtaataccagcactttgggaggctgaggcaggtggatcacctgaggtcaggagtacaagaccagttcacatggtgaaaccctgtctctactaaaaatacaaaaatcagccagatgtggtggtgggcacctgtaatcccaactacttgggtggctgaggcaggagaattgttagaacccgggaggcagaggttgcagtgagccgagatcgcgccgttgcactccagcctgggggacggagtgaggctctgtctcaaaaaaaaaaaaaaaaaaaaaaagctattctgaacaaaccgccttgatccctgactttgagacaccctacatattcttttttttttttgagacagggtctagctctgtcgcccaggctggcgtgcagtggcacaatcacagctcactgcagcctcaacctcctaggctcaagcaatcctctcacctcagcttcccaagtagctgggaccaaaagcgtgcaccaccatgccttttttctttctttctttctttcttttttttttaagaggggtcttgctatgtttcccagactggtcttgaactcctgggctcaagcgatccccctgcctcagcctcccaaagtgttaggattacaggaatgagccaccacactcggcccacattatcacttctttaaaggttaacaaatctaaaatattacatgcaatgtatattttagcatatagcacttaatatttatttaataaatgaatgaacagccttgggcaattcaatttactacctctaaaacatagacaagacctatcctggctgggcgtggtggctcacaactgtaatcccagcactttgggaggccgaggtgggtggatcacctgaggtcaggagttcaagaccagcctggccaacatggtgaaactccgtctctactaaaaatacaaaaattagccgggcgtggtagcacgcacctgtagtcccagctactcaggaggctgaggctggagaatcgcttgaagccaggaggtggagattgcagtgagccaagatcacaccactgaactctagcctgggcgacagaatgagactctgtctcaaaaaaaaaaacaaaaaaagacctatcctatctttctcacagtagtagcatataaaacaagacatatgcatataaaagtatttccgaaaatgtataaaacaataaaaatgaaaaatattcctatgttctagaactggacagagcactctctcttaccccaaacagccactgctttccataatgggctacccgccatatagcaaaccaaagagtgcatgttctcccatgtgccactggactgcagagacacacagaaccagactctctctacgctgacccatgttcctcacagaaagactccataagcgttcgagatgatgatgtcagcatcctagccctaaaggcatggcttggcctcttgccaaggccccattttcctaacctctctcctcattctctcttagtggtcgacctctcactacctgcacaccccatctacaatcattttcccattgtttactcagtgagtctaaccccggcagctattgtgctctttgaagaacatcataaattactgataaactagagatcaataaatatttaattttgtgggctatacttagcataccaactaactctaaatttcgggcacattaagtggtaaccagcaagaaggttaagttttaaaaaacagatgatgagagaaaaacttataaaaaaattctatttattgatagtacagtagggtgactacagttaataataatttgttgtatagttcaaaattgctgaaggagaggaatttgaatgttcccaacataaagaaggggtgaatgtttggggtgatggatgtcccatttgccccagtttcaacattacacattgtatgcatgtatcaaaataccacatgtacccccaaaatacgtacaacttatttttaaagtcttattcttaaggaattattttaacatttcctgctaatttgaaaaagagctacacaattttatttcattgatagaaattcattattatgagacatattcattattatgagacagaatcttgctctgtcacttaggctagaatacagaggcatgatcacactcactgcagcctcaaccacccaggctcaagtgatcctcttacttcagtctcccaagtagctgggatcacaggtgcatgccaccacgtccagatagcttaaaaaaatttcttttgtagagacaaagtttccctgtgtttcccaggctggtcttgaaacctgggctcaagcaatcctcccacctcagccttccaaagtgttgggattacaggtgtgagccacggtgtccggccagaatatcccattactcacagaatgccaggtactcgccagggctgtagtttgaaaatctaccatatctcttccaccactcctccaactgtcttagaaacatcatttatgtgacacacaccttcactctatatgcacaatcttgtaccacaatttgtctttttaatggatatggccatctggtctgtaaacctttggaggattgggaccatgttttatattccttgtaatctacatatacttattcactcaatactacttttttttttttttaaagacagagtctcagtctgtcgcccaggctggagtgcaatggcacaatctcggctcactgaaatctccacctcccaggttcaagcaattctccagcctctgcctcccgagtagctgggattacaggcatgtgccatcacgcctggctaatttttgtatttttagtaaagacagggtttcaccatgttggtcaggctggtcttgaactcttgacttcaggtgatccacccgcctcagcctcccaaaatgttgggattacaggcatgagccaccacacgtgacctcactcaatacttactgaacacctactatagatattagacactgagctagataaacacaatatgcattcagtaaatgctgttgaggacaaccatttcaacaaagtcctaggacctaaatcttccaaagcaatttagggaagctctgggaactcaggaagtctgatccctactcctgggctaagcagtttatattcattatctcatccagtcctcagagataggtaacttcctcagaatcaaattactagtagggtggaggtgatgtcaaaccccaaagcatatgctcttaactgctatactcttctgtctcccagaaaggcacaaacggctaaactaacaacgagattaagtggtacatacgtcacatttcagccaacctttacttcctctagagcattctccctcccaactgtatctcctttgtgctcctaaagtgctttctgctcacccacctctatcaaaacatgtatctatcataccaagatcagcaacaggctgtttacctgtttgtctccctgatttcactaggagctccatagggcacataacagagaaacagttaagtaaggccaggcacagtggctcacacctataaccccagcactctgggaggccgaggtggcaggatcacttgaggccagaagtttgagaccagcctggccaagatggcaagaccccatctctacaaaaaattttaaaattggccaggcctggtggtatgtacctgtagtcccagctacttggaaggctaggataggaggatcgcctgagcccaggaggtcgaggctgcagtgagccatgagtgcaccactgccctctagcctgggtgacagagtgagaccctgtctcaaaaaaaaaaaaagggttctgtaaatgaacaatttacaaatatatggtaaactgtttgcataacaagagctaaggaaggggaactctgtccagcaccttttgcatgtcagacattttacctacagaatctcactcaattctcacaacaaatatgcaaaaattaattattcttattttatagatgaggaaactttggctctgatcgacctgaccatgtaacttgcccaaagtgacacagctggaaagcagcagagcaagtctgtttatttatttatttattggagacaaggtctcaactttgttgcccaggctggagtgcagtggtgcaatcgtggctcgctgcagcctcaacctcctgggctcaagtgattctcctcccttagcttcctgagtacctgggactacaagtgcacatcaccatgcctggctaattttttaaatttttttgtagagacagggtctcactatgttgcccaggctggtcttgaactcctggcctcaagagatgttcctgccttggtctcccaaagtgctgggattacaggtgtgaaccacagtgcctgtgcctagtgagcaagtttgtttagttccaaagtggagctcttttcattacaccaagtgacagtcttgggcaaatatgaagtggtgatgaaaagggaaaacctcgagtcctcagaggcataaacggacaaagatgactcctttctgaagtgaggagttatgtccaagggagataggacttcaatactatttgagcactggaaatgtgggatttgatgggttgggagctgaccttcaggcatgacatacagctgtaagaaggcaaaagaggtacaagtgtggtgactcctaattgcctgaaccattgcctgagcttttttcctgattgtgcttcttggctccaatcaacgcctcacattgctgacaaagatgactttttaaaatacagagctcatcactgcacccttgcagctctcaaaagcttacaaagttcctgactgcctagaaaataaattgccatgctctgctaaaatctcccttgcagttttatctaaacctgaacactcactcaatcatcaaacaccctccattcagaggtccttgcccccattagctcccactagccccacgggcctagaaagctgtctgtctctcagtcctgcctgataatcaaagttaacttcaaagacccctcttccaaagttcctctcctcttttccctctggaaatccatagagcttagcaaagctactgtggtggttattatcagaatagtcagtgtctctgataggaagccagtgacatactactgggaagtacagcacactggtttagagcctcctattcaaaccgtggtcctcagaccagcagcagcagtgtttgagcgcttgttgttaacatcaagttcctccccagacctcatgaatcaggatccgctttttttttttttttgagacagggtctcactttgttgcacaggttggagtgcaatggtgcaatctcggcttactgcaacctctgccttccaggctcaaacgaccctcctgcctcagcctccctcagcctgggaccacaggcgtgcaccaccacgcccggctaacttttgtatttttttgtagggacgggttttcgccctattgcccatactggtatcgaattcctgagctcaggcgatccgcccgccacggcctcccaaggcgctgggattacaggtgtgagccacctcgcgcagcccagaatccgaattttaacaagacacctatgctattcgtatgcacattaagtttgagaagcactggtgtcccatatccattcagaggtcaaaaaaaaaaaaaaccaagctctgctacttaatagccatatgaccttgggcaagctgctgttaatctgttaggctcggtttcctcgttgtgaataatacatccctaaaagtgttttaaggccgaaatgctatcaataatgcccacagtgtgagtagtgcatggcatggagtcatggctcatttgcgcacacagcacaacacgaactgaggagagtagtttcgggtccttcacagactcagttcctgcttcactgcacctcagtttcttcaagtgccaaatgacactctggctctgcttgattctaaagagctaatggggcgcggactccccggaaaggcgagatggggccagctaggcaaaaaggcacggaaaagcagagcacctcaggggggcctacggccgggccagtctgcagccctacgaccccttctcctcccagccgatcccggccgcgcagcactcaccagccgtcgcgatcggcctccgccggattaggttatcaatcaggccggagcagtagcccaagaagccgatgtagaggagccgcgggtcggtcagcttgggcgggggcaggctccgggcctcatccggcagaaaccgtaagggttctgggttccgccgtgcgatcatggtgacgccgtttccacttgaggcctggtctcagaccacgaactacaaggaaaaccacgacgaccactaccccggcctaagcggtcagctttctcctcctcctctgcgcgccggactcacgggcacggcgcagcgcggtgcagcgcccaaacgcttcccggtacgtgttgctgcgggaacccggcacgcgaagttccgggctactaagtttcactttgctcgtccgcccgcgctaattctctggtgggagtgggattcacgggcctggtaacgcggggtcgaggagtaccccaaacgagccaaactgggcgaagactaggagatactgattttcttttctcccaacttccccaaccagaattgcctctccctcccctgccccttctggaaagatttatcttttcatccaatacccacaaatgggcatgatgcgtagttttgataaacgtaattaattgaaattccataaaagcta

SEQ ID NO: 558 - DNA, 64505 bp, Homo sapiens; identical to SEQ ID NO: 557

SEQ ID NO: 559 - DNA, 64505 bp, Homo sapiens; identical to SEQ ID NO: 557

SEQ ID NO: 560 - DNA, 2653 bp, Homo sapiens
acttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatga

SEQ ID NO: 561 - DNA, 2452 bp, Homo sapiens
taatgatagaaactaaatgttacaatttattccatcttcaggattacagacattacagggcaggatgagtaaacaaggcaaatgaagcgagcaccttcagcttcccccctaccccgacatttaaccagatgcagcattttgacatttttaggatatgcaggttgacaattcactgacttgggttgagagctggcaatagcagatctttgcaatttaggttcttcctccacagctattccaagtatcttaattcctgaactgcacactgagagctctgaaatggtgttcactgcaacattcttgcagctttcacatcttaatctgacacctcttgtgaaggcagggaactgtgttaaaagctgtcttcctctttgctaatccaggccaccatcaatcttaaccattagttactatataaaaataaaagtgtgctcaaaagcactcactgaaactgttgtgcccagatcccttttcagagcattagttccctgagaggaaaaaaagaggtcctaaccaattgctttcataaatagtgaccccagtacagtgtatatgtcttttgcagcagaaatcaagaggtcaggcagctctgctcatcctgactagtttatcatcgtttgcatacaaggtatatttatgtaaagctgattccacgccaagtattgcaaccataatctcaaaaaaattgttcaattttagcacacagttcctgcaagataccacagcaggtgagaaatcatctcaaagagttcatcttttacaactgagaggaaaacatcgaaggaggaaataaaactcctctctcctaagttcctcatcaaatctgatggctatgttcacagagttagttgacaaaaatccagagtcctcaatttctggacttgcgaaatccttcaaggtgactgtcaaggtcaagaagaattttcaggcttttctttgccatggcccatgaactccagtccttcaataggaatctctttctcctttattgctttctggtaggaggagaaaacacattataaagacctacatgaagcttaagttgcaagctttgtaaataaaatatgacagtacaaaagtaaaatcaagctgattataaagacttataaccatgattcaaaccacatactttttaaaaaacaagtaccggtcaggtgtggtggctcacgcctataatcgcagcattttgggagaccaaggcaggtggatcacttgaggccagaagttagagaccaacctggccaacatggcgagaccctgtttatactaaaaatacaaaaattagctgggcatggtggcgcatgcctgtaagcccagctactcgggtggctgaggcatgagaatagcttgaacctgggaggcggaggttgcagtgagctgagattgtgccattgcactccaggctgggagacagagtgagactctgcctcaaaaataaataaaaaccagaagtaccataatgaataaatcaagtgtaagacctgagggagactggaaaaggagttgtgagggaaccgttaaaattaagtgaaatttgaaaaataatcatcactttgtgttagtgaaagacttaggttcaaatctgggttccaggacttactggctatgtgactaactgtaaatgggatgaagacagcaactacctcggggaattgctgtgaggatgtgttgggttaacttattggaagtgctttgcccggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgat

SEQ ID NO: 562 - DNA, 17316 bp, Homo sapiens
ggcgttacgcgcgggcgcactgcgggggccaaggaaggaagaaatgtggtcgcggttggtgtggctgggccttcgggcccctctgggcgggcgccagggcttcacctccaaggcggatcctcaggtaaaggccagggccatctaggcgggtggcggagcaagccgggaggcacttcggagcgccggtgacccacactccccgcctcatccctcctccagggcagtggccggatcacggctgcggtgatcgagcacctggagcgtctagcgcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgtgccacttggcctggctaattttttgtatttttgatagagacgggattttgccatgttccccaggcttgtctggactcctgagcaaaggtgatccacccatctcagcctcctaaagtactgggattacaggcatgagccacagcacctggccgtgtttgattctttcaaatgtcttctctactttgcaattttctttttcctttgggacggggtctcactatgttgcccaggctggtcgcaaacttctagactcaagagatcctcctgcctcagcctcccaaatagctgggactataggtgtgcaccaccacacctggctaatacttaaaatttttgtagaaacggggtcttgccatgttgccccatatggtctcaaactcctggtctcaagcaatcctcctgcctcagcctcccacttcctcaagaaagtttttttttttttttgaggtggagtcctgccccatcacccaggctggagtgcagtggcatgatcttggctcactgcaacctccaccctccaggttcaagtgatttttgtgcctcagcctccggagtagctgggattacaggcacccgccaccacactcagctagtttttgcatttttagtagagacagggtttcaccatgttgaccaggctggtctcgaacccctggcctcaagtgatccgcccatcttcgcctcccaaagtgctgggattacaggtatgagtcactgcactggccaaaaaagtccattcctttttttttttttttttttttgagacggagtttcactcttccacccaggctggagtacagtggtgcaatctcagctcactgcaacctccaccttccggtttcaagtgattctcttgcctcagcctcccgagtagctgggactacaggcgcccgccaccacgcccagctaatttttgtatttttaatagagacggggtttcaccatgttggccaggctggtctcgaactcatgacctcacagtccacccgcctcggcctcccaaagtgctgggattataggcgtgagccacaagtcttcattcttttatacttaggttctttttttttttttttaattgagacaagagtctcgctctgtcgctgaggctggagtgcagtggcgtgatcttggctcactgcaagttccgcctcctgggttcatgccattctcctgcctcagcctcccaagtagctgggtctacaagtgcccactaccacgcctggctaattttttgtatttttagtagagatgaggtttcaccgtagccaagatggtctcgatctcctgacctcgtgatctgcccacctcagcctcccaaaggtgctgattacaggcgtgagccactgtgcctggctatacttaggttctctacctgtggctctcgtgatatccaaaagggctgatttatacatgcgtttatacatctatttaagggatgtgttgagtctctgcccctctcctgctcacccaccttccacagcatgtctgtttttccttatcatgttctcagtggttggcactgagtattcagtaaatgtgttttgttttgttttgttttgtttttttgagatggagtctcactctgttgcccacgctggaggcagtggcgtgatctcggctcactgcaacctctgcctcctgggtttgagattctcttgcctcagcttcccgagcacccgggattacaggcatgcaccaccatgcctggttaatttttgtatttttagtagagaggggtttcaccatgttggcaaggctcgtcttgaactcctgacctcaggtgatctgcctgcctcagcctcccaaagtgctgggaatacagccttgagctgccgtgcccggccacagtaaatgtttaatgaatttttttttttttagagacagagttttgctcacgttgcccaggctggagtgcaatggcgcgatctcagctcaccacaacctctgcctcccaggttcaagcgattctcctgcctcagcctcccaagtagctgggattacaggtgcacgccaccacgcccagctaattttgtatttttagtagagacagggtttctccatgttggtcaggctggtctcaaactcccgacctcaggtgatctgcccaccttggcctcccaaagtgctgggattacaggcatgagccaccatgcccggtcccagtgttctttattaatatctctaggaaaggagggactagaagcacagagtcatcagaatttccccaagttatctagagggtaaatacaaagaaatataaccatcattaataagggaaaaggtcgtgaaaaaagatgaggaatttggatccagtagctagcatctcaacctcgtattcagtgatctgtactgtttttcataaatttggaaaccagtttgggttaataattcccattaatcattttaatgtgacatctgtaggactttaatgctttgaacacacagaatgtaaagtgaagacaagtattaaaccttttattttttatttttttgtagtttttataacttcatttgatgtatttgatgatcagcagttagttcccatccacactgactgtagatttgtgaaagtggtaacaagtatataaccaaagtatagagcttatttggtgaatttctaacctcattatgttttctggaccatccactgcacatggacacagtatggacattccttactactttggcccagacagctttgttgagcctggtatcaatacacatatctggagttttctatctccttcattgcaaatttccggtctctttaagagcctgaggggcacacttcttgaagcccactccatggatacacttgtgaatattaatggtgtactcttgggtcaccacctagttgatggcataatggccattcttctcaccatccttctttgcaggaggccaagttgcttaaatgttttaggtagtaggcatcttagctataaaagccctgacttggccgggcataatggctcactcctgtaatcccagcattttgggaggccgaggcaggcagatcactttaggtcaggagttcgagaccagcctggccaacatggcgaaaccctgtttctacttaaaaaatacaaaaatttgccgggcatggtggtgcatgcctgtaatcccggctactctgaaggctgaggcaggagaattgcttgaaatcaggaggcggaggttgcagtgagctgagatcacgccactgcactccagcctgggcgacagagcaagactccatctcaaaaaaaaaaaaaaaaaggtagactgggcgcggtggctcacacctgtaattccagcactttgggaagctgaggtgggtggatcatggggtcaggagttgaagaccagcctggccaagatggtgaaaccccatctgtactaaaaatacaaaattagccaggcaaggtggcaggcgcctgtaatcccagctactcgggaggctgaagcaggagaatcggttgaaccaggacggcagaggttgcagtcagccaagatggagccactgcactccagcctgggcgacagagtgagactccgtcttaaaaaatacaaaacaaggctgggcgtggtgtttcacgcctgtaatcccagcactttgggaggctgaggcaggtggatcacctgaggccaggagttcgagaccagcctgaccaatatggtgaaactccttctctactaaaaatacaaaaattagccgggcatggtggcgcactcctgtagtcctagctgttcgggaggctgagacagaagaattgcttgaacctggggagcagaggttgcagtgagccgagatcacgtcactgcactccagcctgggcaacagagcaagactccatctcaaaaaaacaaacaaacaaacaaaaaacgccttgactggctaatagaaacccctttgcacactaataacatgtcatttggtttgaggtaaaaacagtatgcttacatgccaggggctaataaattatataaattcttttttttttttttttttttgagctggagtctcactctgtcgtccaggctggatgcagtggcacgatctcagctcactgcaacctctgcctcccaggttgaagcaattctcctgtctcagcctcccaagtagctgggactacaggtgcccggcaccatgcccagctaatttttgtatttttagtagagacggggtttcaccatattggtcaggctgctcttgaactcctgacctcaggtcatccgcctgccctggcctcccaaagtgctgggattgcaggcatgagccaccgtgcccggcctaaattatttcaattttcacatgcagtcctggaaggtcaatacaagttatctattttatatagatggaaaaaactgaggttcagaaaggttatataatgtgcccaaagtttcacaggtaataagcagagaatttggaactcagagcttctgctgccaaatactgttctaagatatgccagctaaagtcgattcctaggaactttactctctttcatctgaaatccagagaatgagttgacagcaactctgcagccaaatacttaaatgtccctcatagtcttatgaaccaaaaacttcaaactcttaggctcaagccatcctcctgtctcagcctctcaagtagctgggactacaggtgtgtacccctatggccagctaatttttttctttgttactttttttttggtggagacaggatcttgctgtgttgcccaagctggtctcgaactcctgggctcaagtgatcctcctgcctcggcctcccaaagtgctggcattataggcatgagccatcatgcctggcctgaatccagaactttttttttctcattctgttgcccaggctgcagtgcagtggcgcaatcttggctcactgcagactccacctcctgaactcaagtgatcctcccacctcagcctcccgagtagctgagactataggcacacgccaccacccctggctaacttttgtattttttaggggagatggggtctcaccatgtttcccaggctggtcttgaactcctgggctcaaacaattcacccccttcggcctcctgaagtgttgggaatatagatgtgagccaccttgcctggctcagaacttttaaccaagttaattagcccccattccagtctgcatcaaactagaaataaagtaggaggaagggagaaggcttttagatggaagtagaggggtccacaagaagctattccttccagccagatagcagaaaagaagctcaaagaaagaaaagcagtgggagaacggtcccatcagtgagtccaagggctgacagaatcacaaatggagccactttgtcctccctgttgccacagcactttccaatgccaccgtagcagcatttctcacagttacttaagttattgttcctgagttttaaccagcagggacttctagtttacaactgaagtctttctcaaccagggttcctcagccaaaccagaacacagaaagattcaagtgactttttttcagttctcccaaggacagtatatgacaaatgttagcttaaacacacaggagataagttaacttatcatcagaatgggtgtcttggggtatgtaggctaacttatcttacagaaccctgattgggaaagacaggtggtgaggtagaagtttagtcaatcattaattgatctgaaaagctcatctggtcctgttcagtgttttatataattctgaggtccaagaaagtgaagcaactcaccaagtgagaggtatgcttgctgtaccactgtcacagagaccgtgggttcaggagcctgtaattaataaagctaggtatggtggtgcacacctgtaatcccagctgcttgggaagctaaggtgggaggatcacttgagcccagaagtttgagaccagcctaggcaacacagcaagaccctgtctcaaaaaaaaaaagtaaaacaacaacaacaacaacaacaacaaaaaaccaaccccagaaaatgtgtctattttaggaacaactccatcataaccaataactaaatagaaatgtatgtatgtatgtacatacatacataaatagaaaggtatgtaaaggggtgaattttgttttcctggaaatttcacttacgcaggaaacttaattatgaaacttgattacttgatgagtaaatagattagttgctattagatctactcttggggaagcagtagcatttaaccgcctattggcggtagtagagagtcttcccaaaccttcagatgctaggcaggttgtgcctcatcaggagtgcacagactttgaatgagtggtagggactgagatgtactggggtgcactaaggctttctgaaaggagcaggtgctactcagagccctcttactgccgtgaatgctggctcagcattatcagatcttgtttttttaacatttcatttaatcttcccagaaatcctatgaagcattcaacaaacaaggaaactgaaatatagagaggataagtaatgtgtagcaatgggatctgaattcagctgtgacttgagagcctaagctcttagcctttttgagacggagtcttgctctgtcgcccaggctggagtgcagtagcatgatatccgctcactgcaagctccacctccagggttcacgccgttcccctcctcagcctctcgctacaggcccccgccaccacgcctggctaatttttttttttttgtatttttagtagagacggggtttcaccctgtcagccaggatggtcttgatctcctgacctcgtgatctgcccgcctcagtctcccaaagtgctgggatcacaggcatgaggcaccgcgcccggcctcttagccattttttaatactgtccaacagaaactataaactccagaaagtccaagggttacctttgaatagtataattatgatttttattttacttttgttctcccaagttttcttaaatgaatacagtccttgtgttattcaaaaaaaaaaaaaaatctagtacaactctcttttgtgtgtgtgtgtgtgagacactgtctcactctgtcacccaggttggagtgcagtggtgtgatctccgctcactacaaactctgcttcctacattcaagtgattcttgtgcctcagcctcccaggtagctgggattacaggtatgtaccaccatgcccggctaacttttatatttttagtagagacagggtttcaccatattggatggtctcgaactcctgacctcaggtgatccacctgctttggcctcccaaagtgctgggattacaggcttgagccactgtgcctggcctttttttttttcttcttgctctgtcgcccaggcttgagtgcagtggtgccatctcagctcactgcaacctccgcctcctgggttcaggcgattctcccgcctcagcctcccgagtagttgggatcacacgtgcgtgccaccacgcttggctagtttttgtatttttagtagagatgtggtttccccacgttgcccaggctggtcttgaactcctgaattcaggtgatccacccgccttagccttccaaagtgctgggattacatgcaagagccaccacacctggcctttctcccccacaccccgccgcccccctccaagaaatttaatgtctgaaaagatcatacttgttcaaggccacacagttaagaatgtgccaggtcctgtaacagacttcaactttctaatattcataccatgagtaaatatttgttgtgtctagctttgggctgggtgccacaaaaaaagaactagtcctttcctaaaataatcttattgtgacaacttagttctctttttttttgaggcagagtatcgctctgtcgcccaggctggagtgcagtggcgcgatctcggctcactgcaagctccgcctcccgggttcacgccattctcctgcctcagcctcccaagtagctgggtctacaggcgcccaccaccacgcccggctaatttttttgtatttttagtagagatggggtttcaccgtgttagccaggatggtctcgatctcctgacctcgtgatccgcccacctcggcctcccaaagtgctgggattacaggcgtgagccaccgcgcccggctgacaacttagttcttatgtgcagccttagcccagatgtacctgtcacatctttgtccctctctgacatgactcaaacgccattagggtctgccctcagtctgtgcccactcaaagcaggaggagcgtggctactaccgaataccatatcagtgatttaacagactgcttatttttttaatctaagtatctggaagcaggcttacacacttttacaccttgaaacaatagtgaagcctcatgcaaatgttcaagctcttgtgtgttttttaccggtttgccatctgaaggctttagtaaagtcactaggtcccacagaacactgggagattcttgagctgttggtggcacatcttgctcaagggcaggcacatccaccaaagtggctgtggtggaaaaagcattcattttaggtgtatcagattgggctgagatcccagttgttacttagcagccaacatccttaagttactcttgtggcaagtttgcttccccatctctgcttagctttccagcttcatcttccaccccggcagaccacaccccagcctgctaaactccctgtccttctctgaatctctgagctctcggctctattgctttgggattcatgctgctatacgtgccaggaagtccatttctcataccttcatcccccaatccagctatttcttgcccatccttgaacagtgacatcagctattctgaggatgtgctactcacgcaggctggactaggtaccctttctatcctttggcaggctgtactaacctctgttagatttaaaatattgtttttgtaattgcttttacctgtccccaccaaaagacagttgcccatataatcatcaaaaactatttgttaaatcaatccagagaagtaattagcacttacttctcagggttgttcggtcaatctataaactgtaggctgttatttggtctactgttgatcccagcttctctatctttgaacagtgcccattaactcaagaatatactgcttccttgttctctccttcttgcccctctccatcatcccctaaaagcccccttctctgagagggtaaccttgagcttctgggttttgtagatgtctatacctgagatccgacaatgtggtagaaggcaactgtgctgatgaattactacaaaactcccatcgcgtcgtggaggagtactttgtggcccccccaggtacgtgctgcccagaatggtttaacagatagtctcacagtaaccttaggaatgaagcaggaagcatgaggaccaaagatgctatgtgaaggcactttgaaaaggatgaagtgcatacagatggtggcattaaggtggcagtagggtccagggtcatactcacctctagggggcagttagtaacaggaacaagcaaaacaggattgggggcatgcgggaggtttaaagtaggtggaaatctggagctcaagatctccctaaaggggcagctggcattcagtgtttctcaaagccacagttaagaccctgccagatcctgtaatcgactccaactttctagtattcataccatgaataaatatttgttaggtctagctttgggctgggtaccacaaaaaaaccagtcctttcctaaaagaatcctttttttttttttttttttttgagacggagtttcgctcttgttgcccaggctggagtgcaatggtgcaatctcggctcaccgcaacctccacctcccgggttcaagcgattctcctgctcaggctccccagtagctgggattacaggcatgcaccagcacgcctggctaattttttgtatttttagtagagacagggtttcactgtgttagccaggatggtctcgatctcccgacctcaggtgatccacccacctcggcctcccaaaacgaatcttattgtgacaacttagttatcatgtgtggccttagcccagatgtttctgtcacatctttgcctatgacatgattcaaacgccattagggtctgccctcagtctgtgcccattcaaagcaggaggagcatggctgctaccctatcagtgttgccaggcaggaatgtaaacccatttctccagagaacctggatacctgacattttgtgtgatatttcttaaatttttttttttttttttgagatggagtctcgctcggtcacccaggctggagtgcaatcttgactcactgcaacctctgcctcccgggttcaagcaattctctgcctcagcctgccgagtagctgggattacaggtgcctgccaccatgcctggctaatatttttgtatttttagtagaggcaggatttcaccatcttggccaggctagtcttgaactggtgatctacccgcctcagcctcccaaagtgctgggattacaggggtgagccactgcaccccgccgatatttcttaaattttaagtgctagcaaccaattcaaaatttaaaaaacaaaataccatccaagccaaataaaacacatctgcaagccaggtgcagtctgtgagccatcagtttacaacagctggtatagagatttgcatcatctacctactgtaaatattttaaatagaagctttaaaattactctgggctgacagtaaaatccagaaccttggataggttgactgtttttatctcctctgcaggtaggtgaatacttggagctgttgtactacccctctgggcatctgggagtgggactagccaaaagcaatcaggtagcctgctaagtgccaacttccagttcaggatatcctgagggagaatcattctgagcagactccacagaagacattggccctggtcagcttaaggtgccagttaaaggcaggctctggttgatgcaaggatgggaaagaaagctagaaattttgtgagctaaactttttgtttgttttgagacggagtcttgctctgttgcccaagctggagtgcagtggcgcgatctcggctcactgcaagctccaccttccacgttcatgccattctcctgccttagcctcccaagtagctaggactacaggcgcccaccacaacgcctggctaattttttgtatttttagtagagacggggtttcaccgtgttagccaggatggtctctctctcctgacctcgtgatcgtccgcttcggcctcccagagtgctgggattacaggtgtgagccaccgcacccggccgtgagctaaactcttaatcatgcctccaatccactaaaccacctgttaactgtggagagaaaggagactctccatctcagagcctgatagttgtggctccagcagaaatatcttttgatcagacatgctatctcccacacagaaccttacttcagactttgctttttgggaccacctgagttcatggtcagtgtttccttctagtcctatctgcatattagtggctaatcaacctgtatactccttactgaaaaaggtgaatttggctacacttagaactgattctttcagatactcccagttaggaaaacaggacagtagctacattacttccatattttccatgagaaagtagtgatcagttagctcagtagagccagctgggcggcaggctcagctataacattctctgttgtggccgggcgcggtggctcatgcctgtaatcctagcactttgggaggccgaggagggcggatcacgaggtcaggagatcgagaccatcctggctaacacggtgaaaccccgtctctattaaaaatacaaaaaattagccgggagaggtggcgggcgcctgtagtcccagctactctggaggccgaggcaggagaatggcgtgaaccccagggggcggagcctgcagtgagctgagattgcgccactgcactccagcctgggcaacagcgagactctgtctcaaaacaaaaacaaacaaacaaacaaaaattctcttttgttattttcaaacaggtaatatctctttgccaaagctggatgaacaagagccattcccacacagctgagtagctcattctggaaagggggtactctgtgaacatgtggaagcataatgacagtatttttttactgtgaatactaatgttcctgcttttttcagtcccctgaaaaaatggatgctcaagcatttcttaataacagattcttctgaagacagaattgggaaagatctggccccaacaaggcagtgagttcctgatgctaactgaggtgaaagaaaagcaaaagtcagcttccaaggaattcacttaacaggcctgttcagtatggaagacattatttatctgcctttaactccccccaaaggaccataccaactgcatgaaagtgaacttttctatctacgtaactggtagacggagcatcttgatcactatgtgacaaccttggctgtcatttttagttgccatttgcattgatttgagcagccctatctttaccgaacatacctgaatttgttcctgggctcccactttcttcccagaagagggctaacttcctactaaggtctgaagagtgttgaaagtagactagagcttgggaactcctaacctagaactatctgccatcccacaaagtgattatatgccaaagggatactagtcatacctagtgtttctctttctgaaaagagaacttatcctaaaattagccctgggcctgggacaaaggagccctctccgcccccaaaatgattattaaattgagatgagtccaggataaaactcagataccaaggataaatgaaacttatttagggataaaagtgggctgggcgcagtggctcactcctgtaatcccagcactttgggaggctgagacgggcggatcacaaggtcaggagatcaagaccatcctggctaatgcggtgaaacctcatctctactaaaaatacaaaaaattagctgggtgtgatgacaggtgcctgtagtcccagctactcgggaggctgaggcaggagaatggcgtgaacccgggagacggagcttgcagtaagccgagatcgcaccactgcactccagcctgggcgacagagcaagtctcaaaaaaaaaaaaaaagtgatagaatcagagagtttttcctctaaccaaactgccaaagttggttttggctaagaatttcccaataatatttatgctgctgctcatttttttagttttctgagacaggggtctccctctgtcacccaggctggagtgcagtggtgacagatcactgcagcctccaactcctgggctcaagtgatcctcccacctcagcctcctaagtaactgggactacatatgtgcatcaccacgtccagttaatttttttttaagtagaggtgggggttttgctatgttgcctatctggtcgtgaactcctggcctcaagggatcctctggcatgccttggcctcccaaagggctaggatcacaggcaaaagccaccgtgtgtttatttttcccattcccttcctttatctgcaatgcttttttctttaaggcagcctaatttacaagcttggccttgaattaaaagagaacccagaacccgctcttggagtttacgttctcaaaccaacatcagagcaactgtctatccccatataaataaagttatctacccctgctcctaactgggtacaagttatgactacaactcagtgattttttaaattagtgtgcctatttggtgaaatctgtgaacttaatcaaggacaaccacacatgtcaattactaaacatttaaaatatatttctaaacagaatgggccgactcagtcacagtaactgttgatctccatagtagagcaacccacaaagacagaactgatttttttcccataatcaggggtgaaaaatatacaacttgtttctgaaccaaaaccacaatttctgcagtttaaaatgtttcactgctaatatggccctggtagaaattatgtagttttttttcttctttaaaaaaaaaaaattaaaaaaatttcctaagacactaaatcctcaatctggaatgtagattctgagcacaaagcagctcagttaacctaaaaaataaagaaaaaattcccatcacctgtctcagtagggcctgaaaggagagaagtagtgtggggaacccctgctttggtatggagagtcacggccccttgacccagaccgagaccgtgagtagccatagctggtgcttctctcaggataaactcggatgtaggaagtttcaccctgaaatgcaaacaaaaacaaaaagagtaaaggggaaaaaaatcagagccagaagaataagcaaaccaacatctaacaataatagttaagtattgagcacttactgtgtactctgtgcctggcatgaggctatctcattaaaccttcataacattatgaggtaggtactcttactatcccatttcaagaatgaagaaaattaagacttaagttatatcatttgcccaaggtaacacaataaatgccaatttgacatgttgatactcaattaactatgataaacaatatatctgaattactgccattgacccccctcaaagctaagaactggaaaggatctcaggggtcatatagtttaatcccctgccacctcatgtatgcatctttggatgggcatctatggaaggagctagcctgtatttaataccttccagatgtgaggacctgagctagatgctttagacgttatcctcttgctctagattcctggcaagtcttgtgatggtgctattatgtgaccattttgcccatgaaggaatcgaggtcccaagagtagttcaggtaaggaattaataagcagcagaggagtcatgtccaggctggcttgtccccaggccctctgccttcagccaccattctcagaagatccaaagatgccaaggggaaagaagccggatgctttttcaccttaggtgaaagtcagtaattggagttaccctttctgaggccctgctttgcagtataactgaggatcaggtgctgttctgtttctgcttcaaattcaagtcctagaggacagtctgaacaaaagcatcattaaaccagggaaggaccaacctctaagccaaaaactaggcaattatatgaatcctcagaaaaagaaatgagcccagagacctgtgtccccaaacatccgtaaatctcatagtaaggcaggacaggataaccagaaaaaaacaatgtccaactggtctggtttctggtctcaatggtaccaaagggatagtcaccacctcaatcaaactgagatccaaaacagcagctgctttcctacaaggaaagacatcaagaactactgagtctgaagggtgacataatcaaccacaagaaaatgttacggtttagcctggcacagtggtgcatgcctgcagtcccaactactggagaggctgaggtgggaggactgcttgggcccaggagttcaaggtcagcctcggcaatataatgagactgtctctaaaatcaaaaattagagaaatataaaaattataaaattaaaaaagaaaatgtcatgatagctcaggtttcagagaggatgctgcactactctgggaaaaaagtgaagtgacagctcagccctgacagcaggacctagaagggctgagatgaagaggctgacctgtagagctcagcctggacccacaggaggggtagttgagttcacagagggatactgccatttaagctggttgtgaatggggtggtatgaagaccgactgcactagtattctctccaggttacaaataccatgaccaaactgtgtaatgtgatactaatatgcagaataaagcatattaaaaaacaaacgta

SEQ ID NO: 563 - DNA, 17316 bp, Homo sapiens; identical to SEQ ID NO: 562

SEQ ID NO: 564 - DNA, 85168 bp, Homo sapiens
aaaagataaaaaatattttcatttaataaatacttttgcatgtcacacatttaacgggaaacaaaatatcatgttaacagcctagtaatacaattttattgtcttagatttttttcgtcagcatgtattctttctgttttgttttgcatttgagatggagtcactctgttgctcaggctggagtgcagtggcacgatcttggctcactgaaacctctgcctcccgggttcaagtgattctcccacctcagcctcccgagtagctgagactacaggcatgcaccaccacacccagctaatttttgtatttttagtagagacaggatttcaccatattggccaggctggtcttgaactcctgacctcaagtgatccacctgcactggcctcccaaagtgctgagaatacaggcatgagccactgcagccagacagcacatattcttgttatgcttttaaaactagttattgatttaaattttactcattagtagattctagtgcagaagctatagagcagcagtccccagcctttttggcaccaggcagcagttttgtgaaagataatttttccacagatgggggtttgggggatggtttcaggatggtgattcaagcgtattacatctattgtgcactttattcctattatgactacattgtaatacataatgaaataattacacaactcatcataatggagaatcaatgggagtcctgagcttgtttttctgtaactagatggtcccatcgtgaagagataggagacaatgacatatcatcaggcattagagtctcataaggagcatgtgacctagatcccttgaacgagcagttcacagtaggattttcactcctgtgagaatctaatggctttgctgatctgacaggaggcagagctcaggtgataatgtgagcaacagggagtggctggaaatacagatgaagcttcactcgcttgcctgccactcacctcctgctgtgcagcctgcttcctaacaggtcatggaactgtgtgtggcctgggagttggggacccctgctatagaggattcagatttaaattcagaagttagaatgaaaaagaattatattctttatctaaatgatttcacagttaactaagagaaagtcagtatatgctgaaaagcttatcagtgttaataagaatgaaaaatatgtacaatatgcaattactattaaatataatttgcccatagttgcacaccgaattcattatcatggcagttaagtatcagagcttctggtttctcactcttcgttcatgtattcagcaaccatgtgctaaggtactaggacaagcactggaattacaagataaagatgatacggtccgcccctcaacaactgtatgctataatctgaaaaaacaaacaggcaattcccatacagagtcatacatacaatgacaagcataagacagcacttattggaagacatagaagggatactagcccaggtttgtgtcaatattgtaggctttttggtagaggcaattcataggttgatatctgaaggggaaggaaaacacatgtaggatagagggaagaagtaaatgcaaacagctggaggtgaagacgatcactgtggagctccatgtagtctagtttggctggatgctagaacaaaggtgtagagtatggtaagtggcgaaagataaggctgaataacttgacaagaaccacactgatgtgagagttttgattccatgctaaggaattttcaacttttcccaggggcaaaagtaaaccaatgacaaagtcaatgactagagatttaaaatgtcactggtcaagtgactgcttgtgacctgtaattgcttaactaattattatcacacgagtgtggggtctcttagccttaaatcactaccttaaccttgagaagttgataatgcctttgttttgtgagaacagtttcagtgtgcaggctgatagtctataggggtggcagaagaaaagtgtagggccagaaaaaaagggatacacagatttcttgcgatttttttaaagctatgaaacatgatgaattaacaaagcataagtacacccttcactatgaatgtttatgttttcacatctttcactagatgtgtgtaagaaaaaatatttaatgtagcatttattaaccaagcaattgagagggaataccgttcactacttagagtttatttcagaaatcaatgatttgaatttaattcataaattttggcaacataccttcatctagctctcaaacacctgcagcatctgaaataaatcaaatattacttataatgtttcagtcaaacaagagacattatcatgtaaacccactgtaagtcaaggagcatctgtactgtagattgatcatccctaatctaaaaatctgaaatccaaaatgctctacaatctgaaactttttgagcacggacatgacaccacaactgcaacgttccacacctgacctcatgtgacaggctctggggaaaacagtaaaaactttcttacctgcaaaaaattactgtaaaacattgtagagaattaccttcaggctatgtgcataaggtatatatgaaacacaaatgaatttcatgtttagactcaggtaccatccgcaagatatttcattaggtatatacaaatattccaaaatctgaaaaaaatctacttttggtcccaagcattttggacaagggatatttaacccatcctactggaaaaataaaattccttttcagtatgacagaaattaagagatcagcttaccaaacttgaatgctgcaggattttctcaagccgctcaatttggtcatcctgttttttaataatttttctcatcatcacatgttctacttcaagcctaaaatgtgcattttaaaataattactctcacacgtaattttttttaaatcatgtaaattctaaacaaacttctgaaggtataattacacaaattcttagcaatcacaaaagtagacgattgggctactgtgtcattttctacctgtgttttggtgataatatgcaaaatttaggaataatgtagaaaaatgatgtatttcgatatagcttacaaatgaaacttttttggcttcacaaagacatactaattatcataactgatacaattttcatactacagtgctcttttgctttataaatactcaagttattttgtgtgctgcttcaaattttacttttgtgtgtcgccttccatctccttagtacatcttatagtagctgtaagttgatcctgtatttcttgaaactgaaacaaagaattttaaaaaattacatttggaaatgacctaaatgtccatcagtagatgaatgaatcaacaaaatatatatgaaatattttagactatcacaatcttttttatttataaaaggtcataatctaggagaaatcatcccattacctgttttttgtaagtaattttagtgggacactgctacaccccttcagtctgcatattgttcatggctacttttgtgctgtaattgcagggccgagttattgcaacaaggatcttatggctcacaaagccttacataatactatctggccctttacagaaaagttcacagacccctgctctaggactaaaacacaacattcttcttgcttttgaattacattttatcaattaaatactcaaacttacaaactggtaaaatgtggaaagataaaggattacctcacgctaagcatttatattttgaattccaaacactaccacatcaactataattttattttttgtatgtatgcatttagttttattatagcaaagcaacttgcacatttttaaatatttaaaactaagcatcatctttcctttctagggaaacaacaagaaaatttaaaaacaagcaggaacaaaattaaaatcgacaaagtcagttccaaataagatcctacaggatcttattgactctcccattgaatagcaggactcaggtcatcattaggagagaagtaatttaaaagcgtcatcttaaactgcaaagatgtccattaaacatgccaaaggagaagccctgttgtctaaatgcccacttaaccaacccaaacatctcaaacccatcctttgctgaccttctataaccccctttttagtttagctttttctacaaataagagaaaatagatacatgttggcaaatgctaactgtccatattcatatagagacagagtgtgctctctgagcccaatacaaaggaagtaaggattttcatcgaaataaaaatttattcagtaaaatggcctttctgaacaagttaacctgaaatctaagaaatacgtatacacaggttctttatacattcagaaaagtagagactaaaaagaagataattttctgaaacattccattagacattatcctctgaattaacctggcttgcctcaccatgccaatagagaaatcattaaaaatagactgtttaacaggaaaaaaaaactctctcaacttctgtgagaaatgatgcataattctcaactttcctaaggttaaatatttaagaaaaaaatatatgtataaaaaatggcagaatgaaagccagagattaagatataggtgcattataataaaatcttaataaaattaataataaggaaaatacagaagaaagccatccactataaaattttaataacattaattatcataaaaatacaaaagaaagccatccactaaaattagtaccccaaaacactttatattagttaactagctacagattaacagttgttggtgtgcaaagttgcatacatacttgacttctcatctggtctaatttcttccttgaatcctgcatcccattttctaaataggtgcagtgacgcgatgaagcatccagcagagcttttgttgctgatcctttgtttaagacatcatctcgtttttgttgaagctgtctcacagctacctgataagatgttatttttgttactgattttacaaatcaccttattattaaaccattaataatatttaactctaaagcatactctttgaaaaatatcaccacacagaccgattcaccttcttttcctcatgtgtacacattcctgtgtattactgaatccagttaaggatacagaaggtgttatcttcctgccaaactggtattgttattcacacaacatattcagcccactagtcattcctcccttgatgaatctgcaatgcttaaaaaccttctgaagtctcaaaaagaaatgagtatgtgggtgagactgatggtagtaaattatacattgtggaatgatttccctctttttttaaattagaaactcaaatcaacctcagagttcctcacattaaatcatctgcttaaatccttccaatagatgtctatctcagaagaaaagtaaaattccagtggccttagatgctctaagtaacccgccctccacctcccgccctgactcagctgctatatctctcctccgtactcactccattcctactctacgtgaatcctgccactcctcgttagtctgaaatcctccttagtctgaaaatggggatccagtgtcaaactaataaatcacagatagctatgcctctctttgtcctggacaaagttatatccaaatgatagtaattgagccttgaaataaaaattatgaacaaattttttatttaaaaactgaaagtaaattataaatgccagtgggaagattaaatcaaacatgatttggctaaaatttactgcatttgccccatattataatagaagtaaaattagatgccttgaaagaatagaatggtcatatctatacataatttgagattgaaatagtttcagatttaagtcaaattgacatgaagaaaaacaaaattttaccaactaagacatatttaaagctactgaagaaaagtaattatgaaatagggaatacacttcagttcatctaggaaatctgaaattcactgtcaaagtaccccacttaattgaatcaatttcaaaataccattttaggtatgagcatttccatatacctgatttatcatggtcttaaaatgttgcaacataaatacattaaaattattacttcagcagtataagactacattattaatgttagtctatgttaacattttataacttaaaattttataagcgacacattgactttaatcagaggaaagcatctctcagttctaactttgacttgctggagacaaggaatgtttctaagcagatatatttatcatatgtatccttttttatattcaactagatccaacattcagctgtaaccaaatattactttaaattttacttcaggaagtttgaaaaatacttatttttcttgatacttacttctctttctgctttctctttttcatattggcattctttttctttcgaatgattcagttcattgaccaacattttattgtcttcttctagtaaaagacggtgctttctgcactcagcttgaaggttttgtactctagcatcacatctggcttgaatattaagtattgctttttcttgattgtcagctttgttgcgagcatcatccagttgctgttgaagcaacatattttgtttttttagttgacaaaatctttcctgtttttctatgcatttttccattgtattgtatccacttttgtacattttttcaatgtccttcatttgactctgtttttgctttagctcactttgcacgtgttcaaaaaccaaagccttttctttcagagcctctcctgtgtaatggagctcagttttgaggactctggacttactctcagctttagaaagttgcagagaaagaatcagaacatgagaattcaaattttcctgtaagtgacgacatttatctactgtgccctggaaagcaagctcttggtctctttttgatgagtgactttgatcatgatcacatcgagcagcattcagtctacaacggtatgattgcatttctgtttccagtctttgcctgctctctctttgcttctccagtttggaacggagcgttgtgttttcatctgtcagagcagcaagctgtccactataacaggctatcgtttttgctaatgtttccccattccgttttagagccttttgaaggtcttcatgctttcttttcacaatttcaaagtcttttaagtatttcttttccaggttttggttttttattgtgtctttttccagcctgagcctggcaatttcatcttgcatcaagcggttttcatgcagcaggtcttctttttcatcagtttcagaaacctaagtaaaacaaagcaaacttgtaactagtatccaataggataacatattgtgattgcttctgaaattaaataataacccgtacatttatacaatgagaggttgccataactggatatctaactgggaaaaaagaagttaagtcaaaacctcaaacctcatacagcataaattccccaaagttcaaaagtttatttgaagacagtgaatccatgaaagcaaaaaagaagccactagataatttttttaaatttcaggataaaaaaaggcttttactgaattacaacaaattgcaaggcataaagaattaataactatgaccacattaaaaaattgggtttacactctaacatctaaactatacctctccctatagtgagagccttagcttggcagatatttggacagatgaatgacattttccaaattctttaagttccctttttctaaaatattgtatagatattctacttttctaatattgttatggtcagttttaagaatgacatttattgataaatgataaagctaggcattatactaagcacttttacgtgcacaaatcaatgaactcatttagttataattctatagcaaaaggttaaaaatataagcaagctgcaggatttttcccagcttttctgactctattcctagtgctcttccaccaaatcagtaacttctgtgaggtagatatatacatacaaaaataatcttttatttcaagacaccaaaagtcaagaaaattagatctataaaactcttcttagaaaatcatgacattatttgctattgtgataacttttattccttttccataacatttgaaatgtaattaacatgaaataggggaaatatgctgaactatgtcactaggaacaaaatacttacaatatcattaagtatatattgtagaatagcattgttttcaaaaggcctttgaactaaaataaaatatttcaagatttattataaataattatagctataaatgccatgattcatttttaagatgaaataaaatttggggattgttcaggcctaaataatatatgttaaatgaaagagatggtataagtaatattaataagagtagaaatatgaagttttaccaaacattaatttacctgatttgaattatttcctcctgtcttcaattccacctctgctgatttgagagccggtttaattggttttgtcacatcagcttctatcctatattgctcttctgttattcttaacttttccctaactttttggtgcaactcttcaacatttcttcttttctttttttcttgctgtatggcaaatctgtaaatatacttatcttagaatttatcttatcagtgaggactaagctctaattttttatcttgcccaaattcctacctaaggggtccagggagtcgtgccctacaaaccatggattctcatcagatgggttttatttgaccctgtatattgtgacttgcttttcaatctgactctggcataaccttacgagacaaggaagaaaatatttaatccaaaatatatttccttgccatgccttgaaattgccctgcaaagtctcttgtgggaaaaatccacattctatagagaaccccctttcccctttgttttccttcctttctatgcagatccaggggatattcagctgagagccaggcacccttttgggtccgataagaaacattttacaatctgctctctctgaagtctgctgagagattcctctgcacagtaaaacttggtccccacaatcatttatcttaacctgaacatttctttccattaatcccaggtcttcaaataaactcaagcaattgtcaaccagaaaatgtttaaatttacctacagcctggaagccccagctttgagttggcctgcctttctgaaccaaatcaatgtatttcttacatgtatttgattgctgtctcatgcttctctaaaatgtataaaaccaagctgcaccccgaccacttcgggcacatgttctcaggacctcctgagggctgtgtcgggggccacggtcactcatatttggctcagaataaatgtcttcaaatatcttacagagtttgactctctttgttgatattagaaaataaaacattcatatgttggtttattatcctaataaagtttctatgttcttaaatactatttttctttctagttctcatgtttttaatttctcacctcaatctcatccaaagggcatgtataagttgaaatgtattgataaaagaacatcctgcataagtttctattactagtaactctagcaaatattatgaaaaaggacgttgaaaattattcagtaaagttacaagataaaaattatcttttcttcacagtaattactcctcaattaggatgaatcatttagagttaattaacataaagttactttttataaacaagttggtacattcactagaaatacattttcatcttcatgaaacattcattgcaagtatccctaaacataatttacattgcaagatagcattttcgatgtctttatgaaacatatatcagcagattactgtaatccaagactaggttaagaatgtaatatgttaccctacactttttaagattgttttttgggtaacactttcagtctatcctgctgattagtatgtactttataaccaattgtaaaatctgttttggaacaacacaagatctaatatttaattaaacaataaagaataatacatgtcttcagcataaaactgaattaattttatctacatagcagagagatgttgaataagctaatcagtaatcactttacattttactttttattccctgcatattaagaataaaactggatacatttttttttttttttttttgagagggagtctcctactatcactgggctggagtgcactggtgcaatctctgctcactgcaacctctgcctcccagtttcatgtgattctcctgcctcagcctcctgcgtagctgggattacaggtacaaccaccatacctggctaattttttgtatttttagtagagatagcatttcactgtgttgggcagactggtctcgaactcctgacctcgtgatctgcccacctcggcctaccaaagtgctgggattacaggcatgagccactgcacccggctgataatttttaaaataattattctgggtaaagaaaaatatctgttttatactctgttggttgaattataaattaatatgaacatccttaagaacaatttagaaatattgatcacagatctaaaacagatctaaaaaagtttctatactttaaccagaagaatttatccaatgtaaataattagaaatgtagaaaactatgtgtatataaaagatgttccttgtagcattattacaaaaactttttaaaacctgaaattcaattcatcaattaaataatgagatttccaaaaggtaaaattctatacagccattaaaactatgatttaaaagaatatgcatttaattattagagaagtattcacaattaagaacttgtgatattatatccaataatttcacactccataagattaagaagctttcttccctgttaaatcctagaaggaaagttcgcaattacaaaacttctccttatacgtctttaatataaaacaaacagttcaaacatttatttaaaactaggtcatacctcaaactacagagttctttttccaattcaagtatttcatgctttaactgcgattttatttcttctttttcagatattctcttttgtagtacactagccttatttttcagttttcgaatttttactctaagttgctcacagtggttatctttaagttttattaatcttttccataaacaaaatgtatttttaattttcaataggtgaacacaatctgtaaccaggaaaaaacaaactagagataaaatacatgagtagatttttggatataaaggactgtgcatttttaacatgtattcattcatacgttgaacaagtatgtacatattgagtgcctacaaggtggaagatattatagtaaggtctgcagataagacaacacctctgctattgttttagcttaaagtatagtgaagaaccaagataaaaaggtgacagttataaactcagataggtcctgtaaaaaaaaaaaaaaaaaaaaaacatagttatgtgattgcataagataatttgatctatacttcacccagggaagatttccctgaggaagagatgctacactgagaaatgaaggatgagaaagaagcagttaagcaaagaagaaagcaaagcactctggctagtttgcagcatgtgctgtgctgaagctctgctgcaatctgttactagctctgatggagtaacagatactgatttttcatcttatctgaatgaataaaaaacaaaacagacacaatacattaaactgattttcaacacagtggacttcaggcaatgaagatggtaggtgatcactgaaagacagaaaacaaatacagcaggccttacaaatatcccagctcttttgacagagttttgacggaggttcgaggccatcacaaagggagaaaatctgacatagagctggggtgatgacgctgagaggccagtaaaaccaaagcagatagagatcacaggacagaaaactggagagaaaaaagcagtacaggaaacaaatcctggagatgtgcagagattccctcttgggtatttagtggagtaatgaaaagtgcttgtgtactaggaaacttcctaagaacaatgaaaaataaaataaaaaaaaacaacagttaaagaacattagcagaaacgatgtctggggttcacacaatgactggaagagggtccattcccatgagccaggccaaaataccgcatacttcacaggacaatgaatactccgaaaggtcttgcctcaggagtgaggaattaccccaaatctaaaagcaagaatggaaagattataagtaaatctctgtactccaaataaaactcaagataataagtggaggcagggaaggtttttttttaaaaaaacacaaaccatacttgtagagacacaaattacattgtcataagtaaaaactatagtggatggaaataaacacaaattagagataacaaaggaaaaattcctaaatttgacacgataaactgcaagaaactttcaagcagctaatagataactcctcaaataaaaaagaagagacagaaaaaaaattaaagaaaaaatgaccaaaaatattctaaccttaacacaaaccataatcccacagattcaggaaggaagtgtctgggacagaaaaaaatgaaaatgtatcattgtcattttttataccatctaggatgtataatattactgaaggtgaactgtgataagttaaaattatatactaaaaatcctaaacactaagatagcaaaacagttatcgctaataaacccaaaaatatatataaaattgaatcataaaaaacagttgactaatctaaaggaaagcaggaaaagaaggggaacagagaacagttgggactaatagcaatcacacagctaccagacaaacataactatatcagtaatcacattacaaatgacacttgtctaagaacctcaactataatacagactgtcaggctcagcaagaaagcaagacccaactacaggctgcctataagaaatgcactttaaatgtaaagacacaaattggttgtaaggatggaaaaagatacatgctaacagttggcaaaggcagctgagcaggtgtggctgtattaataccaaagtagatttcatagcaaaaaaaaaaaaacattccagcaataaataacaaaggtcatgtcacaatagtaaaaggttcagttaatcaacaaaacataacaatcctcagtctttatgcccctaataacaaaccagcctcacaatatatgagaccaaagtggatagaactacaaaaagtgacagacaatttctaggtaatctgaggtttcaataccctttactcaataagtgatagaacaagaaggcagaaaatcagcgagaatagacttgaacaacactatgctttccaagtacccacggaacacttaccaaaatagaccatattttaggccatacaacaactctcaattaaaggattgagtcagaaggatttaactcatacaaagtatgtgccctgaccacaaatcaatcagattaaagaccgataacaaaaataactctgggaaatacacaaatatttggaaactaagtaacacacatctaaataaccctgggtcaaacaggtaatgaaaatagaaatagaaaatagaaaatattctgaactgaataaaaattcatcaaccagaatttgtggaatgcagctacagctgtacttgaatacaaatttttagcactgctgaatgtctacattagaagagtcttaaatcaatgactttgacttctaccttaagcaactagataaaagaagagtgacataaacccaaagcaagcagaggaaaggaaataataaacatctgctgtggtctgaatgtttgtcttccccaaaatttatatgctgaaagccaatcacagatgtgacggtattaggaggggggatttttacaggtagttggtcatgagagcgaagccctaatgaatgggattagtgcttagtgctctatacaacagaccccagatctccttcaccccttctgccaagtgagggcacagagaaaaagcattcatgaactaggacgtgttccctaaccatacaccaaacatgacagcatctggatcttggactttgctgaacccacaactgcgagaaatcaacttctgttgtttgaaccagtctatggtattttgttatactgttggttccagaagaaacaatagaaaaaaatcaacaacacaaaacaccttgaggagatcaataaatgtgataaagctccatttagccaggctgctcagaataaaagaaacaatacaaattactaatttcagaaataaacaatgtgacataattatagattctacagatactaaaaatataacaagatattataatttctatgtaagtaaacaggacaacttagataaaattaacaaattcctttaaaaatgaaaattagcaaatctcaatcaagaagcaatagataacgtgaattgccctatatctatagaagaaagttaagttatagttaaaaaccttcctaaaagaaaactccagacccagctggctatgctggtgattctacaaaacatttccggaagaaattaatacaattatacataaactctcccaaaagaaacagaaagaaggagtatatctcaactcagtctgtaatgttagctttaccctgaaccaaaaccagaaaatattaccaacaagaaaattccctcatgagcacgaatgtaaaaattcaaccaatttgtgatgcaacgaagacatcctcccatagtggagtgaataaactgtggttacacagccatacagtggaatatcactctacacataaagaaatgagcaatcaattcatgaaaatatgtgaaggaaccttaaatgcatattaccaagtgacataagctcatctgaaaaggctacttactgtatggttccaactatatgatcaggaagaggcaaaactatggataaagtaaaagggtgcctaagggtaagagacagcaggaaaagatacataggcagagcacagaggatttttagggaagtcaaaataatttatgtaacatggatacacatcattgtacatttgtccaaatccatacatgtaaagtaccaagagtgaaccccaatgcaaattatgggcttggggtgattgtgatgtgtcaatttaggctcatctatcatagcaactaccactatggtgaaggatactggtaatgaaggaggctaaacatgtattggattgggggtatacaaaaaaatatctgaacccccctctcaattttgacaggaacataaaactggtctaaaaaataaaagtctttataataaattctaaatgagactttagtaaactgtatccgacagtataatgaaaaggtaatacatcataaacaaatggggtttattccagaaatggaaggttggcttaacattgaaacatcatcattatttaccacaaaacaaactgaaagagaagacccataggatcatcccaacagacacaggcatctgataaaatttactcctgatgtctcaaagaagaaacactctcagtaacataagaatccaagggaagttcttcagcatgataaacaacgtctatgatgaacctacagctaacgtgcatcatagtgaaaaactgaatgcatttcccataagatgaggaagaacatgggaatgtctgctttcactacttgtttgtagcattgttctgaagattctagttaatgcagtcaggcaagaaaaagaaataagaggcatccaagtttaaaaaaaagaaataaaattgtctttatacacaaccatgaccataaaataggtatgggtaaaccccaacctgtgggccagcttcttgtccgataagcttttattggaacacagctgtgttcattaatttatggatgatctatggctgctctcatactaaaatggcagagtttatcagctgcaaaagagacccttttgccacaagcctaaaatattcactatccttagtaagagggtagtttgagaaagaaaggtttaacaacctttggtctatgaagaaaatctgatcaaatctaccaacaatgtgccagaactaataagtgagtttaacaagaatgaaggatacaaattcaatacagaaaaattaactgtatttctatatgctagcgataaacaatcaaatgaaaattttaaaactatcattttctatagttttataaaagtgtatatttggattagcaatgctcaacctgtataaagaaagtcaaatacatctacactaattaaactatcatttacaacttcatcaaaaatgaaatacagataaatctgataaaatatgaaaagacctataaactaaaaactacaaaatactactgagaaaattaaatattacctctataaaagcagacatacactttattgaggagtagattcgctattgttaagatgtcaattctccccaaattaatctataaatatgacccaatcccaacttaatttccaacaagcgagcagtctttattttattgataagctgattctaaagttcatgtgaaaatgcaaaggatctagcatagtcaaaacagaacaaagaacaaaattggaggattcatttcaagaattactataaatcaatagtaacaaaaacagtgtgccacaggtacaggctgaatatcccttattcaaaatgcttcagactagaagtttttcagattttggattttggaatatttgcatatacatgatgaaatatcttggggataggacccaagtctaaacacaaaatacatttgtttttcatatttaccttgtacacaaagactgaaggtaattttaaataatacttttaataatttggggcatgaaacaatgtttgtatacatgaggtcggatgtagaatttttccactgtgctgtctatgttggcaatcaaaaagtctggggttttagagcatttcagatttgggatatttaaatcagcaatgctcaacctgtataaagaaagtcaaattcagacaatccccaacttaaggtggtttgacttactgactttacagtgggtttactgaagtattaaattgcttttgactcaaacactgggtttcccacaatttggggagcacctgcaaattaataaaattcaacagacagtccagaaatagataacacataagcaaccagcttatgactgacaaaggcaggatggcaatgcagtggagaaaggatagccttttcaacatgcggtgttggaacaactggctgtccatatccataaagtgaacttgaatccatacctcacctcactccatagacaaaaggaaactcaaaatggagcacagatttaaatggaagatccaaatctataaaatttctagaacaaacacaggaaaaatctttgtgaccttgtgctaggcaaacatttttacatatgacacaaaatgcaaaatctgtaattcaacaattaaattggatttcattacaattaaaatcttctgctcttcaaaagatactacaaagcaagtgaaaagtcaacccaaaaactggcaaaaatacccttgtaaaaaagtagctaaaagtaatagtatccaaatacatacagaattattaaaattcaacacgtaagaaaacatcaacctacttttttatatgcaaaagatgtgaaaagacagttcaacaaagaagatgtacagatggcaaataaacacatggaaagatgctcaacattttagtcattaggatcatgtacattaaacccataagaatatacataatacacccatcagaataactaaaatttaaaaaaataaatacagcagtagtgtgacaacatagcaactggaatggtcatttactgctgatgagaatagaaaatagtacaaatattttggaaaaccatttagcagcttttaaaaacaggaatatgaagggccatgaggagacgttagtgggtgatggatatatgttgactatctcgatgatggtaatagtttcacatgtgtatacatctgttaaaacttatcaaatggtaccttttacatgtgtgcactgtatcgcatatcaattttaccacactaaagctactgattgtaggagcaaacacctaaggcactggctgtgacacagagaagggtatgcaatgatgcagtataaagctcgaggactgagatccatatcttatagcaataaatggcagctgggttttcagcaagcaggtaacatgatcaggtgtgattttttacaactatataattatgattgcagaacaggccatggttttggaaggtggaatagtaggaaagacagttagagggttatcacagtatttcaggtgggaggaaatggtaacatgaccatgggtaaatgggtaatggcatagaagagaagcagagtaaacaaacacactgtgtgtatcattcacactgagaaaagtacagtgaaatgatcatagctctttggctgagaaggtacaagatacagttgctttcattctattttaacataaggcatatttctgagatgaacattcttgtaacatatcagtactctatggtacagtgttaagcaatgtgtgcatacattgctataggatttttaaaaagccttatatttatgcattggtcctacctttacacttcatttcatgttgatcaatgagtaatatgacattcttacaattacagcaaagcgagtcaccgtcctctgagactgtttgagatgactgaattatgtcatcaaggtcatccctagaatgtatttggtttttcacctacaaaataaataacactgtttcaaaatgtccccaaaatatttatagcatatactaaatgtacagaagtgggaattgcccatctgtttctatgagcacaaacacaggtacctgttccatactttttttttaagcaatttcctttatgttgactctagttcagaagaccacatggtctatggataaattagtttcccagttcctatgctatttagaaaactgacagagagacttgggttaattaaggaacaaagattaagagaatgtcttcctgagcttgagttattttaattgcaaaaacaatctatttatacatacaattaggtatttagattaccccattttacacaagagattttcataagtaaaaaaattcaaatggatcaaataattggtgaagagaaaaaccagagtagcagcaagtgaccctctaagtcttttggaagttgaactttctccaaagccaggaactctactttacttgtaatatgcttacctcattcttaaatctttgcatatatcacttaattccacttctagacatactgctgatgttctgtcaccatgtggtggagaataatgcacattttctaattcaagttttatgctttcatatttatttgcactacagttgtcacataacggcttctggaacacattctgtattggttttgtactgttgtgtttgtaacaacagaaacaccatcatctttttttttttttttaaatcacatgcttcatttctttggagcaggtaagccacatacctaaaaggctttttgaatcactaaattgaggcatatgtccgatgtttaatttccagttagcggtgttttggttttttgtcatttgcctcacaacctatttgacttcttttatttcatccataactacttctgggtttcttgcttttgtactttcagtatcattataaaaattttccttgtctgagttaaaaacatgttcagtatctggtttgttgtcattttcacagtctactttatttctatttaaataaagctccgaaggtgactggcaagcatattctggagacccagagtatgaatgagaaagaaaggcatttttgagactgggttatttttgttcaggaaatatctggactactacagagacagacatgccagatgcatcactttcctaacaatcaggtgaatcatttgtcaaattagagggtatttacttaagtttgttcttcctgtagagttattatgtagttgctcttcctcaatacaagcagttttgtaattttcacaaatttcactgaaactctactttaacttatttgtgatgaattttaaagtttttttaccctaatttgtcttgtttgatccacattctctcatacttttgtgcacaagtaagtcctgaatatataaagaggtcctttctatcacaacactttttcactactagttgttgagacaatttttgcacatgcaaaagtggaagataaatttgctagttttctttctcagatgtcttttctgtcagagtacatgttttagaaataactctatctttaaataatcaagtgtaaaaagagaaaaattttaaaataattaaagtttaatatcaaacttcttaatctatgtttacctactgccaaatcactggattgtaactaagaagtgaaaaataatttgcattagcctaaaatcagtgaaaaacacaaatcatgaaactttaatttgccactgtttgtttgaactaaacttgactaattcattatgtgttaaatttcccaaaaatgaattaggagatgacttgtggtactataaaggcactgtcactttaaaagattttatcactatatgaacagtgtacacttgagtgctttttcctaatattactaactaatgattaggcaaactttaaattattaggagccaaaatcaccaccagtcagtaagaaaagcaaattctttgtctggcagccaagatggccaaataggaacagctctggtctacagctcccagtgtgagcgacgcagaagatgggtgatttctgcatttccatctgaggtaccaggttcatctcactagggagtgccagacagtgggtgcaggatagtgggtgcagtgcactgtgcatgacctgagggagggtgaggcattgcctcactcaggaagtggaaggggtcagggagttccctttcctagtcaaagaaaggggtgacagacagcacctggaaaattgggttactcccaccctaatactgcacttttccaatgggcttaaaaaatggcgcaccaggagattatatcctgcacctggctcagacagtcctatgcccattgagtctcactgattgctagcacagcagtctgagatcaaactgcaaggcagcagtgaggctgggggaggggcgcctgccattgcccaggcttgcttaggtaaacaaagcagctgggaatctcaaactgggtggaacccaccacagctcaaggaggccttcctgcctctgtaggctccacctctgggggcagggcacagagaaacaaaaagacagcagtaacctctgcagacttaaatgtccctgtctgacagctttgaagacagcagtggttcccccagcctgcagctggagatctgagaatgggcagactgcctcctcaagtgggtccctgaccactgaccccaagcagcctaactgggaggcaccccccagtaggggcagactgaacctcacatggctgggtactcctctgagacaaaactcccagaggaaagatcacacagcagcattcgctgttcatgaaaatccactgttctgcagccaccgctgctgatacccaggcagacagggtctggagtggacctctagcaaactccaacagacctgcagctgagggtcctgtctggtagaaggaaaactaacaaacagaaaggacatccacaccaaaaacccatctgtacatcaccatcatcaaagaccacaagtagataaaaccacaaagatggggaaaaaacagagcagaaaaactggaaactctaaaaagcagagtgcctctcctcttccaaaggaacacagttcctcaccagcaatggaacaaagctggacggagaatgactttgacaagttgagagaagaaggcttcagatgatcaaactactctgagctacaggaggaaattcaaaccaaaggcaaagaagttaaaaactttgaaaaaaatttagatgaatgtatacctagaataaccaatacagagaagtgcttaaaggagctgatggagctgaaagcggaggctcgagaactacgtgaagaatgcagaagcctcagaggccgatgcgatcaactggaagaaagggtatcagtgatggaacatgaaatgaatgaaatgaagcgagaagggaagttgagagaagaaagaataaaaagaaatgaacaaagtctccaaaaaatatgggactatgtgaaaagaccaaatctacatctgattggtgtacctgaaagtcacggggagaatggaaccaagttggaaaacactcttcaggatattatccaggagaacttccccaatctagcaaggcaggccaacattcagattcaggaaatacagacaacgccacaaagatacccctcgagaagagcaactccaagacacataattgtcagattcaccaaagttgaaatgaaggaaaaaatgttaagggcaaccagagagaaaggtcgggttacccacaaagggaagcccatcagactaacagtggatctctcggcagaaactctacaaaccagaagagagtgggggccaatattcaacattcttaaagaaaagaattttcaacccagaattttgtacccagccaaactaagcttcataagtgaaggagaaataaaatactttatagacaagcaaatgatgagagattttgtcaccatgaggcctgccctaaaagagctcctgaagaaagcactaaacatggaaaggaacaaccggtaccagccactgcaaaatcatgacaaaatataaagaccatcgagactaggaagaaactgcattaactaacgagcaaaataactagctaacatcataatgccaggatgaaattcacacataacaatattaactttaaatgtaaatggactaaatgctccaattaaaagacacagactggcaaattggataaagagtcaagacccatcagtgtgctgtattcaggaaacccatctcacatgcagagacacacataggttcaaaataaaaggatggaggaagatctaccaagcaaatggaaaacaaaaaaaggcaggggttgcaatcctatctctgataaaacagactttaaaccaacaaagatcaaagagacaaagaaggccattacataatggtaaagggatcaattcaaaaagaagagctaactatcctaaatatatatgcacccaatacaggagcacccagattcataaggcaagtcctgagtgacctacaaagagacttagactcccacacaataataatgggagactttaacatcccactgtcaacattagacagatcaacgagacacaaagttaacaaggagacccagaaattgaactcaactctgcaccaagtggacctaatagacatctacagaactctccaccccaaatcaacagaatatacatttttttcagcaccacaccacacctattccaaaattgaccacatagttggaagtaaagctctcctcagcaaatgtaaaagtacagaaagtataacaaactgtctgtcagaccacagtgcaatcaaactagaactcaggattaagaaactcactaaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtacagtgggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagccggttttttgaaaggatcaacaaaattgatagaccgctagcaagactaataaagaagaaaagagagaagaatcaaatagatgcaatacaaaatgataaagggggtatcaccaccaatcccacagaaatacaaactaccatcagagaatactacaaacacctctatgcaaataaactagaaaatctagaagaaatggataaattcctggacacatacaccctcccaagactaaaccaggaagaagttgaatctctgaatagaccaataacaggctctgaaattgtggcaataatcaatagcttaccaaccaaaaagagtccaggaccagatggattcacagtcgcattctaccagaggtacaaggaggaactggtaccattccttctgaaactattccaatcaatagaaaagagggaatcctccctaactcattttatgaggccagcatcatcctgataccaaagctgggcagagacacaaccaaaaaagagaattttagaccaatatccttagtgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcttataaacagaaccaaagacaaaaaccacatgattatctcaatagatgcagaaaaggcctttgataaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccaggcccattaggcaggagaaggaaataaagggtattcaattaggaaaagaggaagtcaaaatgtccctgtttgcagacgacatgattgtatatctagaaaaccccattgtctcagcccaaaatctccttaagctgatcagcaacttcagcaaagtctcaggatacaaaatcaatgtacaaaaatcacaagcattcttatacaacaataacagacaaacagagagccaaatcatgagtgaattcccattcacaattgcttcaaagagaataaaatacctaggaatccaacttacaagggacgtgaaggacctcttcaaggagaactacaaatcactgctcaaggaaataaaagaggatacaaacaaatggaagaacattccatgctcatgggtaggaagaatcagtatcgttaaaatggccatactgcccgaggtaatttatagaatcagtgccatccccatcaagctcccaatgactttcttcactgaattggaaaaaactactttaaagttcatatggaaccaaaaaagagcccgcatcaccacatcaatcctaagccaaaagaacaaagctggaggcatcacactacctgacttcaaactatactacaaggctacagtaaccaaaacagcatggtactggtaccaaaacagagatatagaccaatggaacagaacagagccatcagaaataatgccacatatctacaactatctgatctttgacaaccctgagaaaaacaagcaacggggaaaggattccctatttaataaatggtgctgggaaaactggctagccatatgtagaacgctgcaactggatcccttccttacaccttatacaaaaattaattcaagatggattaaaggcttaaacgttagacctaaaaccataaaaaccctagaagaaaacctaggcattaccattcaggacataggcatgggcaaggacttcatgtctaaaacaccaaaagcaatggcaacaaaagccaaaattgacagatgggatctaattaagctaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaacaaccccatcaaaaagtgggcaaaggatatcaacagacacttctcaaaagaagacatttatgcagccaaaaaacacatgaaaaaatgctcatcatcactggccatcagagaaatgcaaatcaaaaccacaatgagataccatcccacaccagttaggatggcaatcattaaaaagtcaggaaacaacagatgctggagaggatgtggagaaatagcaacacttttacactgttggtgggactgtaaactagttcaaccattgtggaagtcagtgtggtgattcctcagggatctagaactagaaataccatttgaccctgccatcccattactgggtatatacccaaaggactataaatcatgctgctataaagacacatgcacacgtatgtttattgtggcactattcacaatagcaaagacttggaaccaacccaaatgtccaacaatgatagcctggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgctctcactcataggtgggaattgaacaacgagaacacgtggacacaggaaggggaacatcacactctggggactgttgtggggtggggggaggggggagggatagcattaggaggtatacctaatgctaaatgacgagttaatgggtgcagcgtaccagcatggcacatatatacatatgtaactaacctgcacattgtgcacatgttccctaaaatttaaagtacaataataataaaataaaaaaagaaaagcaaattcttacattttaatgcaaattacatattgtaatatgattgacagtgttatatatttatatagattataggcttaagttctaaggtctactaatgacagtggatttaataaatttaacaatatttagagattttctatattgaaattcattaggcagttattgtttgtacactaataccaaaggtgccattttgcaaggtataattctcttgatagccagttgggttgattttatgacccattctctccctcaacatagaaactgaagtcagagatcaaaagggaaaataaattcttaaccttggtattagtgactggcaataaaaaaactgcaaagtttgaaccactagcaataattactcctttaatctgaatccagtacggtggtcatcactgttaaattgttcataatttctattgcttaaaattgtaattcaatatttgatgttaccttctttattataataggaagttataaaaatagaagtgcaaacaatatcaggaactttttaactcaattccaagagtaaagattagatacaagttgctatagattccaacactattttaagttttataactaaatgtttttaaaatgaaatattaaattataatcaactgatactaaaaggcaaatccaaaggtaaattcatttcaaatatgctgtattaccaaagctaggaaaacaagattaaaccagaaatttgattttaaatttttacatacctgtggctggttattttcatattcttcaagcctcttttgctctccctctgatgccatttctaagtcttgttctgctaaaaaaattatatatttagttaaaatgagctacacagaacagttagataaaagccatggtcagcggtggctcacgcctgtaatcccagcactttgggaggctgaggcgggtggatcacgaggtcaggagatagagaccatcctggctaacaaggtgaaacctcgtctctactaaaaaatacaaaaaattaactgggcgtggtggcaggtgcctgtagtcccagctagtcgggaggctggggcaggagaatggcgtcagcccgggaggtggagcttgcagtgagctgaagatctcaccactgcacctccagcctgggtggcagagcgagactgtgtctcaaaaaaaaaaaaaaaaagccatattctttctaaaaccagaaaataaaagtgtttcaacgaagcttaatctttagtataatatgtacttctttaagaaaggcttttaatcctccaaaacttcagcaaaccacttggggaggcactagatgtcaccaggttcaagccatgcaaacgtggtcaaagattcactcacaaattcatccacccaacatcaatgaacaaaaccatcagaaataagacaaaatgtaaaaatccaatagaaacagaaaaagtaacagcacactgttctttacttcacaatagtacctttagaacagcacattgagcctgctgttcattattaatcatttccaaaatgactgctactgtttacactttcatcaatgtacagtctcttctttatatctaaaatattttcctcaactattctgacagatttctttcataatttaagactcagacagctatgtgaagtcttccttgattccggctatctttcctcagataaatgattttatttaatacaggttttataacatatgtagttaaggtttcaaaagtgagattatgtctcaactaactataactgaaatagaagagtgtatctatttcaatgtaaacatgttgactgataatgagaaaaatgatccttataaagaatagcaaatcatgatcctaagacagtaagtgtcaaagctgatgggaggatgctatggcctatctttaatgcaatacttcagattcaattacaccattatactacaagcatttatcatgtccaactatttttcctattatttaggaagtacaaagttgtgaggacacttccaataaatatacaatttatttctcatcagagaaactgtttaaaattaatcagcttagatagacagttgtagaataaaaattaataaaactattcatttttttcattcctaggtaggctactgctatgtctacattgcttgtatcctgcagtttggccctgtcaagaactttctgaatccactcatgcaagaagatatgtaaaccacatcaaaaatagtgtataggctgggtgtggtggctcacgcctgtaatcacagcactttgggaggctgaagtgggtggattacaaggtcaggaggtcgagaccagcctgactaacatggtgaaaccccatctctactcaaaatacaaaaattagccaggcatggtgtcatgtgcctgtaatcccagctactcaggaggctgaggcaggagaatcgctttaacccgggaggtagaggttgcaatgagccgagattgtgccattgcactccaggctgggagacagagcgagactccatctcaaaaaaaaaaaaaaaagtgtataataagctttcaatatgtaaataattgtcaaaaatgaaaaaattaaatttccacagacattaataacattttatacttcaaaatcagtacaacgttcactgattattttggttttgttattcaaagaatgaatgctataactttttgtttctaaaattagttcgatttgatataccatgctaatctctaaggcactttcatggaactgtgatcttattaaaaaaataggtttcttagtaaaatcagtcaaagtttcttagttcaaataaatttcatttgattaactaatatcaacacttctatatagctcttataaattattcccaccacaaatgaagaggaaagcctcttaatttagcagtagtaccttacatgtataatttctatttcctaaatttgtgttcctttccctctggctagaaacatgctcagaaatagtagcaaaatgacactgttatgtttcaaactgctatcagatggcaaacaggtatacggaaaggtgctcgacatcactgatcatcacagaaatgcaaatcaaagctacaatgaggtatcatctcacctcagttaaaatggcttttatccaaatggcaggcattaagaaatgctggtgaggatgtggagaaagcagaaccctcgtacaccattggtggcattgtgaattagtacagtcactatggagaacactatagagtcctcaaaaaattaaaaatacagctacccacatgatccagcaatcccattgctaggtaacgattcaaaagcaagaaaatcagtattataaaagagaaatctgtcctgacatgtttattgcagcacttttcacaatagccatgatttggaatcaacctaaatgtacatcaacagaaaaatgggttctaaaaatgtgatacatatacggctcagccatgtgaaagaataagatcctctcattcgcaatgacatggatggaacaggaggacattatgtcaagtaaaataatccaggcaaagaaaggaagccttcacatgttgtcagtcctttgtgggtgtgagaaatttaaaaaatagagctcatggagatgaagagaaaaatcaccattaccacagtctaggaagggtgtgggggtggtaggaaaagaggatgcttaataagtacaaactatagttagaaacaatgaataaaatgtagcattttatagcacaaaaacatgactacagtcagaaataacttgttgtacattttaggattactgaggaagtacaaatgaaaagatagcacaaagaaatggttaatgcttgaggtgatggataacccattaaccatgatgtcattattacacattgtatgcctgtatcaaactatctcatctactccataaacataaacacctacaatttactcattaaaattaaaaacaaaaaaataaaacacacacacacacacacacacacacagtgtgctaatcagaacatccgattggcttaatataataagtgtaacaaaattgaccagaaccaataaaagttaaaacaaaatatgttacaaaataaaacatttcattagctaaaagccataattttaattgacttttaaagcaaaacaaatattttacagtatcaaaattgatctctttaattcgctaaaaactattgaattccaaattggaaacttcagagtatcaaaatgtaaaagtagaaacatctgaataaaaccttatatttttaggccaggcatggtggttcacacctgtaatcccagcactttgggagggcgaggcgggaggatcacctgaggtcgagagctcaagaccagcctgaccaacatggagaaagcctgtctctactaaaaatacaaaattagccgggcatggtggggcatacctgtaatcccagctactcgggaggctgaggcaggagaattgcttgaaccaggaaggtggaggttgtggtgagctacaattgagccattgcactccagcctgggcaacaagagcaaagctctgtctccaaaaacaaaaaacaaaacaaaaaaaaaaaccttatgttttaaaaatgtattttccttatgcatgtaaatctcatttttgaaaatataaataaaaatgataacagctgcattatttagatgaaatcctgaaataaaatataaaaagtgaaataattgagaatagaaagactatgagcattacaaacagattaatgtacttctttccagagttaaatctacaatgcaaagtttacctggtgtggatgtttgtacctccttcattttggtggctgtattcagaacagaatctttattttcaattgtagcctgaatgggttttaaaacaaagtgattagcacatgatgtatattggtataggttatgcagttaataattaaaaatataaatgtaagagtaattaccttcaaggtgcgcagattctcaggatactctaacaagcaagagaaatatataatcatatgtaaatatggtaaggccaaccatacattcgtggagtgttagcatcaaactgaatactcttgcctgtattagtgtagggtttcatgtttttctagtttgtttctttgggacagtaacatgatagaaatgcaataaagaaaataggaatacaagcttcaaaaacatacagttacaagttaaaaagtgagattatgcaccacatctattgctaaaaaaaagtgttaatatcaatgtggatatactgattaacaaggagaaatgtgatctaaaatcagaggagcaagtcataaccctagaaataagtgtaaaagctggtgctaactgcgactacatgactttcatacaagacatcagaaggctttataccagtataacataaacattcatcatgctctttagcttgtctgataactgagaaggtacacaattacaatgacacttcagttgaacgtacacttcacgtatcttcagtgtaagtgtcctgaattgatctgcttggatatatgtttggtgaatcctagtagttaatattcattatttatcatgcccatgtggtgtaatagtctgcctacatttcttatatcctctagtttagccttcagaaagtttcttcatccactaatggcaagaaggtctaatatataaaccccatcgaaaagtataataaattatacatatttatacaaaatggaattgctccaggcattagatattaataaacttacacatttggaaatcagtccaatattcattgaaaataatcactttaagattcaattaatgcattcaacattatttttgtctgtaaaattagtctgctctggaatatcactttactataaagaattttcattaaatagctattttaacaagacagccagcactttggaaaaaactaaatattcatattaaatttcaactcatttgaataactaataaagaatatatgtctgatgtctgatactaataaacatgaataatgaggcactgtgatttatcccaattctagcactccttcctgattacagtagtcattggagcagccagaaatcagatcttctggtatgcaaatattctaaatgcatgtgaagtgagttcactcaggcttcctcagcagaaaccccaaaattacctaaataacttcttccttcccctctttcttgccttgcaatccctctcttgatgaaaataattactacatcagtggtcaccttgctcctcattctccagtgtttatgggttattatgacaacttcctccctctggtttaagcagtaccatctgacatctataatttctattacttttttctctttctccttcccctttccatagaaacatgctctgaaataagagcaaaattatgctgtccccggatcctcttatctcttatgtcttgaactgttttccaacggttcttctacacaatttcaatgtagggaagtctataagcttgttactaagatcatggccaaggaccagcagcatcaacaacacctgacaactcagtagaaatgcacaatctcaggcctgctgaatcagaaagtgcattttcaatgagccccctgctgatctattcaggggtgggacgttgtcttctatcttgagtgcacatgacattaaatgtatattgccaaattacctgttccagatttcccaccgcccgttattcttgtggcaatattcaaaagagaaactttctttttaaatataacctgaatggaaagagaaacaaaatagtcaatacataatatatatttcataggctatgcaataaataattcaaaatataaatgaaagagtaactaccttctgggccgattgtttctgaggagacactgaaaagtaaaagaaatatataatccatcatatgtaaatatgataaagttatccacacattcatgcagtgttagcatcaagctgtatcctcctgcctgtactagtgtaggatttgatgttttacagtttgtgtctttgggacaggaacatgaggaaatatgctgaagaaaataggaatacacgcttccagaaaatattcagtcagaaattacaaagaggtattttgcgtcatgtgtgtattactgaaataaaaagtgtcaatatcaatgtggatatgctgaatgatgaaaagaaatgtgatctaaaatcagaggagcaactcatacacccaggaaccaatgtcaaagaaggtactaaatgctactgcatgtttttcatgcaagacatcagaaggatttataccactgtactgcaagtattcatcatgctctttaacttgcctggtaattgagcaggtacacaatgacaatgacactttaatagaatgtacacttcacaagtcctcagtggaagtgtcgcagcttcatcagcttggatataggttgggataatcctgtatacaatattctttatttctcaaacccatgtggtgtaataatgtgcctacatttgttgtgtcctctagtttaggctacagaaaggttcttcatccactcatggcaacaaagtataatatataaaccatatcaaaaagtataataaatgatcaaatgacaaacttatacaaaataaagttgctacaagcattagatatgaataaccttttacatttggaaatcactacaatattcattgaaaataacaattttaaaagtcaattaatgaattcaaattaattttgtttctaaaatagtctggtttgaagtatcatgttactctctaaagcattttcattaaattgctattttatccaaagttagctaattgaaaagccaatatatgcatattcatgtttatttcatttgaataactaatatcaacaaaacatatatctctgacacccaagagtaacaaagaggagcaatgagtcactgtggtttatcccaattctaggagtccttcctgcttccactggttcctaaagcagtcaaaatcaaatcttcttttaggaaaatattcgaatatgcatctgaacacaagtttcctcagaagaaacaacaaaattacctaaataacttcttattttccctcctttctgcctgacaatccctcttccttgaggaaagtaattgctacatcagcggtctcgttagttctcattctacagtgtttatgggttattgtgatcacttttccatctgtttttaggaacgcgatgtgatatctgtaaaatctatacttcatctctatctcctaccacccttggtgaaaacatgctgtagaattaaagcaaaattatgctgtcccctgagccccttatgtcttgacatggtctccaatgtttcttcttcccaatttcaatgtggggaagtctataatcttacttcgaagatcacgtccaagaccagcagcatcagcgtcacccgagaacttattacaaatgaagaatctcaggtctgcagaatcggaatgtgcagctgcgacgaacccccccgctgatttatttggggaagagaagttcttttctatctggactgaacatgacattaaatgtgttttgtaaaattacctgtcccagatttttctccatcctttatttctctggctatattcgaaacagaatctttctcatcacctgtagtctgaatggaatttgaaacaaaataataaataaataaagtatgtttcatagactatacaattactagttcacaatataaataagagtttaattaccttcaaggctggtcgtctctgagaagacactgaaaagcaaaagggatacataatcacccacatgcacgtatgataaagttattcatacattcatgcagtgttagcatcaagctgtatccttctgcctgtactagggtaggatttgatgtttcctactttgtgtctggggattggaacatgacagaaatacactgaaaaaaagtaatacagccttcatgaaaaatatacttacaatttcaagcatggtatgatttgtcatatgtctaaaactaaaataaaaccgtgtcaatatcaacgtggatatgctgagtgatgaggacaaatgtgatctaaaatcagaggatcaactcatacacctgagaatcaatgtcaaagtaggtggtacttgatcccacaggtctttcatgcaagaaatcaaaaggatttacaccattatactacagacattcatcatgctctttaacttgcccgataacagagaaggtacacaattacaatgacacttcagttgaatgtacacttcacgtctcttcagtagaagtgtcctaaattgatcaccttggatatctgtttgctgaaactgagtagataatatttattattcctcaaacccacgtggtgtaataatttgcctaagtttcttgtatccactcgtttagctttccaaaagtttcttcatccattcatggcaccaaaggataatatattagcctcaataaaaatatcatcaattatcaattttgacatacttctacaaagtaaaactgctacaagcgttagatattaatatgttttacattcacaaatcactccaatattcattgaaaatgaccactttaggagttaattagaattccacatactttttgtttctaaaatagtcttgttgggagtatcatgctattctctaaagaagtttcatccaatagctattttacccaagagttagctccttgaacaacgaagccaatgtattcatattcaagtttatctcatttttataactaaaatcaacaaaacatgtatctctgatgcctaatagtagcaaagaagagtaatgagtcagtgtgctttatcccaattctagcattgtttcctgcttccagtagttcttggagaagccaaaatttagtgttcttttatgcaaatattccaaatttatctgaagtgagttcactcagctttcctcaacagaaaccccaaaattacataaataacttcttcttttctctccttcctgcctcacaatccctcttccttgtggaaaataattgctacttcagtgatcttgttcgttctcattctatgctgtttttgaggtattaggatgacgtttccctctgtttataacaatataatctgacgcctataatatctattacttcatctctttctccttcccctcttgatggaaacttgctgtagaattaaagcaaaatgatgctgtcccctgaggctgttatgtgctaaaccactctcctatggttattcttcctaatttcaatgtagggaagtctacaatcttactactcagatcatggtcaaggaccagcaccatcagggtcacccgaggacttattacaaatgaagaatctcaggcatgctgaatccaaacataaagcttcaatgaaacccccgctgatttatttggggaagtgaatttctcttctatttgatcgaacattacattaaaggtgtattccaaaatacctgtcccacgtatttgtccatcctttatttctgtggctatattcgaaacagaatctttcttgacacttgtagcctgaatgggatttgaaacaaaataatcaatacataaagtatatattcatagactatacagttaatagttcaaaatatatatgagtgtttaattaccttccaggccggttgtttctgagaagacactgaaaagcaaaacagatacataatcactcatatgtgcatatgataaagttattcaaacattcatgcagtgttagcatcaagctgcatctgtctgcagttattagtgtaggctttgatgctttatactttgtgttttgggatgggaacatgacagaaatacactgaagaaaacaggaatacaggtttcaagaaatatacactaagcatttcaaacgtagtatgatttgtcatatgactaaaactaaaataaaagtgtcaatttcaataaggatatgccgagtgatgaggacaaatgtggtctaaaatcacagaagaaactaatcacctgggaatcaatgtcaaagcaggtggtacatgcacccgcatgactttcatgcaagatatccgaatgattaaaccattatactgcaaacattcaacatgctctttaacttgcccaataactgagaaggtacacaattacaatgacacttcacttgaacgtacacttcacatctcttaagtggaagggacctaaatcgatcaacgtggatgtatgtttcctgaatccaagtaaataattcattatttctcacacccatgtgctgtaataatttgcctaagcttcttgtattctctagtttagccttttgaacatttcttcatccactcgtggcaacaaagtataatatataacctcaataaaaagcatcatcaattatcaattttgacataattctactaaataaaactgctacaagtattggatattaataagcttttacacttggaaatcactccaatattcattgaaaattaccattttaggagtcagttgttgaattcaacattatttttgtttctaaaatagtcttgttaggagtatcatgctattctctaaagaatattcattaaatacctattttatccaagagtcagctctttgatcaatgaagccaatgtattcatattcaagtttatctaatttctataactaaaatcaacaaaacgtgtaagtctgatacctaacagtaacaaagaagagtaattagtaaatgaagtttatcccaattctagcattatctcctgcacccagtagttccagcagctgccaaaatcaaatcttctttatgcaaatatgctaaatgcctctgaagtgagtccactcaggtttcctcagcagaaaccccaaaattacataaataacttcttcttttccctccttcctgcctcacaatccctcttccttgggaaaaatcattgctatatcagtggtctccttagttctcattctacagtgtctacaggttattaggatcactattctgtcttttttatagcagtatgatgtgacatctgtaaaatatatacttcatgtctttctccttctacccttattgaaaacatgctgtagaattaaagcaaaattatgctgttcccctgagccccttatgtcttgaactgctctccatatttcttcttcccaatttcaatgtggggaagtctatataatcttactgcaaagatcatgtccaagaccagcagcatcagcgtcacccaagaacttattaaaaatgaagaatgtcaggcctgctgaatcagaatgtgcagttttgatgagccccacactgatttgttcggggaagagaagtacttttctatctggactgaacatgacattaaatgtgttttgcaaaattacctgttccagattgttgtccatcctttatttctgtgggtatattcgaaacagaatctttcttgtcacttgtagcctgaatggaatttgaaacaaaataatcaatacataaactatgtttcatagaccacacagttaatagttcacaatataaatgagagtttaattaccttcaaggctggttgtttctgacaagacactgaaaagcaaaagggatacataatcactcatatgtaaatatgataaagttatccatacattcctgcactgttggcatcaagatgtatcttcctgcctgtattagtataggctttgatgttttctactttgtgactcgggactggaatatgacagaaatacactgaaaaaggtgaatacaggcttcacaaaatatacttacaatttcaaacatggcatgatttgtcatatgtctaaaactaaaataaaaccgtgtcaatatcaatgtggatatgccaagtgatgaggacaaatgtgatctaaaatcagaggagcaactcatacaattgagaatcaatgtcaaagcaggttctacatgatgccacatgtctttcatgcaagaaatcacaaggatttacaccattatagtacaaacattcatcatgctctttaacttgcccaataactgagaaggcacacaattacaatgacacttcagttgaacgtacacttcacgtctcttcagtggaagtgtcctaaattgatcagcttggattatgtttgctgaaacctagtagctaatattcattatttctcacacccctgtggtgtaataatttgcctaagtttcttgtatccactcatttagccttctgaaagtttcttcatccactcatggcaccaaaggataatatattagcctcaataaaaatatcatcaattaccaatgttgacgtacttctacaaagtaaaactgctacaagcattagatattaataagtttaacattcagaaatcaatcaaatattcattgaaaggaccactttaggagttaattagaattcaacataatttttgtttctaaaaagtcttttttggagtatcatgctattctctaaagaagtttcattcaatagctattttatccaagacttagctccttgaactttgaagccaatgtattcatattcatttatctcagttttataactaaaatcaacaaaacatgtatctctgatgcctaatagtaaattactcctaaagaggagtaatgagtcactgtggtttatcccaattctagcatagtttcctgcttccagtagtgcctggagctgccaaaatcaagtcttcttttatgcaaatgttccaaatgtattgaagtgagttcactgaggtttcctcagcagaaatcccaaattacataaataacttcttcttttctctccttcctgactcacaatccctattccttgaggaaaataattgctacatcactggtcttgttacttgtcattctacagtgtttttgtggtattaggatcacttttccctctgtttatcccaatacaatctgacacctctaatatctattatttcatctctttctctttcccctcttgatggaaacatgctgtagaattaaagcaaaatgatgctgtcccctgagcctgttatgtgttgaattgctgtcagatggttctttttcccaatttcaaagtacagacatctaaaatcttagtactttcagcatggacaaggaccacagcatcagggtcacccgagaacttattacaaatgaataatctcaggaatactaaatcagaacatgaagatttgacgaaccccccgctgctttatttggtgaagagaagatctcttctatcttgaacgaacatcatattaaatgtgtttgcaaaattacctgtcccagatatttgttcatcctttgtttctgtggccatattcggaacagaatcttccttgtcacttgtagcctgaatggaatttgaaacagaacagtcaataaataaagtatatttcatagactatacagttaatagttcaaaatacaaaagagagtttaattaccttcaaggatggttgtttatgagaagacactgaaaagcaaaagggatacataatcactcatacataaatatgataaagttatccatacattcatacagtgttagcatcaacctctgtcctcctgcctgtaatagtgtaggctttgatggcttctactttgtgtctggggacaagaacatgacagaaatacactgaaaaaagggaatacaggctccatgaaatatatccttacaatttcaaacatggtatgatttgtcatatgtcgaaaactaaaataaagccctgtcaatatcaatgtcgatatgccgagtgatgaggacaaagtgatctaaaatcagaggagcaactcatacacgtgagaatcaatgtcaaagcaggtgctacatgatcccacatgtctttcatgtaagaaatcaaaaggatttacaccattatactacaaacattcatcatgctctttaatttgcccgataactgagaaggcacagaattacgacgacatttcagttgaacgtacacttcacatcccttcagtggaagtgtcctaaattgatcaccttggatatctgcttgctgatacctagtagataacattcattatctctcacacgcacgtggtgcaataatttgcctaagtttcttgtatccactagtttagacttctgaaaatttcttcatccactcttggcaccaaaggataatatattagcctcaataaagatatcatcaattatcaactatgacatatttcttcaaagtaaaactgctacaagcattagatattaatcagtttttcattcagaaatcactgcaatattcattgaaaattataattttaggagttagttagaattcaacatcatttttgtttctaaaatagactttttgggaggaccatgttattctcgaaagaagtttcatgaaatagctatttcatccaagaggtagccccttgaacaaggaagcaaatttattcatattcaagattatcgcatttttataactataatcaacaaaatatgtatctctgatgcctcctagtaacaaagaggagtaatgagtcagtgtggtgtattccaattacaccattgtttcctgcttccagtagttcctggagcagccaaaatcaaataacttttatgaaaatattccaaatgcatctgaagtgagttcactcaggtttcctcagaagaaaccagaaaattatataaaagaattcctctttttcagccttcctgcctcacaatccatcttctttaggaaaatagttgctacaccaggggtctccttagttctcctacagtgtctacgggttgttacaacaagctttctgtcttttcttggcagtatgatctgaagtgtgtaaattctatacttcctctctttctccttccacccttactgaaaacaagctggagaattaaagcaaaattatgttgttccccagagccccttatgccttgaactgctcaccatatttcttcttcccaatttcaatgtggggaagtgtataaccttactgcgaagatcatgttccagaccagcagcaacactatcacccacgaacttatttgaaatgaagaatctcaggactgctgaatcagaatgtgcagcttcaacgagccccccgcagatttattcagggaagagaatttcttatctacccggactgaacatgacattaaatctcttttcaaaattacctctcctagttttttctccatctttttttcctctggctatattcaaaagagaatctttctcgtctcttgtagcctgaatggaatttgaaatgaaataataaattaataaagtatgtttcatagactatacatttactagttcacaatataaatgacagtttcattaccttcaagcctggtggttgctcaaaagacactgaaaagtaaaagggattcataatcactcatatgtaaaaatgacaaaattatccacacattcacgcagtgttagcatcaacctctgtcttcctgcctgtattagcataggctttgatggcttctactttgtgtctggggactagaacatgacagaaatacgctgagaaaagggaatacaggctccatgaaaaatactcttataatttcaaacagggtatgatttgttatatgccaaaaactaaaataaaaccgtgtcaatatcaacgtggatatgctgagtgatgaggacaaagtgatctaaaatcagaggagaaactcatacacctgagaatcaacgtgaaagcaggtgctacatgatcccacatgtctttcatgcaacaaatcaaaaggatttacaccattatactacaaacattcatcatgctctttaaattgcccaataactgagaaggcacacaattgcaatgatacttcagttaaacttacacttcacatctcttcagtggaagagtcctgaattgatcaccttggacacctgtttgctgataccaagtagataatattcattatctctcacacccatatggtgtaataatctgcctaagtttcttgtatccactagtttagccttccaaaagtttcttcatccagtcgtggcaccaaaggataatatattagcctcaataaaaatatcatcaattatcaattttgacatacctatacaaagtaaaactgctacaagcattagatactgatcagtttctctttcagaaatcactgcaatattcattgaaaatgaccattttaggagttaattagaatccagcataatttttgtttctaaaatagctttgttgggagtatcatgttgttctctaaagaagtttcatgaaatagctattgtatccaagaggtagctccttcaacaaggaagccaatgtgttcatattcaagtttgtctcatttctataactaaaatcaacaaaacatgtatctctgatgcctaatagtaacaaagaggagtaatgactcagtgtgtttttatgccaattctaggattgtttccttcttccagcagttcctgcagcagccaaaatcaagtattttttattaaaatattccaaatgcatctgaagtgagttcactcaggtttcctcagcacaaaccccaaaattatataaatgacttcctcttttcacaccttcctgcctcacaatccgtcttccttgggaaaatgattgctacaccaggggtctccttagttctcctacagtgtgtacgggttattacaacaagtttgctgtctgtttttagcagtatgatgtgatgtctgtaaaatcgatacttcctctctttctccttccacccttactgaaaacaagctgtagaattaaagcaaaactatgctcttccccagagccccttatgtcttcaactgctctccatatatcttcttcccaacttcaatgtggggaagtgtataatcttacagcgaaggtcatgttccagaccagcagcatcagcatcagcatcagcatcactcaagaacttactacaaatgaagaatctctggcctgctgaatcagaaagtgcagcttcgacgagccccccgctgatttatttggggaagagaacttcttatctatctggactgaacatgacattaaatctgttttcaaaattacctgtcctagatttttctccatcctttttttctctggctatattcaaaacagaatcttccttgacacttgtagcctgaatggaatttgaaatgaaataataaataaataaagtatgtttcatagaccatacattaactagttcacaatataaatgagagtttcattaccttcaaggctggtggtttctgagaagacactgaaaagcaaaagggattcataatcactcatatgtaaatatgacaaagatatccacacattcatgcagtgttagcatcaaactctgtcctcctgcctgtattagcgtaggctttgatggcttctactttgtgtctgcggactagaacgtgacagaaatgcactgagaaaagggaatacaggctccatgaaatatacccttacaatttcaaacatggtatgatttctcatatgtcaaaaactaaactaaaaccgtgtcaatatcaatgtgcataggccaagtgatgagaacaaatgtgatctaaaatcagaggagcaactcacactcctgagaatcaatgtcaaagcaggtgctacatgatcccacatgtctttcatgcaacaaatcaaaaggatttacaccattatactacaaacattcatcatgctctttaaattgcccaataactgagaaggcacacaattgcaatgatacttcagttaaacttacacttcacatctcttcagtggaagagtcctgaattgatcaccttggacacctgtttgctgataccaagtagataatattcattatctctcacacccatatggtgtaataatctgcctaagtttcttgtatccactagtttagccttccaaatgtttcttcatccagtcgtggcaccaaaggataatatattagcctcaataaaaatatcatcaattatcaattttgacatatttctacaaagtaaaactgctacaagcattagatattgatgttttacattcagaaatcattccaatattctttgacaatgatcactctaggacttaattagaatgcaacataatttatgcctctaaaatagctttgttgggagtatcatgttattttctaaagaagtttcattaaacagctattttatacaagaggtagctccttgaacaaggaagccaatgtgttcatattcaagtttatctcatttctataactaaaatcaacaaaacatgtatctctgatgcctaatagtaacaaagaggagtaatgagtcattgtgtttttatgccaattcaagcactgtttcctgcttccagcacttgctggagttgccaaaatcaaatattgtttatgaaaatgttccaaatgcatctgaagtgagttcactcaggtttcctcagcagtaaccccaaaattatataaatgacttcctcttttcccacattcctgcctcacaatccgtcttcattcagaaaataattgctacatcaggggtctcctcagttctccttctacagtgtctatgggttattatgaacagttttctgtctgtttttagcactacgatgtgacgtctgtaaaatctgtacttcctctctttctccttacacccttaatgaaaagatgctacagaattaaagcaaaattatgctgtgccccagagccccttatgtcttcaactgctctctatatttcttcctcccagttgcaatgtggggatgtgtataatcttacagccaagatcatattccagaccagcagtatcagcataacccaagaacttattagaaatgaagaatctcaggcctgctgagtcagaatgtgcagcttcgaccagccccccactgatttattcggggaagagaacttcttatctggactgaacatgacattaaatgtgtttcgcaaaattacctgtcctagatatttctccatcctttttttctctggttatattcgaaaaagaatctttctcatcacttgtggcctgaatggaatttgaaacaaaataataaataaggtatgtttcataggctatacgtttactagctcacaatataaatgagagtttcattaccttcaaggctggttttttctgagaagacactgaaaagcaaaagggatacataatcactcatatgtaactatgacaaagttatccatacattcatgcagtgtttgtatcaacctctgtcctcctgcctgtattagcgtaggttttgatggcttctactttgtgtctggggattagaacatgacagaaatacactgagaaaaggaaacacaggctccgtgaaatatacccctgcaatttcaaacatggtatgatttctcatacgtcgaaaactaaaatcaaaggttgtcaacatcaatgtccatatgccgagtgatgaggacaaatgtgatctaaaatcagaggagaaactcatacacctgagaatgaatgtcaaagcaggtgctacatgatcccacatgtctttcatgcaacaaatcaaaaggatttacaccattataatacaaacatgcatcatgctctttaacttgcccaatatctaagaaagcacacaattatgatgacacttcagttgaacgtacacttcacatctcttcactggtaatgtcctaaattaatcaccttggatatctggttgctgatacctagtagataatattcattatctctcacacccatgtggtgtaataatttgcctaagtatcttgtatccactagtttatccctctgaaaatttcttcatccagtcgtgacaccaaaggataatatactagcctcaataaaaatatcatctattatcaattttgacatacttctacaaataaatctgctacaagcattagatattaatcactttttcattcagaaatcactgcaatattcattgaaaatgaccattttaggagttagttagaattcaacataatttttgtttctaaaatagccttcttgggagtatcatgttagtctgtaaagatgtttcgtgaaatagctattttatccaagaggtagctccttcaacaaggaagccaatgtattcatattcaagtttatctcatttctataactaaaatcaacaaaacatgtatctctgatgcctaatagtaacaaaaaggagtaatgagtcagtgtgctttatcccaattctagcattgtttcctgcttccaatagttcctggagctgccaaaatctaatattttttaaggacatattccaaatgcatgtgaagtgagttcactcagatttcctcagcagaaaaccctaaattatataaataacttctcttccctccttcctgcctgacaatccctcgtccttgggaaaataattgctacatcaggggtctccttagttctcattctacagtgtttatgggttattactatcagttttctgtcttttcttcgcagtacgatgtgacgtctgtaaaatctatacttcctctctttctccttccacccttagtgaaaccatgctgtagaattaaagcaaaactatgctgctccccagagccccttatgtcttgaacctctctccaatatttcttcttcccaatttcaatgtggggaagtgtataatcttactgcgaagatcacgttccaagccagcagcattagcgtcacccaataatttattacaaatgaagactctcagacctgctggatcagaatgtgcagcttcagcgagccccccacccgccctgcgctgatttattaggggtagagaagttcgtttctatctggattgaacatgacattgaatgtgttttgcaaaattacctgtcccagatttttctccatcctttatttctgtggctatattagaaacagaaccttcctcgtcagttgtagcctgaatggaatttgaaagaaaataataaataaataaataaatgaagtatgtttcatagactatagatttactagttcacaacataaatgagagttcaattaccttcaaggcttgttgtttctgagaagacactgaaaagcaaaagggatacataatcactcatatgtaaatatgatacattttccatacattcatgcggtgttagcatcaagctgtatccgcctgcctgtattagtgtaggctttgatgttttctactttatgtcttaagccaggagcatgacacaaatatactaaagaaaacagaaatagatgtgtcacgatacattcctaactatttcaaacataatatgatttctcgtatatctaaaagaaaaataaatcagtgtcaatatcaaaaagggtatgccaagtgatcatgacaaatgcgatcaaaaatcagagaggaaactcaatcacctgggaaaatgtcaaagcaggtggcacatgcacccacatgtcttttatgcaagatatccaaatgatttacaccattatactgcaaacattcatcatcttcattaacttgcccagtaactgagaaggtacacaattacagtgacacttcagttgaatgtacacgtcatgtctctgtctcttcagtgaagtgtcctaaattgatcagcttggatatatgtttcctgaatccgagtaaataatattcattatttctcatatccatgtggtgcaacaatttgcctaagtttcctgtattctctagtttagccttcccggacatttcttcatccactcatggcaacaaagtataatatataaacctcaataaaaagcatcatcaattatcaattttgacatacttctactaaataaaactgctaaaagcattggatattaataagcttttatatttggaaatcactccaatattcattgaaaatgaccattttaagagtcagttgatgaactcaacattatatttgtttttaaaattgtcttgttaggaggatcatactattctctaaataatattcattaaatagctattttatccatgagatagctctttgatgaaagaagccaatgtattgatattcaagtttatctaatttttataacaaaaatcaacaaaagatatatatcttatgcctaatagtagcaaagagaagtaatttgtcaatgtggtttatcccaattctagctttctttgcttcatccagtagttcctggagctgccaaaatcaaatcttttttgtgtaaatatgctaaatgcatccgaagtgagttcactcaggtctcctcagcagaaaccccaaaattacataaataacttcatcttttccctccttcctgcctcacaaccctcttccttgaggaaaataattgctacatcagtggtctcgttagttctcgttctacaatttttactggttattacgatcagttttccgtctgtttttatcaatacgatgtgacgtttgtaaaatctatacttcaactcattctccttccacccttggtgaaaacatgctgtagaattaaagcaaaattatgctgtcccctgagccccttatgtcttgatctgctctccaatgtttcttcttcccaatttcaatgtggggaagtctataatcttactgtgaagatcatgtccaagaccagcagcatcagcatcacccgagaacttattacagatgaagaatctctggcctgctgaatcagaatgtgcagctttgatgagcccccccactgatttatttggggaagagaagttcttttctatctggactgaacatgacattaaatgtgttttgcaaaattacctgtcccacattgtagtccatcctttatttctgtagctgtattcaaagcagaatctgtcttgtcacttgcagtctgaaagtaatttgaagcaaattatcaataaagaaagtatgtttcatggactatacagttactaatacaaaatataaatgagaatttaattacctttgaggctggttgtttctgagaagacactgaaaagcaaaagggatacataatcactcatatgtaaatatgataaagttatccatacattcatgaaatgttagcatcaagctgtatcttcctgcctgtattagtataggctttgatttttgtgtctggggactggaacatgacagaaatacactgaaaaaaaagaaatacaggtttcacaaaacaaacccttacaatgtcaatcatggtatgatttttcatatgtctaaaactaaaatgaaacagtgttagtatcaatgtgaatatgccgaatgatgaggacaaatgtgatctaaaatcagaggagcaactcatacacctgagaatcaatgtcaaagcaggtgctacatgatcctccatgtctttcatgcaaggtatcaaaaggatttacactagtatactacaaacattcatcatgctctttagcttgcctgataactgagaaagtacacaattacaatgacacttcagatgaatgtacacttcacgtctcttaagtggaagggacctaaattgatcagcttggatatatggttggtgaatcctagtagatagtattcattatttataatacccatgtggtgtaataatctgcctacatttcttgtatcctctagtttagccttcagaaattttcttcatccactaatggcaggaaggtataatatataaacctcatctaaaagtacaataaattacacatatttatacaaaatgcaatggctcctggcattagatattaataagcttttacatttggctatcagtccaatattcattgaaaataaccattttaggattcaattaatacatttaacattatttttgtctgcaaaattagtctactctggaatatcattgtattataaagaattttcactaaatagctattttaatgaaaaagcattcggaaaatgctttggaaaaaagctttggaaaaaagctaatatagtcatattaaattttaactcatttgaataactaataaaaaatatatgtctgatgtctgatactaataaacaggaatgaggcactgtggtttatcccaactctagcactccttcctgattccggtagtcatcggagcagtcagaaatcaaatcttctggtatgcaaacattctaaatgcatctgaggtgagttcactcaggtttcctcagcagaaaccccaaaattacagaaataacttcttccttcccctctttcttgccttgcaatccctctttcttgatgaaaatagttactacatcagtggtcactttgtttctcattctccagtgtctacgggttattatgacaacttcctccctctggttttagcagtaccatctgacatctataatttctgttacttcttctctttctccttcccctctccatagaaacatgctctgaaataagagaaaaattatgctgtcccctgatcctcttatgtcttcaactgttttccaatggttcttctatccaatttcaatgtagggaactctataagcttgttactaagatcatgaccaaggaccagcagcatcagcaccacctgacaacttactagaaatgcacaatctcaggcctgctgaatcagaaagtgcattttcaatgacaccccactgatctattcaggggtgggacgttctcttctgtcttgagtgcacatgacattaaatgtgtattgccaaattacctgttccagatttcccaccgcccattattcttgtggcaatattcaaaagagaaactttctttttaaatataacctgaatggaaagagaaacaaaatagtcaatacataatatatatttcataggctatgcaataaataattcaaaatataaatgaaagagtaactaccttctgggccgattgtttctgaggagacactgaaaagtaaaagaaatatataattcatcatatgtaaatatgacaaagtcgtccatacattcatgcagtgttagcatcaagctgtatcctcccgcctgcactagtgtaggatttgatgttttacagtttgtgtctttgggacgggaacatgaggaaatacactgaagaaaataggaatacacgcttccagaaaatatacagtcagaaattacaaagaggtattatgcatcatgtgtgtattactgaaataaaaagtgtcaatatcaatgtggatatgctgaatgatgaaaagaaatgtgatctaaaatcagaggagcaactcatacacccaggaatcaatgtcaaagaaggtactaaatgctactgcatgtttttcatgcaagacatcagagggatttataccattatgctgcaagtattcatcacgctctttaacttgcctggtaattgagcaggtacacaatgacaatgacactttagtagaatgtacacttcacaagtcctcggtggaagtggcccagcttcaacagcttggatataggttgggataatcctgtatataatattctttatttctcaaacccatgtggtgtaataatgtgcctacatttgttgtgtcctctagtttaggctacagaaaggttcttcatccactcgtggcaacaaatataatacataaaccttatcaaaaagtataataaatgatcaaatttgacatacttatacaaaataaagttgctacaagcattagatatgaataacctttgacatttggaaatccctccaatattcattgaaaataagaattttaaaagtcaattaatgaattcaccattatttttttttctaaaatagtctggtataaaatatcatgttattctctaaagcattttcattaaattgctatttttatccaaaagttagctaattgaaaagcaaagccaatatacgcatattcatgtttatctcatttgaataactaatatcaacaaaacgtatatctctgatgcccaacagtaacaaagaggagtaatgagtcactgtggtttatcccagttctagtactccttcctgcttccactgtttcctaaagcagccaaaatcaaagcttcttttacaaaaatgttcgaatatgcaactgaactcaggtttcctcagaagaaaccccaaaattacataaataacttcttattttccctccttcctgcctgataatcctcttccttgaggaaagtcattgctacatcagtggtctccttagctctcgttctacagtgtttatgggctattaccataatttctccatctgtttttagcaatacgatgtgatgtctgtaaaatctatacttcatctctttctccttcctcccttggtgaaaacatgctgtagaattaatgcaaaattatgctgtcccctgactccttatgtctttaatggctctccaacgtttcttcttcccaatttcaatgtgaggaagtctataatcttactgcaaagatcatgtcgaagaccagcagcatcagtgtcacctgagaactgaggaatctcaggcctgctgaatcagaatgtgcagcttcaatgaatcccccgctgatttattcggggaagagaagtacttttctatcttgactgaacatgacattaaatgtgttttgcaaaattacctgtcccagattgttgtccctcctttatttctgtggctatatttgaaacagaatctttctcgtcacttgtagcctgaatgggatttgaaacaaaataatcaatatgtaaagtaggtttcatagactatacggttaatagttcaacatataaatgagactttaattaccttctcagctggttgtttctgagaagacactgaaaagcaaaagggaaacataatcactcacatgtacatatgataaatttatccatacattccatgcagtgttagcatcaagctgtatcttcctgcctgtactagtgtaggctttgatgttttctactttttgtctggagactggaacatgacagaaatacactgaaaaaaaaggaatacaggcttcacaaaatatacccttacaatttcaaacatggtatgattcgtgatacatctaaaactaaaataaaaccgtgtcaatatcaatgtggatatgccgagtgatgaggacaaatcagaggagtaactcacacacctgagaatcaatgtcaaagcaggtggtacatgatccctcatgtctttcttgcaagaaatcagaaggatttacaccattatactacagatgttcattatgccctttaacttgcccaataactagaaggtacacaattacgatgacaattcagttaaatgtacacttcacgtctcttcggtggaaatgtcctaaattgatcaccttggatatatgtttcctgagatctagtagataatattcattatttctcacacccatgtggtataataatttgcctaagtttcttgtatccactagtttagctttctgaaagtttcttcatccactcatggcaacaaacgataatgtattagcctcaataaaaatatcaattaccaatgttaacatacttctacaaagtaaaactgctacaagcattagatattaataagttttacattcagaaatcactccaatattcattgaaaatcaccactttaggagttaattagaattcaacatcatttttgtttctaaaatagccttgctgggagtatcatgttagtctctaaggaagtttcattaagtagctattttatccaagagtaagctccttgaacaaggaagccaatgtattcatatgcaagtttatctcatttttataagtaaagtcaacaaaacatgtatctctgatgcctaatagtaacaaagaggagtaatgagtcactgtggtttatcccaattctagcactgtttcctgcttccagtagttctcagagcagccaaaatcaaatcttcttttatgcaaatattccaaatgcatctgaaatgagttcactcaggtttcctcagcagaaaacccaaaattacataaataccttcttctttttcctccttcctgcctcacaatccctcttccttgaggaaaataattgctgcatcagtggtcttcttagctctcattctacagtgtttatggagttattaggatcacttttccctctgttgataacaatatgatatgatgcctataatatctattacttcatctcattctctttcccctcttgatggaaacatgctgtaaaattaaagtaaaattatgctgctcccttagcctggtatgtgttgaactgctctccaatgtttcttcttcccaatttcaatgtaaggaagcctacaatcttactactcagatcatgaccaaggaccagcagtatcagagtcacctgagaactcactacaaatgaagaatctcaggtgtactgaatcagaacgtgcagcttatatgaactccccactgatttatttggggaagggaatttctcttctatcttgattgaacatgacattagatgtgttttgcaaaattacctgtcccagatataggtccctcctttatttctgtggctatatttgaaacagaatctttgtcgtcacttgtagcctgaatgggatttgaaacaaaataatcaatatgtaaagtaggtttcatagactatacagttaatagttcaacatataaatgagactttaattaccttctcagctcgttgtttctgaggagacactgaaaagcaaaagggatacataatcaatcatatgtaaatatgataatgttatccatacattaatgcatggatagcatgttagcatcaagttttgtactcctgcctgtattactgtaggctttgatattttatactttgtttcttgggactaaacatgaaggaaatacactgaagaaaataggaatacaggcttcaagaaatatacactgacaatttcaaatgtgatatgactttctccatatgtctaaaactaaaataaaaccatgtcaatatcaatgtggatatgctgagtgatgaggacaaatgtgatctaaaatcagagtccaactcatacacctgggaatcagcgtcaaagcaggtgatacatgcacccacatgtctttcatgcaagatatcagaatgatttggaatattttactgcaaacattcatcatgctttttaacttgattgatcagtgagaaggtacacaattataatgacactttagttgaaatctcttcagtggaagtgtcctaacttaatcagcttggatatatgtttggtgaattctagtatgtaatattcattatttctcacacccatatggtgtaataatgtgcctacatctcttgtatcttctagtttagccttccaaaagttccttcatccactcattgcaacaaggtataatatataaacttcatcaaaaagtgtaataaattaccaaatttgacatacttttacaaaataaagtttctacaagcattagatatgaataagcttttacatctggaaatcactccaatattccttgaaaataaccatttgggagtcaagtaatgaattcaacattattttcacttctaaaatagtctggttaaagtatcatgttattctctagagaatttttattaagttgctattttatccaatagctccttgaaaaacaaagccaatgtatgcatattcacatttatctcatttgaataaccaatatcaacaaaacatatacctctggtgcccaatggtaacaaagaggagcaatgagtcactgtggcttatcccaattctatcactctttcctgcttccagtagttcctggagcagccaaaaatcaaatcatccctcatgcaaatattctaaatgcatctgaagtgagttcacttaatctaagagttataatttaaaaaatcattttatttatactcatgaagactcctgatgtttttacatttcctggattcagcagttctaccttctcactgtctcttcgtccacttttgcaaaaacatacacatcaatgaaatactgtgtaatcagattcctatgaaaataaactaaacaaagtttctaaatcactagagacttcttttcttataaataaccaaccaatatgacataatacatatatatacatatgtcatgattgtcatgattattggcagttatctgtttagtactctaaaaatgcattctttgattccttttttttaaaatctagtttcacatgatataccatcagggtctctcaggttcttttacaaaataactacctcagcaaacacagctttccaaaaacaaaaacaaaaaacaaaaatctgatgtgaacgaagcatgtatcattgatgtccaaaacttctagggagaagaaatgagaccctgtgggttaccctcatccttgtaacttctgcttctgctttccattaagtgacttcccacaagtctcctcatcagaaacttccaaattacctcactagctgctttctttgtttacacctgcccaatttgacatacatttttttcgttcataaatctaatatccatattggtggacttgattctttgacctccacattcatttcttcattattttcaccaccactgtatgtgacatctgtacagtcccattctgacacatgtgaagataaggttttgctttattaaaatgttaaatgtgtcagacacttgactaatgtgtacaaattccttcttcacaaaagcagccccatggcctcctctctcccatagacactctttcacagctgttcttcactcacatcggtttgagtatctatcatctcttattttgtcgctatgctttcacctcatattatgagttattatcataggctcagcagcctatcttacctgttttcctctccagcagacagtactgagcaataaactaggattttccaggatatgaacacttttatgtacacaacactttgtggagctattttatgtttaactacccatagcaccactatgtttatgctttccagagaaataagctctgaaattttattgaatataacctatttaaaaacttatttaactacaatgacagtctctccttgatgcaccaaaatcttcagaaataacttgtgaagacttgaaaacatgtcagtaattgacatgaaaaatgaagcactgacataattttttgcaggtataaaaaagacaagctgagatccttactagatccaagaagagcaaagtacgttagacaggaaataaatatggaacacaaatattttcacttgtaatgaaaattcctctatttacagttttcagaagagaaaaaaatacacacacacacacacacacacattcacacacaaaaaccagagcaatatggctttacggggtgtttcttcatcaaagtcctatttgccatttgacatctgggaacactctatagggatcaacaaaggggttctaaattgtgatctgagtagtttagagtttaacattcatgaaggggagccaagaggacaagtaacactttgaccatcggccatttcctctccttactgtcattctctgaaaagcacacactggattttctcagggtcatgacatgtcaaaaagacatgctttaagggggaaacagttgcaatcaacatagccatgggagagatgcagctatgcttgctaggatttccaatacttctgtttcatttctaatataatacaaatcaataaaagcaaccacataagcatatccatgctggtatgtcaccatatttatgtccatatggtatcaacatgaagagagcataattaaatatgctgccatcatcacatggcatatcattagatcatacaataaatcaaatacctcactgggtcaacatggatagatctgaaatatatatcactgattttacaaagaccaagttgcagtcattttgtgcactgtctgaacttttctacaaggttttaatacacaaaatcaagttctacatgttatctaggaatatgcacatatgttgtaagaggtttttaatgtgcatttgggtgatttcttttgctttttttaaaaaaaaatttaattcaagttcttggttacatgtcgtcaataagttttagtagtatagagaaccctaagaccataacagctcagaatgactgtcttaaaggctatgtctaccaaagagtcaggatagcatgactacttactttcttcatttttaaaactcagaggtaccccacacacactcccaaataaaactgcacacaagttctttagtttaattagatcccatttgtcaattttggcttttgttgacattgcttttggtgttttagtcatgaagtatttgcccatgcctatgtcctgaatggtactgcctaggttttcatccagggtttttatacattgagaacttaattttaagtctttaatgcaccttgagttaatttttgtataaagtgtaaggaaggggtccagtctcagtttcctgcataaggctagccagttttcccaacaccatttattaaatagggaatcctttccccattgcttttgtcaggtttgtcaaagatcagatggtgtaggtgtatggcattatttctgaggcctctgttctgttccattggtctatatatctcttttggtaccagtaccatgctgttttcattactgtagccttgtagtatagtttgaatcaggtagcatgatgcctccagctttgttctttttgcttaggattgtcttggctatatgggctctttttttggttccatatgaaatttaaagtagttttttctaattctgtgaagaaagtcaatggtagcttgatgggtatagcattgaacctacaaattactttgggcagtatggccattttcaagatattgattcttcctaaccatgagcatggaatgtttttccatttgtttgtctcttatttccttgagtggtggtttgtagttctccttaaagaggtccttcaaatcccttgtgagttgtattccttgttattttattctctttgtagcaattgtgtatcggatttcactcatgatttagcactctattactggtgtataggaatgcttgtgaattttgcacattgactttgtatcctgagactatgaggaagttgcttatcagctgaaggagatttggggctgagacaatttggttttctaaatatacaattatgtcatctgcaaacagagacaatttgacttcctttcttcctatttgaataccgtttatttctttctcttgcctgattaccctggccagaacttccaatactatgatcagagtgaacaggcaacctacagaatgggaggaaatgtttgcaatctgtccacctgaaaaaggcctaatatctagaatctacaaggaacttaaataaatttacaagaaaagaacaaacaatctcatcaaaaagtgggcaaaggatatgaacagacacttctcaaaagaatacatttatgcagccaacaaacatctgaaaaaaagctcatcatcactgatcattagagaaatgcaaatcaaaaccacaatgagataacatctcatgccatttagaaaggcaatcgttaaaaggtcaggaaacaacagatgctggagcagatgtggagaaataggaatgcttttacactgttggtgggagtgtcaattagttcaaccattgtggaagacagtgtggtgattcctcaaggatctagaaccggaaataccatttgagccagtaatctcattactgggcatatactcggggtgtgtgtgtgtgtgtgtgtgtgtgtatatatatatatgtacagtggcttgttcctataatctcagctactcagaaggctgaggcagaagtatcacttgagaagcccaggagtttgagaacagactgggcaacatagcaagactctttattaaaaaaaaatcatacaggctgggcacagtggctcatggctgtgatctcagcattttgggaggccaaggcgggtggatcacacgaggtcaaaagtttgagaccagcctggccaaacatggtgaaaccccatctcaacaaaaatacaaaaaaaaaaaattagctgagtgcggtggcacacgtatgtaatcccagctactcgggaggctgagacaggagaatcgctcaaactcaggaggcagaggttgcagtgagccgagattgtgccattccactccagcctgggtgacaaagtgagacttcatctcaaaagaaaaaaaaatcatgaacttttgtacatgccttagaccttataggaaaaaaagtataagactttgatgctttattacagagactctcatgatttgttacaaagcagttctttagaaacatacttggaggctatactaaaattattatttatactatttgtaggcaactaatgaattaagaactcttatttcctttcttacgtgcttagcatgtacttatcaaatgcaaagaagaatatattatcaaaatttggtttatcttacatgtgaattgcagtataaaatagtcataattctaacagaattatatcagactgacagaaaatggcatcattagtagaatcaatataatgagtaggcattgtcaaagaacatgatttctggacaaatgaaccaggtgcagctagaacagcagtcccccttatctgctgtatgtgtagaaaacacatattcaacatgatgttcctcttctctcacaccgcaacaacaatcatcagcacagaagatttctgtgaccaaatatgtatttttccccagcaacaagcaaacaatcaattcctatgggtgccctgtaattctggcactatctacttggggattgtgtcagatcccacaggttgagggctcagtaccacaggctattcccccacagcagttacaagtctgggcctccagaacttctaatcaacttccagttggacttcaagttgggtttcccaggaccccctctttggtttgattaatttactagagtggctcagagaactcatggaaacacatttaccagttttttataaagaatattaaaggatacagataaagagatgcatagtgcaagatacggggggaaagtaacatgcttccatgtcctcccagggcactcaccctctgggaacatccatgtattctccatatgccttcatgtattggagagcatccaggtagctgaatacagctacctggatgctctccaaatccaatccttttgggattttatgaaagcttcattacataggcatgactgattaattgaacattcagcccctctcacatcccaggaggtgaggggtggggctggaagtcccaaccctctaatcacaccctgatcactatgatgatgagccccaccctgaagccatctggaggctgcctgtcataagtcaatcattagcatacaaatgatatcatgttggaaattctgaggattttaggagttgtatgacagaaaatggggttgaagaccaaatatatatttcataatatgacattggtggttttattgactgcagattcagttacccatggtcaaccatggtccataaataaaatttatgtatacacatcataaggtttaaattgcctaagattctgagtagtatgacaaaatttgagcccttacatcccagtctgcccaagatgtgaatcgtccctttgtcaagtgcatacacattatatatgatatctgctcactagtcattgacataaatctgtacctaacatccaaccaacaatatcatcatggttcacggatccaagatcacgtgaagcagatgatcttctttctgatatatagtcaaatagaaggtcaatagtagcctaagactacatggcaatgcctactgcatttgcctcacttatcacatagccattttatcatctcacatcagtgcagaaagtagggtgactatagtacatgatattttgtgagctcacattcacataacttttattacagtatattgttacaattgatctactttaccattagatattattaatctcttattgtgcctaatttatgcattaaattttattatagatatatatgtatttttaaaaattattgtacacatagagttcagcactattcatgttttcaggcattcactaagggtcttgaaatgtatcccccatgtgtaagaggaaattactgtacttattttgttgaaacacaacagtttctccacctcttcagtttaaactatttaggataaagcactctaattcaaaaaatctaggtctatgaaaactgtactctattctatggcaaaacacaggatacagagtagggtcaaggatccctgcaaagacttttcagctgccaatgcagaagagcctaagagagatcagtgtccttactctcactaatcctctcctagggaagattctggtaagtttgcttagttctagctattcattcaccctatgtaaggtacaaacaatccttaaattcagctttcatttttagctccttcaaaaaaacacaaacagagaaaatatcactcccttaacagcttatccaatctgagtgttgtttccttgtcagagagaagcttataaagaaatactgggaatggtatggcaagttgccagggagtactttctaatatataaaatatatataaaggaaccataaactcactggagctaccaagatgtgccaacagttgtctcactacctagtgggaaaaacaacaacaacaacaacaaatctttgtcactatatgtaaacaaaaatagtatgactctcttggcatttttcatgatggagaacctagttataagtgagtcatgttataataatatagactgttttcaaagtgatcgctcaaagaaagaaggtgaataagaaacatatttgtatgcctatagtattcactagctggtctatttccaactgcaaggtaaataggaaagactttctgactccagttttataaagtacaacctcttgagattgtccctttccactgctagtctatctggacccatctcacagaaaaggatgatccagttagtgctgtgtagtacacagcatgaagtcattttcctcaaccctccccattatgtggcaaatgtctatataaattatgctttttcaacatgtaaagcatatgccattaaatcctacattaataaactaaaagcaaaaaagcacaatggatagcttaattgaatacattcaattatcttggaaattatgttttgtaatattgaaaaagatatccactatgttatccttaatatatgactatgctggacatatcaaaactatggggacagcaaaaatattagtagttgacaggggttaattgtgagggaggaataaaaaaagagacaaatttcagggcagtgtaagtattctaatggcgggtacatttattatacatttgtccagctttatagaaggtacaataccaagagggaacttaaatataaactatggactttggatgattatgatgcatcaatgtaagcttctcagttgtaacaaatgtaccactcaggtgggagatgttgaaaatggggggagctatgaacgtgaggggggatggcgtatgtgaaaaatctctttaggttcttttcaatattgctgagaatattaaactgctcttaaaataaagttgttaattttttaaaaagattttcactgaatcttctattactaatatattgctatattatattaccatatattatagcaagacgtactcaatttgaaacacaatataaatattctctccagaattatagtatataaaagcacataaagcaaataacttaactgtattaacaggcaagaaaataactgataaatgattgatttttttaatttcataattataaacagaaatttaacaaaatataaaacaaaactgaaccatctacataattaaaatgaaacaaattttttatttcaattttaaatgagaaatcattacttattttatctaaccattttactgaaaggttaatcgaataagaacagattataattacctaatattgccatagtaacttctgtacagagacctgttaaatattcaccaaaattccaaaatctaacagcacagaaacttagtatttcatattaagttgcaactgactcaaatgaaataagcaccatgctatgttatattaccatgttattcactatcaaatagaatttttaagacacctaaaattaagttggggctgtaactgctgtgaagaaaataattcatataacagtcataagactgtcattcttagaaaggcctacatgcaaaactggccatttgctggtgtttggaaatttgcattttaaaggtttgtcaccatttcctgagaaaagtagctcactgtacctaaactgtttgcataaacaatgtggttgactctgaacagctgcttttcttctggaagtgtggaatttttgtatatgtgtgagacagcatgcctatgtaactagcttccataagaaccttggatactgtgtaagtctctagtcagactcatactggtagacaatattgcccatgtgctgtcaaaatttgaagctacaggaattcagcacatcctggtaactccacaggagagggctcccggaagcttgtgcttggcttccccaagacttgccacatgcccctttgccctgagccaattttactttgtattctttcactgtaacaaatcaaagcccagagtaggactgtttgctgagtccttccaagtgaatcaccaaacacagaggtggtcttggaaactctgacatagtggcattatatgaaattagttttctttaaggtgatgtgacctgtgactacgatcagaaggctgtttataaaacacctttccctcatctgttttccttaacagttgcctttgagattcctgtatttctgcatgaataaatccataagggaacagaaataattatgccaaaaaatgatgaaaaacaagcagcaatcctattttaaccagaataaaaatttgagaatatggatgattaaaaatatatcccatagtatgaaagcttctagaagagaaacaaaaagatcacagccaattgtcttcaactcaccaaggtttcttttataataattggggatcaggccaggtgcaatgacacgcacctgtagtcccaactactccaacggctgaggcaggaagattgcttgagatcaaaagtttgaggctgcagtggagattgtgcctgtgaacaaccattgcactccagcctgggaaacagagtgagaccctgtctctaaaatgcattagtaggctgggggcggtgccttacacctataatccaaacactttgggaggctggggcgggcggatcacaaggtcaggagatggagaccatcctggctaacacagtgaaaccgcatctctactaaaaatataaaaattagctgggcgtggtggtgcatgcctgtagtcccagctacctgggaggctgaggcaggagaagcgtttgaacccaggaggcagagtttgcagtgagccgagattgcgccactgcactccagcctgggcaacagagcgagactcagtctcaaaaaaaaatctattaataaaaacataagtaaaataatttgcatcattcaggtcattgtgataattatagaaatatatgtagccattggatataatacttactatcaatcatagagctcatttaatttgtttctaatcttttttcttaagttcttataaaactaaaaatatctataaaaactaaaaatcatctgttaagggccgttcttcatagaacaggtcaaaaagtcaaaaactgcatttaaaatgtaggatgagttatccacttctcctcccaaacagtgggtttttcttattaagggccaataggactttaaactccctttggagaataaaggaagttatagaccagcacgatggctcatgaccataattccagcactttgggaggctgaggcaggaggatcacttgaagccaaaagtttgagactggcctgggcaaaagagagagacctttgtctttaaaaaataaaaaataaaaaagttagcttggtatggtggcatatacttgtagcagtctcaatgacttaggaggccgaggtaggaggaccacctgaacccagaagtttgaggctgcagtgagctatgatcacactattgtactccagcctgggaaacagcaaaagactcaatctcaaaaaaaaaaaaaaatcaagaaacttatatatagatggttaaaggtgtggtaatccaactgaccaaatattccagctaagtaacagattaccaatatttgaagaaatataataccagaaaagtgttttacattaaaactatgtcgtttgaaaatttagaatttaaaatttaaaatttaaaaaaatttaaaagacaccttaagtgtcttaacttaatttgaaaatttaaaagacatttaaagtttgaaaatttaaaagaaacttaaaatcttaaaggagcagcatcacttacactgtcactgtgctaaagatataaagaagtttagcattaaagattaatagaataccagatatactttagaataggtagctaattctcttaaaagaaaatcctatatagttgtcaaaaatacctgtgttagaaatgtgttctaataatattttctttagggacgaaattaaaaaaaaaaacagtaaaagcagagatattacaagaggtcatgaaaagggaattgcactaaaacaaagtgtcccagaacacagagacttggtatacttagcatgtcaccttatatttttctccatgacattatataaaagacgtcagcttctccaaactgctcgtctgtaggctacttctttttttttttttttatacttttagagtacatgtgcacaaagtgcaggtttgttacatatgtatacatgtgccatattggtgtgctgcacccattaactcatcatttagcattaggtagatctcctaatgctatccctccccactccccccaccccacaacagtccccggtgggtgatgttccccttcctgtgtccatgtgttctcattgttcaattcccagctatgagtgacaacatgcggtgtttcgttttttgtccttgccataatttgctgagaatgatggtttccagcttcatccatgtccctacaaaggacatgaactcatcatttcttatggctgcatagtattccatggtgtatatgtgccacattttcttaatccagtctatcattgttggacatttgggttggttccatgtctttgctattgtgaatagctacaaaccactgctcaatgaaataaaagaggatacaaacaaatggaagaacattccatgctcatggataggaagaatcaatatcatgaaaatggccatactgcccaaggtaatttatagattcaatgccatccccatcaagctatcaatgactttcttcacagaattggaaaaaactactttaaagttcatatggaaccaaaaaagagcccacatcaccaagtcaatcctaagccaaaagaataaagctggaggcatcacgctacctgacttcaaactatactacaaggctagagtaaccaaaacagcatggtactggtaccgaaatggagatatagaccaatggaacagaacagagccatcagaaataatgctgcatgtctacaactatcgatctttgacaaacctgagaaaaacaagcaatggggaaaggattccctatttaataaatggtgctgggaaaactggctagccatatgtagaaagctgaaactggatcccttccttacatcttatacaaaaattaattcaagatggattaaagacttacatgttagacctaaaaccataaaaaccctaaaagaaaacctaggcaataccattcaggacataggcatgggcaaggacttcatgtctaaaacaccaaaagcaatggcaacaaaagccaaaattgacacatgggatctaattaaactaaagagcttctgcacagcaaaagaaactaccatcagagtgaacaggcaacctacggaatgggagaaaatttttgcaacttactcatctgacaaagggctaatatccagaatctacaaagagctcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacagtgagataccatctcacaccagttagaatggcaatcattaaaacgtcaggaaacaacaggtgctggagaggatgtggagaaataggaacacttttacactgttggtgggactgtaaactagttcaaccattgtggaagtcagtgtggcgattcctcagggatctagaactagaaatagcatttgacccagccatcccgttactgggtatacacccaaaggattataaatcatgctgctataaagacacatgcacatgtctgtagactacttctgattgaaacttgaaactctcgaaatgcggctgtgttatgattccatgttggagagagtcgggatgtatgtgctttggacaaggtggttccagttactgctgccagacttttgtttcagaatgcatccagaagaacttatcagggatttcagtacaaactaagtatttccacaaggagcagataagaagaccacagtttttctcacacattacccttaggttttgacaattctgtaaaagtgtgggcacatgtactcagaagtcaagaccattttccctgaccctgtgcacgtagcttctgcagttacaaaagggttacgcaggatcttggtagatttgttcctccatatttggacaacagacataccaatcacatcaatagcccacattacacctcaaaaatggttcttttgaaaagggtaccgccaaagagcttttaaaagttaaatctaattggcttttgagtaatcttacttgttagaattcatactccctccttaaaattctcactttttttatttttgcaacatcacttcctctgactcctctcctacttttctctagccactgctcattctccttcaccaactctttttttcctgggggtggggagggaaagttgacattcccagggttttgtcacaggatagcttctcattctacatctgcatcatggacagctcattgagatcgatgactttgcctaataattataataacatcattctacgtctgcatctccaacctcagatttggagggaagggaagttattcttccctgttgaccagctgtacttctccattcagtgaacacgtcctactcctttcttgtgtgcagtataaaggccagtacacaacctggaaacctatgaatgatccaagatttctctctccccactaatgttttacattcaatgttcactaaatcatattaactgtacctcttttctgcttctgctttatatttctactgccaccaaataaatatgtttatatttcctagatcaacatggcctcttcactgatggttttcacaggaaaagatccctatcaactattattgtttttttataaataaaaaattaagtaaaacaaataaagaaggcatacaggcaagaaaaagaccaacattttaaaatgagtaaatggagtaaatttactttattttaccgtggatgggtgaacaccttacactagattgatagtagttcaagcatcgaactacaaggaaactacagctttaactactgcaaaatcttcctttctctagcttactttcttgtactcagaatacaatatataatatatataacataccaaatatgtattttcaacagcatggggattggcagcactaaatcccatgttgttcaagggccaactgtaattattgattcatttagtaattgcaaagaatttattttacaaattaaatagaagttctaattatataaaaagtctaattcattatcatgtgactattaaaaaaatacaacataataacttaaaaatttgttttcttatttacacaaaaaggtcatctagaatactaggaacgataattaaataataatttttttcaaacaatactgagattataaattacctacaattaactttttaaataattataaaatctagactactaagtattttttaaatgtgtacaatttaaagtgatttttttaaactgcttttttgtaatcaaaacatctttattcttttttatctatggtagtaccatcaagagtaattcactatcagaaatctcacctggattgctatttataggaagatcttcatatctctttcttttgtattcataaattagatcaaaaatgctatgcataaaaataaatgaaattaatattttaatactattatcaaaaacatttaccaaatatactaaattattagagtatcttgaacaatatcaggatgttaattatcctatacacttctcttttgtaagctctacaaacttcttagtacctttctaattaaataataaaaacaggtgaagtactcatgaagtgaaggcagtatagctcagcaaactatctcacatcagcttgacataatggaaagtcaccttcctggctcttactggaaggtcctggctctatagccaacaggtatttgctcttaaacaagttgcttctcttaggcacaatgtcttcttctagattttactaccttctttcactaggttgttatataggtttaatgaagcagcatttttaacattcacagagaaatagtaaagcagtggagcttgttcttgaactttatcgctgaaactattttgaaatcccaaatcaaacccaatgtgtattttttcataggttctaatattcaaatgcttcagtttaagaaaaatgttaagtcctaattttgcttattgttctattatttctggcttataattcagtgtatctcaactatttcataattcataaataaattaatttatgaatatattatttcattaaaataggtaacacgattgttaactattattgagctcatcaattccaagggcagaaaactaacagatgtcaagatctggcttgggctaccactattacttctctacagactctaactgaatgagcagatgtttgctagaatgatggttcatctccatcagtgatgttatctccaactgacatggaagacaaaaccctactttcattttttttaagttccatgaagtagatgcaagttgacattttctcatttccaagatacatactaacaaaatatttacacaacaccccatgtgttacttatctccattctcagtttatagatcaccttacacaaatgtttttgtagtgaaaaatcacaattctaatataaggggccacccattttgttttgattcaaactatgacttagctagccagcaaacagtcaaatgaccttcccgtgactgcaaaatatgaaatgcttcaccatgctaattttctccgtattgttccaattttagtatttgtgctgccaaagcaagcacaaagccttacttttacatataactgctgataagtcatggatgagggttagctctgttaaatctaactaacaaacttgagactcagataattccaatgaatggcttcctgtgaaatagaatccgaaaatattttataaacttgagatactgatgcaagcagcttgagagatcttcattattatagataacagatcacttgaggggccaaccacaagttgatgcctactactctaaggaaggatggcatagaagcttccactacctgagaaaagctcttacgctgtttatataaaaagtctcagggtacagatctggtagcaataaagaagaacactgtgatctctttctacaacattatttgaatatctctgacagtttagaactatcctaactaatatttgctttaaagagaaaaaaaagggactcaaaaaataactcaccatgaaggtctagaagcccaggttaaaatgtgggctttacatcaggttttgagtgtgggtgaaagtgtcaatttgctccgtatgtgtgttgataaagttagaatatccagctaacagagcaaggttctgctgttttggaaacaatggctgagcatataagtatgtgcaactgaactaaaaaaaacagttgtaactttgaagcctttttatggatcaacatgaagattgagggatctcaaacagaaagggcatgctggtagcaaaggttaatcactaccagactgcaagagtactttcaatggtaagaaagcagcaacagaatcaatgaaaacaaagcaatgattagaatgtcctttccccttctccttctgacttgtagacactgattgtcttccttggacttagggaaccccttaggttcttgaaaaattccatgatcaggctatagtagatggtccccagtacacaactcaaggttttttgataaactggacattttgagacccaaataactaattagaaaaatcaaagatgtgaaactactttaccctatgcataggggttatactggaaataaaatggacaacattggaatccctaaggagaaaagtcctgaaagtttcaatatcaagaatcttgcacctactgctacttatctagcctttttcttgatttctggctgatgaagttgcacaactctcgaaaacttaaaaacttgaaaatttgtcacttgaaaactacttgaaccaaactatgcaatctcacctgatatataagatgcaattgttacaattattttaaacttcaatttagtgttcattagcctttttacgtaaagacttacactctattctcagcctcactggcataatcttctgcaagctttccatacacatctcgagaaaacacatcaatattgtgctgcagaagaagaatgactatatctttttctccaagagtaacagcaagtatgagggctgatctaaaataacagagaggtaattaaaaactttaatgacattttaaaagctaagtttatatactttatcaacttaacatgttgcctgtccatgtagaattaacccaattacatgtactaagaaacaagcatcttgggtgctcaagggtttatctttgcaagttaccacaaaggttaaaagcaaggaacaaaaaggaagcctcttgtcccactgtggtatgacataaagttgctaacttaaagtcctttgatgggcaagaaatatgctcaggccacctatctacagtaggcaaatttaagtgaaaaattattcatttcttccctagtctgatactatacattataatgcaaaatcagctgaagggtcagataagagctatctgcaggcttaaaacaataatattaataggaatgctaatagtagtagtcatagcttcagttaatgatgctcataagcatgtgctaggcatttaattaaacactatatatatatatatatggaggataataatatatccttcaagggtggttgtgtataagtaatatcacatatatataaaatatatatagtatattatatataatctataaaatatataatatatagtatattatatattatctataaatatatattgtatatattatatattatatatgatgttagttacattatattcttacatacatatgtgtgtatatatattatatgcacatacttatatgctcagccattgtttccaaaacatcagcaccttgctctgttagctggacattctaacattatatatatataatgttacttacacacaaccacccttgaaggatatattattaccctccttttcacagaagaaaacatacttggtaagtaatgttaccaaggtcacacatctagcaagtgggaaagctagggattaaacccagtcctgtgtgaacctaaagcttgtcttcattgaagtaaagttttatccatctaaagctatcttttttccccctccccatatcaattaaaaacaacatcaaaacacagtagaaatgaaaaactaacatgaaacccctttagctaatgtaagatcatacaatcaaaagcatcacattattacattgtaaataacaccacatcatcttacaaataacaaacatctatcaatatacagagctttctatatatagaagccttttatgtgtataatgtctatagagagagatgaatcctgctatacactgttctttatgttactcagtccaaataattgtttttctacctaagtgatgatctgtgttgatatttctcactatatcccagtaattaaaagttagtcttcttactaatgtaatatttgtgacttgagtgactgctaccactctaaaatgacactcaggtttaaaaacaacacaataagaactaaggtctgtacctgccaagataatcaatggcatttacatttgcttttttctttaataaaaattccaccattttcacttttcttcgactcacagcaagtaacagtggctgatattcattctgtaaaataacagcaacaatttataatcacaaaattacatatttatcaactgaaatgaaaaccttatgtaagatcctgtgagcttcaatatatacaattgaaaggtcgtaagaggtagtccctttcttttccctcctcggtgcttttctatgttctgctccttcccctggaaacaacctcctctgcctcaccacaagaactctggtcatctccaaaactcacttcaaacatttcccagttccaagaatctttgcttctgtcccagcatttagcatggcatgtttcaaggatttaattgtttcccacctgaaccaagagcttcttgagggcagcagctgtatttttttctctatgtcctcaaactctaagacacagtaataaatgtttcaggtatttttattaatgatctaaattattatctatagagcggtgtttcttaaactattaatatattccaaaggatatttactttaccagaatttgaacattataccccaaaagagagactccatgatcacccatgtttgaaaaatgttacaaaactgtgcattatgtgtctagtatttgagaaatcttttgaacttcacctaatccctatttgtaaatacttattttggagaatgttaacatttgagaaatgagagtttcagggatacagttgtgagagcttaccagtaaaggtagaggtttcctctgggtgatacacacttgcctcattctcttctatcgatggtgtgagaatctcaggtgacaatgtcaggagctcctgagcacctgagcacctgacattgtcatctgagattctgacacgattgacagttcatttgaagcctatctctttttaattcggagagccgggctctgaattaatagagataggcttcgagtgaactttcactgcttattattaaatagtccatgggttttctctagtaatatttttatcttagctgtcagaaagctctgtatgaaatgttattctcaattacaatcttaggaccctgatgcaaatatttatgtaattataatcttaggaccctggtacataactcctttaaaaatctatttgtattctagtttccaattcattcttacctaacttattttattttaggtaaaatatcaatcagaaataaaaatacaatggcttatcaattaaagctctaataatgacctatatgaattatttatagcataatgaaaaccactaaattatttgcatcatttatttatttatttatttatttatttgagatggagtctcgctctgtcacccaggctggagtgcagtggtgccatctcggctcactgcaacctccgcctcccggattcaagcacgagaaattctcctgcctcagcctcccgagtagctgggactacaggcgtgtgccaccacacccagctaattttttgtatttgtagtagagagggggtttcaccgtgttagccaggatggtctcaatcttctgacctcgtgatctacctgcctctgcctcccaaagtgctaggattacaggcgtgagccactgcgctcggccaattacttgcatttttaggaggcaatgctgaagagaaaaatataatgttgtctgcaatatgcataacctatgcaactataccatgattcaccttaaaaagcttacatgcattctaatgggaagatgattatttatggtatgtataaatagtttataaaacaccaccatctaaattcaaaagttcaacccgattaccaaaggatttatataaaatatagactctacatttaaataaatataaaatgtcttgaaaaccttgaaatatttactaaaatatattataaaacagggcttgtaaagtcatccctacagaggcaagggagatgacctgaggaagtgaagtacctaggtaggcacagtagcaaaatggagaccacatgcctcatagaaaggggcaacctctgcacagcatccaaaacctgagataggctcaagggacaccagattggattcttgaagagaagcttggaatccagatctgtgcacgagtctcctaaaccttccatgttgagacaatttgtagacgcaaactaaacacatgtatgggacacatttggactatataccttgtatttttatatttgctatggatatgtctccaagcgattgtatgtaaagcaagtattttcatgtaaaatacttcctttctttagtttcagattttttttccaaaataggcccaagaatgcaataaaaattgttactaagagtcataatacccactttgagcacttttacaacattcattcatttataatttatgtttaattttcccagattgttcaccaaatggataattagttcataggactgctgcaactaaattattaaaataatattaaattataattctagtttctatattgtaacctaattttttttattttaggtaaaatataaatcagaaataaaaatacaatggcttatcaattaaagctctaataatgacctatatgtattctttgtattcttactaacttcatggttttcagtgtttaaaactgctatcctgattatgccacagttctatgtacttaactgacatactgaggcagtccataatagagcttcagctttaaaaaaaggtttagaattttttgctattgtaattgagagaaccccgcttttaataatgatgtattgacctaatcaccagaatgataacaaagagactcagagtcctgaaagagtcagtctctacttattaaaagagtccacaatagcaaatttctaatgaccctatgaatggcagtgaataagtgatggtggcaaagaaaaggtgttattcttatgctgatagatactgcaaataatagtcctttccacttcccaaccacagaggtagagacaggtaaaagtcaggccaatattattggaaaggagaaatttaaaggaagcagcacctatctccagctcttctagagattttttgtgtgtttgagatatgggaatttatattacacttatctattcagtggttcttaaccagcagcgtatcagtgtcccaagaaatgttttattgttgttgttgttgttgtgttgttgctgttagaggcagtgtcttaatctgttgctctggctagaggcaccaccatgcccagcttcaaggaaatattttaaaacatacatgcccagtaatatttaatagtaaatattagatttactatattaaaatcttcaggggatatcctagacttagagatttgcttttaatttccccaggttactgccatgcacaattctaactgcgaaccagcacagttgataatcacttcagtctcatttctcacccacgtggcaaattccctttatcgtttgggatttggccgaaaagaggaaagagcaaaagatagagccattcactgaagacttcatttacttttcctgggtaggggtagggaagagactagtaagctcaaaatccaacttgattttactatttataagctccgtatctcccacctgcccatcaagacattctggacttgagagtagagtttagatgcttatctgagtggctgtttctgccagaattgaataatgtccattaattatgtgttcttctctctgctgaactgtgtgccgcttcatcaccactattcactgccaacctggtttcctcagagtcttaccaaaattgatccctgggcaatttcacaactcacaaactctttcccaaagtaagaataatcatccccaaaactgaagcgatctttgtctaaacatataaattgaaaacaaacaacaaaacacacaaaaaccctctccacagtattttccctcattacctaatttccaaattagcttgtgcatttctgattgctctccttttcttcatttttccctcttaagcctttccacagaggaatcactttcaaatgaaatcaccttcacatacaacacttgtcaacagcaacaacatgtacatttattgtgaaattctttaattttctttgacatttaaaataaagcctatttataagggacaattttactttcctgtgtcacttcacactgattagaaaaaaagtaatttagtggaaaaacacttaactattacctttcccaaattcagttgtcatgaattataaatttattgtaattcatttgtttttatagttatttaccataagtgcatgaaaaaaggctgttccctataatgcttctttaaaagttccaatatttaaagtaaaatcttagacagttaaggcatttcaaaatattttcattcaaggaatgtttgagcttccaaatatgaaaaattgacccttacatgtgtcaatgttaaaataaatgcatttcagatagtttgaaaataacattggttgacctataccttgctgcattcttcaatatttgtaccatgtgaaagaagtttttctatcatggatgtatcttcattatacacagcgtagtgcagagcagtccttccaaagacatccgtaatatttggatcggcgccattttgcagcagaagagttgcacaagcctcctgcctcagttgtacagcctgtcagtattagaccgagaaacatgcaaatactgaaaaaatcaaaataaacactccgtaggatttcctactagttatatggtggtattccaatgagataaattcattttatcctatgtacttcaaccaaatccatctcatgctcaaagagtcagctactatgtaccttgatcagaggtgtcctgtcttcacggtcgcagaggttaagctcacatcttctggacaccaggagatgtaccatttccggttggccagtggcacaggccaaatgtagggcagtcctgtgagagtgacaggactttttaaaacatgtaactgtaagcattaattagcatgttatttctctgtcttcaaaacaaatatgtaattttcttgtgaagaaagtacaacatttgttagcgcttattactcaccacattaatgaaagagcaggctatttaatagaaaaggcttggcttttggattcagtttaattggggcttaaaatttactgtaagctctgtcacttagctgttatttagcctttctttgcttcaatttccttatcaataaaatatgtaagagaatagtagctagcccacagaacactgctgtgatgcttacataagaatctatgcacagcatttagaacactttctaacacaaataacagctcaataatttttagatatcactacttacaaagacaaagacattttaattaagtaaaatgatacaatcatatctacattgaggtatctattaaagattagatgtatcattgtatttcagtcattctcagatgctcattttctcactattctcttatataagctactattctcttatatattaacatctcctgacattggaaaactgtttacaattcattatttattacatttataactggcaacattttaaacattatcttatcgatatataaagtaatgtggcatcacccaatccgtgatgccttacattaagtgggatacagttcatagaacaggcagttctattcatataattggcacctaaatgaagtactgtggaaaaagaaggcaaaaataaaaaaacaaatttttaaaacaaagtaattcttacttcaactttcaaaaaaaaataatccaaagaaaactcaggattcaaatgaataggtatggctcatttttttcaatacttacagaatgttatgtaaattaggtatttgcaatgattaatagtagtatttgagactgtcataagtttttgaaatggcagttaaaggttatctttcactattttctaacttcagaattgcttttgtttaaaaaaaaaaaaaggaataaaagatccaactgggattcagtcctaatgcttccattttaaatctcagcttgctcaggctgggcaggtaaacatgaagttgttaagggtggaagagtcctgagagatggtggaatgtgtctgctacataataggtattcaggttatgcttgatgaataactggattgaaagaatgcatacatacagttgggaagtttattgtgaaaaaaactataaattaaagcagtgcttttggaatagtgataatcacttatatttgctcattttcattttcatgaggacactgataaactaaaataattaatttaaaattgtttccttatatgtaataaaactataataaaaacttatgtatatactaaaatctatgcataataaaataatcaagcacaaataaaaatattccctctgcctctgaagaggctaaaagttcacagaagataccaataaacaaaaaaataaaaataaggccaggcacagtggctcacacctgtaatcccagaactttgggaggccgaggcggggggatcacctgaggtcaggagtttgagaccagcctggtcaacatggtgaaaccccgtctttactaaaatatacaaaaattagctgggcatggtggcgcacacctgtaatcccagctactcaggaggctgaggtgggagaatcacttgaacctgagaggcagattgcagtgagctgagatcatgccactgcactgcaggctgggcgacagggtgagactccatctcaaaaataaacaaacaaacgaagaaattaataataaaatagaaactgagaattttttttctttgcaagatttatatttcttcttttcccaaggataatttcattaataaaaaacatttactagaagttttaaacatgctgatcatttatacatcacagataagaaaaaatatcacaatacacctgccagaaaagaagaaatgttatattttgtacacatatttggcttactaacaccatagattgtttgtgtgtatgtataatcaaaccaactttttttcagagtacatcttcacacctcaacatacatctgtatctactgacatctgcaaaggtcccatattgtcccatcctatggatgcactgaaatttattgataaatttataaaatttataaaatccactataaggggttttccaaatacactgctattttaagcagtgctgagaaaaacaaattgcatgtatctctatttcctagagatattttagtataacggaattgatgggtgaagggcacatacatttttacagtgtgatacttaccaacaaattgtctatttgaaaagtcatcagaaatgtaaactttcaacagcagtatatgtactgctaccctttaccctcacaaacttgtggatagaaaacagtatttcattctttttttaacttaaataccttctcctcccaggaacactaaatattttttcccatgtgcataggttgcttgaatatctgaaaaataaatgctttgctctattttaaatgagagttcttgtttatttgaagaattctctgtaaaatgaaaatcacttttttatctaatatgtatacacacatattgtcttttgttaattttttcttataaactggattttttttattttgctaaatcgaccttcagaatgtgtgcttgtgatatttgtaggaatataaacatgcatcaatataagtaggcatttgtgtttttttctgttatctttcttattttgtgcatttaaaatttttaatctacattccataacgaacttatttctgtgacatgaaaatctagccagatttctccaaatagttagcaggcacttcatttatgagtaattcatcttttcctactaatatgaaatgtcaccattatccaattctattagattggtgcaaaggcaattgcggttttcgccattacttgtaattgcggcaaaaaccgcaattgcttttgcaccaacctaatatattcttacacatattggtgtgttcctggattttctaacctgttccattcactgatttgttgtttcagctgttagtaaataacttgtggaaattaacagcacattttcatatctagaaaggcaagtcttttttgactccatttcaaaagttttcttaatgtcgtcacaatagtaaaagacagcatgagtaattcaaaaatgttaacactttgataactttatttggattatgtaaaatttataaacacagaaagagctcagaactttagaaaaatgtgtctttctattcaagaacacagaccatcttcccacttcaaagtttccctctaaggtccctcagtgaaaaccaaattgacataggtgtccattgatatcaaataaatattggatttttatccaaagaatttttagccaggaagttgatatattatggaaatgatttctctcattatgcacctttccataatgtatgtaacattatgctttaaaatgtgcacgttaaaaataaaacgctgtacatgctgaattttattagtgaaatcactttaaaatgatttataaagaagcagcatggtgagtgattggaaaccagctgaagttttgtttttgttttgctgcttgtgaaaatgacctgggtgctcgcccccgccaaggtttccacatcccaggtgcggctgagcctgccaggaaagaaagtccagcccctttggtgacaggactcgcccccctcacctctgcacccctttcccccaccccattcacccccacacctcacccccacctccagtcctctatcccattgaaccctcaccccatctccccaccccacaccatccacgcccctaccccccaagccttcattccatccacctcagcccattcacgcccccaccccatgcaccccctactccccactcccatcccccaactcactccacaccccgccaccccatataccgccactccccaggccccgctccactcactcccaccccagccaggcaccccctagcccccgtccataccccgagccccggaccatccgccccgcagccctcagcctgcaaaggggtacttctccacatccacaggcctcctcccgcagccccggctcccggcccccattacctttccttcctgtctctcttattggcgtcataatacgtgagcagaaggtacttcagtttctccagattaccacgtaagacagctctgtggatcctcttcagatgatacggtttaatgtagtaatggggaaatgcgaagccatccgagcacaagcgctccatgagggtgggccacctctcccgctcgtcgtcttccttaatcgtcggctgcaaattgtagcctgcagccgtatttcagctcgccttcggggatcgccgcctccgaagagcaacaacaggcaaagcagtctgtgcacggacctccgcgcagactctcagcgcctcccgcctctccgcagaaacgcccaacagaagggttagaaccagcgagcacgcgcaccttagccggccctgcccaacaggcccgaggcagagaaaccgccctagcagctctcgcgcgccc

SEQ ID NO: 565 - DNA, 2137 bp, Homo sapiens
cggaagttttgctgctagtcgcggacgcaatggcttcaaggttacttcgcggagctggaacgctggccgcgcaggccctgagggctcgcggccccagtggcgcggccgcgatgcgctccatggcatctggaggtactcgggtctccgggcgtgccagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggtaaggagaaactcccttctgtgtcttctgtgtaacttatggccttggatgtgttcatagtggtctcctctctgggagtatttgatacaggaaacttggcttgtaggaacagtcccctgagcttctggaaggtagggcttatttggcctaatggttcaattcttgttttttttgttttgttttgttttttgttttttcttcaggacccatacaatgtactggccccaaagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactggaaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacataggcaagggaattgttagaatttacagtgaccttgatacaaggtcagtttactcataggtgaactcagagcctcaatttcttcatctgaagaatgggaggagggcttgaactgatctcttaagatatcaaccatagtcttacttgtgtatcagagatgtctgaggaaaagaaattcatgttgaaagtctccctttctaggttggatgaccataaaccaccttttttcccttttaggtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 566 - DNA, 8160 bp, Homo sapiens
gccacaagaaaacagagccacacactgggccttgtccataattattactataatgatttacaaaagtttttttcaggcaaccgtgttaaattattgtacatatctgagagagggaggtggggccctggccacagcaaaagtgacgacctctttcttgggtgaggtaagaaaatgtcccccacccccttttaggtctgactccttattaagtggcttcccctcaataaatgatgagcatcaaccctttcccacccagggtgccgagggtagagggaggagcaagtggatgaagtgctctgaaaaggatagtgcagcggctctagccaccgtgcatcctctgccctggctctgaagggcctgaccctgggctgcacccccttgctggggatggaagaccattcagtactcagccctacaccagggcatctacccaggaagataggaggacagagtgtgaaaggggctgtgtcaccctgtcaggtcacgaacaggaggtggcaatggatgcagtgacacaccagtgggagctgctggctgccccttgcagcccactccccaaactggctacccaggcatccaggcattctggccctggagctcagggaggcagccctgagagtcggagcagggaaccacaggcctagctggccctgccagggggatacccacaacagcctgacatggcgctcaattcccacacgccagctcaaggctcctgtccatgcagctcaatgttacttgtgtgtgcatgtcctgtgtagaggggaaggctgcaggggggcactgctgtgccacccacccaggggttcagggcatgcaggggaccctaagcctagtatacgagccaagaccaaaaagggttaaaggctctgtctcccctccctccccctctcccaacatgccccgccctccttgggcactagaaagttttgcgatgaatagcacgggagccatcctcttcatactcctttttggacacccacatcttcttaaaagtgtccagcgaggccaggatggagccgctgtggggatggagggatagtattgctgtggacctgtcagggagccaaccaccttcctgggtgctcagagttgcatttccctaatttgggagggaaatccacccacctccacgtggcctaggccaacaatgggaggagcatccagggtaaagtggtctcctcccagagccctcccttgagccccgcctcacccaatccatgtggagtacagccgttcctgcggggctgagatctagaaggaggaagtggccacgttaactgtggatccccacccagaagccatcctcccagccttggggtcaccttccccaggtcctgaagcctgacagcaaaggcataagctggggagtggcagcagcagccttgggaagaacaggactaggtggacgtgagctggtgagcgggtctgggggcagcattcaaccttcctccccatgccaaggctgccagcgccctagtgccccagggggagtttctgtaacctcaccttgattttgatatcctttggggcaagcttcttcacttcactgagtaatcggtctccgaagcctgtgaacacaaagctggctgagcctggggtctgcacccggcctcctcgctgctagctcccgcacccagccttcagggcccccagctactgctggtcctctatcagcagctcttcccaggatgaagggcaaggctgagaaatgatccagccccatggctgcctgcgggccctgcgtcctcacagaggcagcgtgagatgaagccgcacatgctccttgctcgactctcacaatacactttagagcttgtgtaaacttctcctctattcacagagtaaacaaaatttaattttaaattttggtctgttaaaaaaaatgttcattgagcaccaccaaaaagccaacagaatatggctctgggtaggggtatactctctgagggtccagctgccctgggcctcgtctcaccaccaccaactctcaagccacagtacctttgaaaagcgttgagccacctgagagcacgatgttggcgaacagcgtccggcgcaggtccatgtcggacttgtgtatggcgaaggccaccacctcatggagcccctcactctcatccccgacaaggtccggctggaacagcagctcgggggcccggaatcgtgcaggccccacctttagtgtacaagattgaggcagacaggcttcctggagaagcgggctaccccttcccccaggctgggcatcggctgccactccagtgccaggcccggccacttacatcaagcgtgctgccgtctggcaacgtgtactgcaccttctccgtctccagagcctcatccttctgtgggttgatggacaggtagcacgctcgctgcggggacagggacacagccctcagaaggctgcacctgggacacctgtgccttggtgccaccctttcctcaccccaggtcgtgtccacaccctctcgccccttgtcacctctttgattgtccggacaacctcaaactcagccgaggtatggaagtcaaccccttccttgcgcagcaggagtcggaggtagcgggagacgtcgcggccggcaatgtccacccgcatgatggagtgaggcatggcaaagccctcatagatgggcacagcatgagtgaccccgtcccctgagtctagaaccactcctgtcgtgcgtcctgttgcgtacctgtcaccaggtcagcatcccctcacctcagccactgaggcacggggacctcctcacccaggggaggaaccctggcacatctgcattatctagtctgaagagaggacacgagggactccctagaggaacagtcatcaaggggctgtttttccagggaagtcagaccctggtcatggcaagcaggacggcacagggaggacaggactcagggaggccaggcttagggagcactcacagactgagcacagcctgcatggagatgaacagggccggcacgttgaaggtctcaaagaacacctctgccgccttctcccggttcttactcgggttgagcggggcctccgtgaggagcacaggatgctgcgagggacgggacagttgtaggcatcagaggaggcaacttgcaaggccctaaaaggctctttccagagaaccacacccgctggcgcacaggcagctcagcctcctacccctcctgagggccccatccctttatctgctggcagttactcttccggagatccggctctctttggaagattctgcctagcagccactgggtacgtatgcgcacccagacacacacggaaaggcagcaggccctctagaaatgtagaagggaaatgtgggagcccggcgaggagggacgcagaggagaggggcatggccaggagaatgcagagcatgcaggaggggcagccgccacacctcctccgagaaggtctgcagctgatccttggagtagacgtactgccagatgcgttccatgtcgttccagtctcgcaccacgccgtgctccatggggtagcggatggtcagcagcccccggtgctcctggtggggtgggaagggaggtgtggcacccggcccttgctcagcggctgctttccgccctcctggaagctgaccctcacctgccctgaccagaacctcacctgccctgaccagaaccacccctgctcactgggtgtcccagggtctgtggcgggtcctgaactcagcatgggctcacctgcccaccagcttcttaggctcttagagcccagctagcttcagctggggggatcagagagggtggcagtgtgccccgcaatctgcaggctctcttcttccccattctcactgccggcacatcccccacattctcctcacactctgccagctcccctctggccagcgccggcaccttgcagccgcccaacacggcccctcctgggccacctgtgccccctgacctacgcctctccccccagccctttggccggtcctcaccagtcccctgtttgcactgacatgctgcctccacctgcccttcgatgtccccccagccatgccccttctcacctagcaccacttagctcctctcaccacctcggctcctacggaccccatctgcgagacccccaccctctgcacctccagctcaggcctcccctttctgggcccagaaccacgcatgccccacgccccggcacccgacacaatgctcctcaggcgcctaaactgcccttggccaagctcagcttgctgctctccccacacccacacatgctctcctgagggtctgatcaggccatgcagccccttggtgggacactccggcttcactgtgagaggcggccccatggccctcattagagcagacgtgaagtgtgtgtgattctgactcttatatcactttttgatcagttcttggttctgtagcttccaaatagcttctaaaagacaggacacgatgagctctacccatgctccctagaagaggaactgctgccccatctcagggggaggtgcccctgcacagcacttcccagctggagcctggaggaggtacccgggaggtcaccagcagaggcccaagaacacatgccatgttcctgcaactgaggaccccacccccagggaaaggcaggctcctcggtgttacctctgcttttggtccgatgaagaggtccccctccagggctccagccatcacccgcatgtgcttcggccgcccgacactgttaggacggataacgtcagcaaggtgggcagggagcatggcagagcttgtgtccagaaaaaccgaaatccaaccatagtcgcccagagggtacctggcctccaaacaccaggatgtggctggggggcacaggttggaactggggcctatggggttcggggctagagagggggcctaggcaggacgagaagctcagggtcagaaggcacggtcagcagagacagctgcatgtctgagcgccagaacccagccctccatggcccagcccttgcagagggtcggcttcctgcagccacagtgactcagcccacgctcctgacttcggtggggcagggctgccgtcaccatccacagactgagggaggacaaccccaggaagctgggtcggggctcccttgtgcaccctgctctcactcagtcaagcgccctaccccactgccagcgcttctggatcagagattcagttcttggaaactataggatctgatgagctaccactaaaggcaaaggaacctctaattatacccatgcagtcagaaaggaatgctgaagctcgacagggcgcaccatgctagctctgtcccagaccaggccgggctcgggctagcctgccactcggggcctaggatcccctgctgcccgctgcctttaggccactcattccaaagcctccaggatttgtgaagaggtgcccctaagggcaactttcccaatgggctcgtggtgggtgcaaggggcaccccaggctctctgggtttgcaattcttattcccgcccccaccagtaccatacagggcaaaggatcccctcttaactgaaacaagacattttctagagtctgaaaacaagcccggcagaaaacacttccagggaggaaagggtggctgtgcatctaattcctcactcttcctgctccgagtttagggctcccctcggagatgtctccctttattcttgctgctgctaccacaccccatccccagggaaatgctggttgcttttcctccttgctggctcaacaagaccaaaacgagagactcccaagacaaaggggaaccctagaacgcttgtcttgttctttcagtgctctctcaagagtgtcaacctcacaaatttggtgttttccatacaggtcagggcacaaattgtcttcaaagagccctgtgacagaaggccaatgttcttacagaaggtaaacaaaaggactaaggctgctgcctgagccacacttactagtttgggaaacagtatttgggaatctggtctcctgcaaagccagctttaatcacccccgaaccctgcaaggaaaaacaaagttgagctgcccacatgcaccaccagatgaagccagtcccccgcaatggagagagctggctgccccgtcaaggcaggccaaggaggaagccagggaccctgccaggatcatttacaagtacacctatggttcaagattgggggcaattttgtatccccctgctctggcaacatttggcaatgtctggcagctggggagaggggacatgcagtgggggatgctattggcatctagtgggcagaggccaaggatgctgctcaacatcctacgatgcacaggcgagcctgcactaccaacaaggagctagcccagaatgtcaataatatagagatagagaaaccacgaagggcaccttcctctgcacaactaatggttggctccagcaggattccatagcacatgctactcccaaaagctagaagaaacccctctgtgtgggtctttttttttttttttcaacagcttccttctcccccaagaacccagaaggcatggaacatggacgacctacagggcctgctggagaagaccaatgggtgcatgggatgaccggcagcttccctcaagtggcttcccagagactactaggagaacttggtcctatcgctgcccccacctggaagctggacttaaggatcccccaaagaacggggcaattagaaacctcccacccagcgaagggataagcttctcaactcagtcccaccactcttcatcgcaaccctctgagtctgcagcagaaacaaacatctccaagttacagaggaggggatggaatccccaaggggccgagcggtagcccttttaacttataagcctgttgattagcctatacgagttatttgcacgtcaagaaaggaagtagcctgctccttcctgcagcgtcctgctggtgtgacagcacgtccccaagctcagtgctaacctccttattaaacatcccctgctgtgactcagggaacccacatgggtactctaaaacagtcattcagggaccccacggggtcatgtgggagggagacagatcccagaaagagcacaagtgagtcattaccaaaaactccaaggcccgcacaccggacgcacatacccagctaggggcagactcaaagatcccagcccttatcttctccccatatcagagctcggaagccagaaatcttcctaaggcaggtgaaagcaagccgagccccactgctgaaggacaaagccacaggaagcctgatgacatctttcctctgaggcttccaaacgatcaccccaaattgcttgctgatactgggaagagtggccatgaactctccattgctctgctggctgtggaatgtttgctcagcacaggaagcatttaaggagaaagtcaaagtagccaaaaggcaaaccagatggtggtggacatgtgggtgacagagcatcctgcatttgttgcctcggggtgcagccccaaagataaagccagcagtgtgcaaatgacaaatgctaccccacctccgccaggcagccagagccagggccgaaggacgcggaaaggaactggtgtggaaacctgcccaggaaccgcactctcaactgagaagagtccggggcgcgtccccgcccggccgcccggctgtcactcaagctctcctgaacttccccgcccgactcggggaggggtcggggaagaggctctgcgacgcgggcgagggggctcgccccatggccggccttacaaggccaagagggcgcgcgcccccggggcgaagccagcggcccggcgggggcgacggccacgcagtgagcggaggacgcgccgaggcgggcgggggtctctccctgcgccgccgcgtgcgcccccgggggcggggcgcccgccctccccctggctgccgggcctcacgttgtcgatgaccacaggctggttggcgatgatgtcgtaggactccatggccgggccgcgccggccctgcccagcaggcgggctgcaggaggcaccggatgggcgggcgggcgggaggaccgggacggcggcggctcccgacgcggcgccgctgccctccctccccgagcctgcagcctacgcgagccccgcggggctttctggagggcgggcccggcggccaatcatcgctcccacctggcccgattgacagcag

SEQ ID NO: 567 - DNA, 71055 bp, Homo sapiens
actgctcttccggacgcaattttgaggaggtcggagcggaaggacgtcgtggagattgcttgcgctggggtgccacacttaggctgagctgcaggttttcgcacagtcgcgagttaacctctgcttgctccagaggcctcgtcctaatccacctcggctgacggcgcgggatccctggctccgcgaggtctccgaattgtccgagctatctgctatgcagaactttgccccttttgttgtgtttgactcctgtctctaaccctagtctggatggttttgtttctgtcccactttacagataggtacaacgaggctcagagaggtgaagttccttctaaggggccgtagagagtggagagtcgatcgctgttcagatagcgatctggctgggcgcggtggctcacgcctgtaatcccagcccagaggcttaggcgggcgaatcacctcaggtcagcagttcgagaccaacctggccaacatggtgaaacctcgtctctactgaacatacaaaaaattagccgggcttggtggcgcgcgtctgtagtccaagctacttgggaggctgagacaggagaatcgcttgaacccgggaggcggaggttgcagtgagtcgagatagtgctagtgcactcccgcctgggcaacaagagcgaaactccgtctcaaaaaaaagagagaaaagatggtgatctgctggttacgagcatagtgctgcagttagaccggggtcctcctccccaccctgtcacttcacaaatgtttactgagagtctagacacccttgggatgcttgagatacgttggcgtataagataaacacagttcctgtccgtactatgaggttgacctacatcagcagttgtgcagtcttgaactagtatagtcattgcataaagttggcatgatatcatgtcctcatgcagttgtgaggatgaaatggaattatgtatatggagataacattagcttttctgaggctcagcattctttccagtatgtcagagtggcttttgtatgtagatactgacacaatcaatgcatatgggacacatacatgacaggatgctactctaggtacattgtataatgatacatatgtaagtacatagtacattctagatgtgtgtgtgtgtggacatagtgcgttctagatgtgtgtgtatctggactatgacatgaccacaagatacatgcgtatatagatcttgtgactacatcctatgaaatacgtttccatatgccctgtttaaatcagggtttctcaactctgcactattaacattttgggtcctgattattcttttttgtttttggcaagggggcggggtgtcctgagcattgtagagtgtttagaaacatccctggcctgacccactagatgtcagtagcacctctccccaggtggtgacaaccaataatgtctctggacctttccagatgtctccttggggttagaaaacataaccctgttgaagaatcacagggttatgtgaaagtgcataaaccatacacacatactgtatgcataaaacctatgagacctcttgtgaacttttttagtatattactatagtagataacatttcaacatgtgccaggtactaatttgagtgtttcatataccttgtgtcatgcaatggtcacaacaactttatgaaactggtactatgtccctgttctacagaggagtaacctgaggcttggaggaagagtaactggctcaggatttcacaggtagtagtggcagagctggaactgaaattcaggcaatctgaatccagaacgaacattctttatctctttaccaaacaaacctttttttttttttgtattttgagacggagtctcactctgtcgcccaggctggagtgcagtggtgccatctcggctcactgcaacctcggcttcctgggttcaagcttcctgcctcagtctcccaagtagctgggactacaggcacacagcactgcacccagctgatttttgtatttttttttagagatagggtttcaccatgttggtcagacttgtctcgaactcctgaccttgtgatccgcccacttcggcctcccaaagtgctgggatgacaggcgtgagccaccgcgcccggcccccccaaaggcatttttcgtctctactaagccctcacacaaaatatacaagtgtgtaagtaaatttctctttctatcataaacattggccttggcataggaacgttaagtaaaactgaaaatgcaaatgaaccttgacatttttagtttcaaatattgcccccaaattcagcaaatttccaattactgtcgttgcatggtggtatcctcagcagatgggtgcaggaccccctgcagatgccaaaatctgtggatgctcaagttcctgatatacaatggtgtagcatttgtttataacctatgtacaccctcctatatgctttaacccatttcccatttagaaaaaaaaagtacttgacttggtgtggtggctcacgcctgcaatcccagcactttgggaggccgaggccggtggatcacttgaggtcaggagttcgagaccagcctggccaacatggttaacacccgtctccactataaaaatacaaaaaattagctggatgtggtggcgagcgcctgtagtctcagctactcgggaggctgaggcaagagaatagcttgaacctgggaggcggttgcagtgagccgagatcacaccattgcactccagcctgggcgacagagcaagactccgtctcaaaacaaaacaaaaaaaagaaagcaaaaaaagtgcagctcgctgccagcacagtattctcagggcaagcaagatatgagttaagtaatccctagattgcttataatactggctgggcacgatggctcacgcctgtaatcccagcacttagggaggccaaggtgggtggataatgaggtcaagagatcgagaccattctggccaacatggtgaaatcctgtctccagtaaaaacacaaaaattagccaggcgtggtggcacgcacctgtaatcccagctactcgggaggctgaggcaggagaatcgcttgaacccaggaggtggaggttgcagtgagctctgatcatgccaccgcattccagcctggtgacagagggagactccatatcaaaaaatatatatatttaatatatatatcaaatcatatccatatcaaaatatataaatatatatacatgcatatatatgtatgtatacctaaaacagtgtaagtactgtgtaaataaatagttgttaacctgtattttttgtttgcattttttattgttgtgttgttatttttgttggtttttgtttgtttttgagatggagtctcactctataaccccggctggaatgtggagtgcagtggtgcaatcttggttcactgcaacctccacttccctggttcaagtgattctcatgtcccagcctcccgagtatctgggattacaggtgtgcgccaccacgcctggctaattttttttctgtgtttttagtagagacggggcttcacaatgttgaccaggttggtctcgaactctcgacctcaggtgatccgcctacattagcatcccaaagttctgggattacaggcgtcagttactgtgcccttactgtgtgtgtttgttttgttttgttttacttcaaatattttcttctttttttttttttgagatggagtctcactctgttgcccaggctggagtccagtggcaccatctcggctcactgcaagctccgcctccccagttcacaccattctcctgcctcagcctcttgagtagctgggactacaggtgcccaccaccacgcccggctaattttttgtatttttagtagagatggggtttcaccgtgttagccaggatggtctcaatctcctgactttgtgatccgcccgcctcggcctcccagagtgctgggattacaggcgtgagccactgcacccggccttacttcgaatattttctattgtagttggctgaatctgcagatgtggaactcacaaatacagagggctgactatagatgagaaacacattatattcaagatttaccacttaagagtcctttctctaggtgcttatagaggttgagtatcccttgtcccaaatgtttggaaccagaagtagttcagattttggattttgatatatctgcgtatatataatgagatatcttggggttgggacccaaggctaaacatgaaattcacttatatatatatgtttcatatatatcttatacacctagcctgatggtaattttatacaatattttaaataattttgtgcatgaaacaaagtttgtgttaagtacttacgtgtggaatttttcattgtggcatcgtgtgggggctcaaaaagttttggattttggatcatttcaggtatcggatatttggattagggatgctcaacctctacagttttttagtcctagctgggcgccgtgactcacacctgtaattccagcactttgggaggctgaggtaggtgaatcacctgaggtcaggagtttgataccaacctgaccaacatggcgaaaccccatctctactaaaaatacaaaaattagccaggtatggtggtgcgtacctgtagtacctgctactcgggaggctgaggcaggagaatcacttgaacctgggaggcagaggtagcagtgagccaaattcgtgccactacactccagcctgggcaacagagtgagactctcaaaaaaaaaaaaaaaaaaagagtttctgattttggagcatttcagatgtcagatatttggattggggatgctcaaagtatatagttttggagtccttttggccccactgaatgactcctgtaaactcagatgctgtcttaccaacctgttttgcactctcctgatttttagtaagctttttaactgtagaaatcacataaaaagcttaaagattttcatgaagaaaatagaatttgccttcattattttggtttttttccccatctttttatttcaagcttatagaaaagtcaaaagaagttacagtgatctcccgttatacctttcatctagactcactattaatgtctggccatgtttggttttctctatacacgagtgtatataggtatgcatctgtatacgtgtacatgtatgtatgtgtgttgtgtgtgtctttttttttcctgaaccttttgaaagtaagtttgaggaacagttaccaggctgctgcagtgatctgtaagtggaaatgatggtgttttgtggtgtgagggtgtcatcgtaagtgctaggaggaggcgagtacaggacatcttaggtgcatacaggagagactcctaatgagtcttttctggtatccccaagaggcttcatgaagacagtgactggtaaactgcaacccaaaggactgtttggaattagccaggcaacaggtggaacagagcattgcagaggagaacatgcgtttgaggaaactgcatgtagatgtgtatgtccagatcatcccaggttgagatgaaaaaatggggagctgctgcagaaaggaatgagatttttttttttttttttttgagatggactctggctttctcacccaggctggagtgcagtggcacaatcttggctcactgcaacctctgcctcccaagttcaagcaattctcctacctcagcctcccaagtagctggattacaggcacccaacaccatgcccaggttatttttgtgtttttgagtagagatggggtttcgccatgttggccaggctggtttcccaactcctgacctcaggtgttctgcccatctcagcctccctaagtgttgagattacaggcgtgtgccactgcgcctgacgggagtagatcttttaagccaggcttaggaattgagattttattttaagggcaatggggagccattgaaggtgttgtttgtttgttttttgagatggagttttgctcttgttgcccaggctggagtgcaatggcacgatcttggctcactgcaacctctgcctcccgggttcaagcgattctcctgcctcagcctcctgagtagctgggattacaggcatgcgccaccatgcccggctaattttgtatttttagtagaggtggggtttctccatgttggtcaggctggtctcgaactcgcaacctcaggtgatccacccgccttggcctcccatagtggtgggattacaggagtgagccaccacacctggcccagatttacaatttttaaagaatactctgactggagggtgaagaaagaattggagagaggtctgagaagaggcaagggggccagttaggatccatgggcaagatggtggcagtgagaatgcaaagaggtagatgagattttcaggagaaagacttgacagcacagaactagatagggcgaggtgaggtagagattgcagaaagtcagaggcgagtcccagctttctagcttgggcagccgagtgggcgatggagcccttgactaagtagccagggagggaggagacactgaggtcagttgtgggtgtgattcgaagtgcctgttggagatgggttagagatgtctggctggcccctctgagctccaggatggaggcctggttgggaggcagtgcaggcaagtaacgccctgtgccttcttcccacacagcctcagcctcaccatgtgtgtcaggagctgtttccagtccccccgtctccagtgggtgtggagaacagccttcctgaaacacacccagcgcaggcaccaggggtcccaccgatggacacaccttggaggcagcacctacagagcggtgattttcgacatgggcggagttctcattccttctccagggagagtcgctgcaggtgagctattgattctgtttcactttgtgggactagagtggtggtgggagaatggagggtgatcgggaaggcagaggggaacacttgggcagcagtgtgtcccagcaggccatgctctggctctcgagtcgaattccaagcaccactagggggctgagtgtcttgggcgcatgattcagcttctccaaatcttactttcctcatcattaaatgagctaatggtagtgccttcctccttgggatttggcggagagttatccgtgggaagcacttgcttagcacagtgattgctcagtgcatcctaaattctcaatcaatgatgagctgccatgaatgctgtgattagaatttaaccaccaaggcagggcacagtggctgaagcctgtaatcccagcacttttggaggccgaggtgagagggtcgtttgagcccaggagttcaagaccagcctgagcaacatagtgagaccccgtatctgcagaaatttaaaaattatctgggcatgatgacaggcacctgtagttctagctactcaggaggctgaggtcggaggatcacatgaatccaggtggttgaggctgtagtcagccgtgatcatgccactgcactccagcctgggtaacagagcaagacccttactcaaaaacaaacaaccaaaaatcccaaagaatttaaccacttcttcttgggaactgttctacttctgaaatctagaatgctgaaattccccttttgattacagccttcctcccttctaccccactccctctaaacctgcttctggactgacagggtaagggtcagccctctggtctctggtcttctctttaccagccccttcctggttttacttcttttctactcagttcagtttttattagttaaagtcgttttggcttcaagcagtagaaaacctaacaaaacagtgactgaaacaagctagaagtttctttctcttgcacataaaagcccaggtatgtggtctggggcactgtgtgatgcgactctgtggtatcagggactccgactctttatagcatgttgctctgctgtgacttttcatttccactcttacattgtggtctgtcttggctgtgtcgcctcctgctatcatattctcatgccagccagcaggaaggacaaagggccaggcagccatccctctccttttgaccttctgtggtggctggttggccagttctccatcctaaatcaacccaggcacaggttttctatgcctgcgtgtctaggctttccagcactgctgaccaaattactcagccgtgctaactggctgcacaagctggtttctgagctccagcctcagttgggccattggtgctacgcctgagcctctctgttccttcactcttatctctctgttccttcactcgtatctctgtcatgtttacctcaggggctgttccagactgtccactccccctgctccttaccacccccaaatattcttgctctgcagatagctgaatctgttcttctacaaagaacataaagactaaacctgagcaacacagtgagaccctatggtgagctaggattgcaccactgcaccccagactggcacaacagtcttttttagagaacctgtctctaaaaaaaaaggcagcagggaagaacataaagatcactggacagaaagtttcttgactttctctagaatatcttaagaaccaattcacttctctccattgccactgcctccacccttgccttctctcacccaaatgatgtcatcagcctcctaacttcctctgcctctggctctctggattttacaaaatctcctcccagctccagaattaacctttctaaaacatggatcgtgcttctgcgcttagcagctcacacctgtaatctcagcaatttaggaggccgaggtgggcagatcgcttgagcacaggagttcaagaccagcctggccaacctggtgaaaccttgtctctacgaaaaatacaaaaagcgtacctgggcatggtggtgcatggatgtagtcccagctacttgaggggctgcggtgggaggaactctttagcctgggcgattgaggctgcagtgagctgagattgcaccactgcactccagcctgggtgacaaagtgagaccctgtcacaaaataataaataaaataaaaataaagcatagatcttgttcctttcatccctggcttgaaaatcttgaatgcctgcatgtggtcccctagattaagtctagaagctttcacctgggattcagggctcctctcagttttagctttcctgctatggactacctgatgctccccaggcatgccaggcacatttgcatgtttgtgcctttgcaagctgtgtttcctccctgcctcctctgcctgttcaaatcctactgatgcttttaatggcaaatttaaggggatattattcagcaatgactggaatcttttgaacactcagtaaatctcatggttgttactaacttcaagagtcctcttctgtcaagacttctccaacctcatttgcaacctgggcagaatgttcctggatagccaattcccattaagtttcaccttcaccgagatatttttgtttgcagtgggatatgttcatgtctcctctatggggctcttggattccaggaccccaggtctgggatttcttcacttcactgttgcagtgttagctctgcaggctggctcagtcattcaggaaatgtttgatgggtaaatgtgaacaaaatagtgatgccttctactttgtcttttgcttgactggagcttctaatgttatttatttcaaatgaaccatatcaagggtcatttgataagaatatactagaattggccaggtgcggtggctcatgcctttaatctcagcactttgggaggacgagatgggcggatcacttgaggtcatgagtttgagaccagcctggccaacatggcaaaatccaatctctactaaaaattcaaaaataagcggggcatggtgatgggcacctgaaattgcagctactctggaggctgagcagggagaaccacttgaacccgggaaacagaggttgcagtgagctgagatcataccattgcgctgcagcttgggagacagagcaagactctgtctcaaaaaaaaaaaaagtatatatatatatacactagaattactgtactatactatttttttttttcttgagatgggatcgcgctctgtttcttaggctggagtgcagtggtacaatcatggctcactgcagcctgaaactcctgggctcaagcaatcctgcctcaggctcccaagtagctgggactacaggtgtttgccactatgcctaatttttgttttttatagagatggggtcttgctatgtttctcaagctagtgtcgaactcccgggctcaagtgatcctcctgccttggcctcttgagtcattggaattacaggtgtgagttaccatgcctcacctgctgtctgtttttgtatggcctgtcagccaagaatgacttttatgttttgaaatacgtaattgaaaaatatcaaaacaagaataatattttgtgacatgtgaaaattatgtgaagttcatatttcaatgtccataaaaatgaaattttttagaaaaccatcttgcccatttgtttacatattgtccatgactgcttttaccctgtactggcagagttgagtaatttcaacagggtccgtaatgctttcaaagcctaaaatatttaccatctggcccttttcagaaaagcttgatttaagctgttagtttactataaaattagtacgcacaacaaagaattcaaagtatagcccaaacattttagtttttttattttttattttactttatttttctccaagaatgcattttcagaccaaagctcaaacactttaagattgaatttaggccgggcacagtagctcacgcctgtaatcccagcagtttgggaggccaaggcaggtggatcacgaggtcaggagattgaaaccatcttggctaacgtggtgaaaccccgtctctactaaaaatacaaaaaattagccaggcgtggtggcaggtgcctgtggtcccagctacttgggaggctgaggcaggagaatggcgtgcacccaggaggcagagcttgcagtgagcctagatggcaccactgcactccaacctgggcgatacagcgagactccgtctcaaaaaaaaaaaaaaattgggcatggtagtccatgcctgtaatcccagatactcgggagactgaggcaggagaattgctggaactcgggaggcagaggttgcagtgagccaagatagcaccactgcactccagcctgggtgacagatcaagactccgtcttgggagaaaaaaaaaattgaattcagagggtataatgatttcgaaacttcaaaatgtttgactttaaaatttttgttagtgtgatagatgaaaattccatctttgtggtttcttttcttttccttttttttttttttttgagacagagcatcattccattgcccaggctaaagtgcagtggcgtgatcttggctcactgcaacctccatctcccgggttcaagcaattctcgtgcctcagcctcccaagtagctggtattacaggtgtgtgccaccatgcttggctaatttttgtattttcagtagagacagggtttcgccatgttgaccaggttggtctctctcttttttttttttttttttgagacagagtcttgctctgtcgcccaggttggagtacagtgatgctatctcagctcactgcaaacttcgcctcccgggttcacaccattctcctgcctcagcctcccgaagtagctgggactgcaggcatccaccaccacgccctgctaattttttgtatttttattagagacaggtttcactgtgttagccaggatgatctcaatctcctgatctggtggtccgcccgccttggcctcccaaagtgctgggattataggtgtaagccactgggcctggccttttttttcctgttattttaatgttcatttgcctgattgcaactgaggttgcgccttttttttttttttttgagtcggagtctcacatttgcctgattgcaactgaggttgcgccctttttttttttttgagtcggagtctcactctgtcacccaggctagagtgcagtgctgtgatctcggctcactgtaacctctgtctccctggttcaagctattctccttcctcagcctctcgagtagctgggactacaggtgtgcaccaccacacctagctaattttttatatgtttttagtagagatggggtttcaccatgttggccaggctggtcttgaactcctgacctgaagtgacttgcctgcctcagggttccaaagtgctgggattataggcacaagccactgcatctggcctttttttttttttttttcagagagcatcttgctgtatggcccaggctgtcaggctggtctcgaactcctagtctaaagtgattctcccgcctcctgagtagtgagcctttttttttttttttaatattattggtcattcagtttttccgtgaattgctcacttttcttgttgattttcagtaaacctttttttttttgagacagacttttgctcttgttgcccaagctggaatgtaatggtgcaatcttggctcaccacaacttctgcctcccaggttcaagcgattctcctgcctcagcctcctgagtagctgggattacaggcatgcaccaccacccctggctaattttgtatttttagtagagacggagtttctccacgttggtcaggctgctctcgaactccctaccttaggtgattgcccgccttggcctcccaaaatgctgggattacaggcatgagccactgcgcccggccggtcataaccgtttatctgttacatgatttgcaaatattttctcccttttatgccttgtcttttgattttattgataatgcttttagctgtaccaaagttttctttttcttcctttctttttgaaacggaattttactctgccactcaggctaaagtgcagtggagtgacctcggctcactgcaacctctgcctcccaggctcaagctatcctcccacctcagcctcacaggtagctgcactataggctcgcaccaccacacctggctaatttttgtattttttgtagagatgggttttcaccatgttgcccaggctggccttgaacttgggagcataaacaatctgcccacctctgcctctgcctcccaaagtgctgggattttagccatgagtcaccacgcccagccttctatattattttctaagttttagaattttgtttttctgacttggatatttactgtattgggaatttgttttgtgatggcctgaaagatgatttaacttaatttctattccatattgaaacctagttatgccaaccccatttattgaatagtcactgctaaaagagcataaaatacagataaaatttcctgctgccacctcgaccctttcccagttggttccagacttaagtggttatcattgtgaaaagtttcttgtttatttttgaaaaattgcccgtgtgtgttgggggtgggtgtggggggcatatacaaattggatcatatgctgtagactgttccatagcttttttttgactcagtatgatattttgccatctttttcatatcagttggcatatgtctaggatctagtttggaggttagtaaactttttctataaagggctagacatggtggatgtgatggcttatggctacgatcccagcactttgggaggccgaggtgggagactgtttgaggccaggagtttgagactagcctgggcaacatagtgagatccccatttctacaaaaaataaaaaaattagctgggcatggtagcacgcacctgtaatcccagctactcaggaggctaaggcagaaggatcacttgatcctgggagcttgaggctgcagtgggccatgactgtgccacagctccccagcctgggcaacagcaagaccccatcttaaaaaacaaaaataaagaagggctagataggctttgtgagccatactctcagtcacaactattcacttctaccattgcagcaagaaagcaataatagacaatagtaaacaagtgtggttgtgttccaataagactttatttacgaaaataggtagagccaggcatgctggtgtgtgcctgtagttccagctactagggaggctgaggtgaaggttcatttgagcccaggagtttgaggccagcctgggcaacacagcaagaccccatctcttaaaaaaatagataggagacagatttggccccaagccatattttgctgacctttgggcaagtttatatgttttaacatctgtgtggtattccgttatatgaatatatcataattgatgtaataaacaccttattagtatacatttaacttttctagttctttttattatgagcaattctgcacaaacaaccttgtacataacctttgcttactttcataaatatatatggaagaaatttctgaaagtagaattactacgtcaaatgtatgtgcatttcagattttgacagaaattatcaaattgctgtctgcagaggttgtgcttgtttacgctcccgtcaacagcatatgatggtgccggtttcctcacatgcttgccaactccgagactgtgaaaaatgctatatgctttagctctaaaattaaagtattttttggattgagttttaaaagtcttgttattttcaaaggacatataccagattgttaacattagttatttctgaaagaagataggactgcttgtccttttactttccttccttccttccttcctcttctttttttttttttttttttttttttaagacatggggtcttgctctatgtccctaggctgcagtgcggtggcaccatcatagctcattgcagcctcaaactcctgggcttaagcgatccttccacctcagtttcccgagtagctagaattacaggtgcaacccatcacgccaagctaatttttaaattttttctagagacagggtttaatcatgtggcccaggctggtatcagactcctagcctcaagcgatcctcccattttggcctcccaaagtgccgggattataggtgtgagctactgcacccagcctactttcttttgcatagttttctatgaaatatattgtctgaaaaattttcaatgcacagacactactttatcagaaaaaaacaacaaaggtgttttaattccaaaacaaaagctatatgtaaagtgtattttgtcttagatatataattatgaatgttgtatgtatatatttgcccccagcatctgtattatagacagaaaaagcaactgtggatgaggagaaacagtccttgcacaaatgttcccagtattctacagatgctgatgctgatccatccactgccttagctctttgtggacagaaatttccttcttggccaggcacagtggctcacacctgtaatcacacacagtaccttgggaggcccgaggcaggcaggcagatcacctgaggtcaggagtttgagatcagcgtggccaacatggcaaaaccctgtctctactgaaaatacagaaattagccaggcttggtggtgcacgcctataatctcagctacctggggggctgaggcacgagaatcagttgtacctgtgaggtggaggttgcaatgagctgagattgtaccactgcactctagcctgggtgactgagtgaggctttttctgaaaaaaagaagaaatttgcttccttatccacaaagacagcatttcaggcgaacatttcagtgtactcactccatgctgtgaagaattactatagcctatagaaggaagggcatgttctaggggccaccaggatctggcttcttccttcatgtgcttccatagtctctgccaggtccaggtaagtgacctaacatatggtccagtgaatatgagatcaaggaataaaattcatcatgcagtgcccggagtcctctcaagcaaccactgaggatctgatgcttcacagcagtgtgctctctgttgtacacattagcattgctcttcctctgggggtctaaggttgagattttgcattttgtgaatgtctgcaaatttccaacagcatccaccctggcagtacagcgagtccgtaggaactggtatggtaattttcctgagctccctaaaccccagcatgtatcaatgtattccacttttgcatattttgcttcctatagaatgggaggtacagaatcgtatcccttctggaactatattaaaggccttgatggaaggtggtgaaaatgggccctggatgagatttatgagagcagaaataacagcagagggttttttacgagaatttgggagactttgctctgaaatggtgagtggtaaacatacctacatttccatatttttctttttgccttgagtagtggttgcaacattcatgtataagttagttaaactgaaaataaagtgaaacctaataacccattacatgttttaaagttatttcttaggccaggcgcagtggctcatgcctataatcccagcactttgggaggcccagggggtggatcacctgaggtcaggagttcgagaccagcctggctaacatggtgaaaccccgtttctactaaaaatacaaaaaattagctggctgtggtggcgcacatctgtaatcccagctatttgggaggctgaggcaggagaattgcttgaacctcaggggtggaggttgcagtgagctgagatcatgccattgcactccaacttgagcaacaagagcgaaactgtctcaaaaaaaataataataaagttatttctttcacccctaggtgttcaatgttcaattcatatatgaataactaaaaatattcttagccaggcgtggtggctaacacctgtaacttcagcactttgggaggctgagacaggagaagtgtttgaactctggagtttgagaccagcttaggcaacatagccagaccttgtctctactaaaaatcaaaaaaattagccaggcatggtggtgcacacctgtggtcccagctattcaggaggctgaggcttgagccctagggattgaaacttcagtgaaccatgaccgtgccactgcactccagcttgggcaacgtaacaagactctgtctcaaaaaaaaaaaaaaaaaaattctttactaagttcctccagcatatatttttttaatgttttctggtgtattataaaggatgttatgaaggatacgaatgaacagccagatgacaagatacctgggggcaaaggttttagagccactgtgccctttccaggcctgccaccctcctcccagcacctccatgcattcagcaacctgaaagctcccctctaatagatactaaaacaggagctgtctacataatggctttgataaaaaagcttttttaaagcaataataatattgaacattttttctgtactgtgcactgttctaagctctttatataactcatgtaaccacaatagctctactaaaatataatttaaaatatagtaagaaaagttctgtaggtagatggtgatgatggtgatggttgcacgacaacacgactgtacttaatgccactgcactgtgtacttaaaaatggtcgagtgcagtggctcacacctgtaatcccagcattttgggaggccaaggagggcggatcacctgaggtcaggagttcaagacaagcccggccaacatggtgaaaccccatctctactaaaaatacaaaatttagccaggcgtggtggtgggcatctgtaatcccagctacttgggaggctgaggcaggagaattgcttgaatctggggggcagaggttacagtgagccaggatcaagatcacaccactgcactccagcctgggtgacagagtgagactccatctcaaaaacaaaaacaaaaaaaggttaaaatggtaaattttgtgttacatatattttccacaatttatatatatatatatatataaacatatatgtgtatatgtaatagtaaactttgaaaacattatgcaaagtgaaagaagccagtcaaaaaagactgcatggtgtatgattccatctgtgtgaaatgtccagaataggcaaacccatagagatagaaagtagattggtggttttctagtacaaggagactttgggggaaatgaggagtgactgttaatgggtacggtttactttttttttttttaattttttttttgagacacagtctcactctgttgcccaggctggagtgcagtggagcaatctcggctcactgcaacctctgcctcccgggttcaagcgattctcctgcctcagcctcccgagtagctgggactacaggcgtgtgccaccagctccagccaatttttgtatttttagtagagacggggtttcaccatgttggccaggatggtctcgatctcttgaccttgtgatccgcccaccttggcctcccaaagtgctgggattacaggcgtgagccaccacgcctggctggtttgctctttagagtaatgaaaatgtcctaaaattgatggcagtgatggttgcacaactttgtaaatatattaaaaaccattgaattgtactctttaaataggtgacttgcatggcatgtgaattagagttcagtaaagctgttctaaaatctgtgtgtgtatatgtatatataaaacagcagacttgcctttgcagattttgaaatgtgataatataagagttttctttctttctttctttctttctttttttttttttttttgagacggagtcttgctctgttgcccaggctggagtgcagtggcatgatcttggctcactgcaacctccgtctcctgggttcaagcaattctcctgcctcagcctccccagtagctgggactacaggtgcgtgccaccacgcctggctaattttttgcatttttagtagataaggggtttcaccatgttagccaggatggtctcgatctcctgacctcgtgatctgcctgcctcagcctcccaaagtgctgggattacaggtgtgagccactgcgcccagccttataagagttttcaaaacccacacagattgaatttaaaaacaagaaaaaaattgatcagaaactaaagttcataatggtgatactgaggcaatataaaaagcattaaatgacttctcaatcattaaaaattaaattacatatacttcatatacttttagatttcactgtatcctcttatgatatgctgttttttttttcaactagcaatccatgagcagaataaagaactcatttaattgtaatattgatataaatagctccattccctactgtgttgctcaggctagagtgcaatggcttgatcatagctcactgcagctccaatctcccaggctcaagccatcctcccacctcagcctcctgagtagctgggaccacaggtatgtgccaccaagcctagctaagttaaaaaaaaattttttttagatctcactttgttgcccaggctggtgtcaaaatcctgagctcaagcagtcttcccacctcagcctcccacagtgctgggattacaggtgtgagccactgtgcccagcctataactctagtcctggataacttttaaaaaccttatatgagagttcagcacaggggctgaggaacacagttcctgcaggcagcaagctatgagcctgggctcttgtagcagagagcagaaggacgccaggaataagcattttttttttctgttggccatgagtgtttgtcactcttaatgattgctgttctcctgtgccctctcctgttcttagttaaagacctccgtgcctgtggactcatttttctctctgttgaccagtgagcgagtggcaaagcagttcccagtgatgactgaggccataactcaaattcgggcaaaaggtcttcagactgcagtcttgagcaataatttttatcttcccaaccagaaaagctttttgcccctggaccggaaacagtttgatgtggtaagcttgagctaattgaaaaccattggaacagaatctgtgccctcgcttcagggtgcaatgttaaatgctatcttccagcaggtcttgagtgagggagtttttccttcagccacttgactaagttaggtttaaatgcaatatgttgaaaacagaccctttaagatatcactgtgttcttagcaaggtcagacatttatggcatttgattactggttgacacttcagctttacattctaaattcgaaccttagtcttcatataacacaagcatctctgtcagccctcatatcgtaatggatcctttggccttttctaagaccaactatgttgccttctatttctgtgacgttagttcctagaccagtgctgtccaataaaattttactgccttcctcggcctgatttacttccatactaaatccatctgctccatgtgtgtatcccaacctgtcatgtgataaacctatcgttttgacatgcttggctatatttgggtactttacctatttatttatttttatttttttattttgagatggagtctcgctctgtaacccaggctggagtgcagtggcacaatctcagctcactgcaacctctgcttcccaggttcaagtgattctcatgcctcagcctcctgagtagctggaattacagatgtgtgccaccatgcctggctaatttttatatttttagtagagacgggggtttcaccatgttggccaggctggtctcgaactcccaacctcaagtgatccacccacctcagcctctcaaagtgctgggattacaagtatgagccaccgtgcctggcctatttatttttttatatatatatatatatatatttttttttttgagaccatctcactctgttgcccaggctaaagtacagtggcaccatctcggctcactgcagcctccaccttccaggctcaagcagttctcctgcctcagcctcctgagtagctgtgattacaggcatgcaccaccacccctggcaccaccacccctgaatttttagtagagacagggtttcaccatgttggccaggctagtctcgaactcctgacctcaagtgatctgcccacctcagcctcccaaagtgctgggattacaggcatgagccatcgtgcctggcccctatttgggtactctctttttttttccttgagagaaggtctctctctgtcgcccaggttggagttcagtggcgcaatctcagctcattgcatcctccacctcctgggctcaagcaattctcgtgcctcagcctcctagtagctgagactacaggtgcatgccaccacgcctggctagtttttgtgttttttatgaatattagagactgggtttcaccctgttggccagggtggtctcaaacttcagacctcaagtgaccaacccacctcagcctcccaaagtgctgagattacaggcatgagccactgtgcctggccctatttggatactttaaaaatgtttgtttttgtcttataaccaacagcagtgataattccctttagaaactccaaagcccagattggcagttgatcttccagcaccttttagagttgtgatggatcagaaggacccttcccctggcccattcctccaaggatattctgagtcagtgcaaaagggaacagctcatgaaatatagtgagagtcatggtagcctctagaacacatcagattaaatttctctgataactcaagtattggacattttgctaccagagcccctttctgattctttccatctttggaagagctacttttgctggactccaggaagtggcatattaccttagccctacatctgcctatgcctgggtgtatttgtacccttcgttgggccagtgagattaaagattttcaactctgcctacacatcacatgacctgggagtttgtaaagatgctgggtctgtttccctggaggctttcattgagtatgtctagttgggatccaggcatgtgtatttcgaaaaagctccacaggtgattctgccttgcagctggggtgagataccccaagacgcagtgagggacttcagattctgtccatgcttttctcttatcagacagcctctgtcatgcttaccttgagaaggaggcttcccctccatcttcctgggatagagccttgataaataaaatcatttttatctgatctacatttggaaaaacactgaccttgttcccacagttcctgctttgccaagaaagtaatagaagccctgaataagttcatgccatcatgtgcaaaataagaaagagaaggctagagatcttatcaaataaatcttaagaatttattttacttcccccagatgtaattcacctagtgagaggagccgaatgcttcctggaactttgccccatcccccccaattccctccactctcctagctcttgtctcagccagtacagctctgccacttccatctggtacgttacatcgactggtgtctgaaacaccctgcttctgtacttctcactattgacgttttctttagggtagcctcttagactttttttttttagctcattcaggtccttaggagacaagagaaagtagaaaggtccagtttattccagacatttatttacctgaaagggcagttctcacccaacccagaatgcaagtgtagggtagagagaggggccactgggtttgtccttggccttggagagcttgggtcattccaagtggcaagtcagagatttagttctgttcttagggcagatcagagggtattggttataggctatgtggctataggagattgggcccactctataggagattacgccctggggacactgtaaaaggactttcggggaatcagtggatcagagacagcctgacactgagaaggctttcccgtgttctcctgaactctcaccagcaccctccacccattacggatcagatatgtggctgaagcaaggtcgtcagagtacaggagcctcttagcatgtcaggaacagtgtcagccctcccatggaatttctgtctaaatggagtatggatgggtttttaacctctgaaataaacactaagttcgtatttattttatacctgtaatagtgtcttctttctgcaaaaaaaaaaaaaaatggcgaaatgctttccgtcaaactgacatgtacagcttttcttctgctctgtttagccccaagatgtgacattagccaaatgctttgtcattttggaacccacttaagtttcatttaagtttcacaacttactgagctaagataggtacgatgactattaatattattcccattttattgatgatggcactgaggcccattatggctttgctcgtttgcacagggtcacagtgtctgaaacagacactttggtttctcgagtttgcccccacgttgtaacccagtattgtcaaattactcaatgtaagaaggcaacatcattttatatcataacactcttaaattacttgttataataaatctcaactgtccttcttatgcttttcctctcaaaaagtttaccagcatgcatgtgggagctccacctttcgggacattcatctctcattcctgtccctccatcagattgtggagtcctgcatggaagggatctgtaagccagaccctaggatctacaagctgtgcttggagcagctcggcctgcagccctctgagtccatctttcttgatgaccttggaacaaatctaaaagaagctgccagacttggtattcacaccattaaggtaatagtcactaatttttgaactccctcccatgcaccagccactaatgcaatgtttctctgtaatctttttacatttgtagctctagctttccttagggtttccccctgtgtttccatagtcatcttattttgtgttaattatgaaatctatgtgactagctgcttgtattttcaatgggaagcaagacaaacaggtactgcgaaggcaggttgagaaaagagatgggaaaggaggtgaatggcaggcttaagacctttgtgggggtgttcacactgtcctcatgatccagtgatgctgccttaagtggggagccagtggccaccagccatgcaggccatgcagctcactgctgtaaagcacgagaagccatgtgagggggtctcatgccaacttttttctattctttttttttttttttctcatacagggtcttgttatgtcacccaggctggagtgcagtggtgcaatcatagctcactgtagcctcaacctcctgggcttaagtgatcctcctacctcagtctcctgagtagctgaccagaggcatacaccaccacacccgactaatttttgtattttttgtagagacagggttttgccgtgttgcccaagctggtgtcgaactcctgggctcaagcgatctacccaccttaccctcccaaagtggtgagattacaggtgtgagccaccatgcctggcttctattcttctatgtttgggttttcatcgtcgagctgatgggcctgtagggtaagagcaaacgttgtaacataatcttctttcttcttggcacaagagggtattgtgaaatttttttttttttttgaaacagagtttcactttgtcacccaggctggaatacagtggcatgatcttggctcactgtaacctctgcctccctggttcaagcaattctcgtgtgtcagccccctgagtagctgggactataggcgcacgccaccatgcccggttaattttttgtattttagtaaagacagggtttcaccatgttgcccaagctggtctcaaactcctaagctcaggaaatctgcccgcctcgcctcccaaagattcacggcctcaccacgcccggccgtgaatcttttttgagatgaggtcttgctaggttgccgagggctttgaactcctggactccagcagtcctcccacctcaggcttcccaagtggctggaactgtgggtgcacaccatcatgcctagctgttttgtgaaccgttgaccagtgcttctctctgcaggatagaaagttcagtgtggttaggagttaaatgggaagaggaaatgcattctactgctccctcattagctaaatatcctgggttcgaaggccttcctcagagtactgacttctttgataatttccctctaaaggactaccctttgtaaaaagtaaagtagaggttcttctttaaagactttccttattatttaattaggaataaatagtaacttcttttagaagcaaaatttatttaaagacctgtgctaaattttttgttgttgttgttgttgagacggagtctcattctgtcgcccaggctggagtgcagtggtgcagtcttggctcactgcaagctccacctcctgggttcacgccattctcctgcctcagcctcccaagtagctgggactacaggcatccactaccacgcccagctaatttttttgtatttttagtagagacagggtttcactgtgttagctaggatggtctcgatctctcgatctcctgacctcgtgatacgcctgcctcggcctcccaaagtactgggattacaggcgtgagccaccacacccagctgacctgtgctaaaattttttttttttttttttttgagatggagtcttgctctttcgtccagtccagactgcagtggtcctatcttggctcactgcaagctccatctcctgggttcgcaccattctcctgcctcagcctcccaagtagctgggactacaggcgcctggctaattttttgtatttttagtagagacggggtttcactgtgttagccaggatgatctcgatctcctggcctcgtgatccacccgccttggcttcccaaagtgctgggattacaggcgtgagccaccgcgcccagctatgctaacatttttaaatatttgctagctgcaataaagaaattaatgtattttatgtttttagttcctgcaatttagtctaaatatttgccttggcctgctaatactggtccaagcaagtattgggtcatagcttgttcctcttctttatttgaaggtgtttttatttttctcagcattttacaagttacttccttcttcctttgttttcctctacctttgcctcttttaaaaagttttaagttgctagccaattaggacaaatacagaatgtaaagtctcgttccagccaatggaaactggacacagcagtaggatggatgcgtcagcttataaatgaccctgtctcctttgtttggtgtactgttgtggcaaaactgctggtgagtgtaccctttctgcaggaagtaaaaatggccttgctgagtaaattaaatttatgttcaagtgctatgtctttgtggcaccggggaacaaacatttcagacacctcctaggaaacagataggagcccctgaggccaggattgactgctggcacctgttcaatatatattctctgcacctgtactaccatgaattgtaaaattaaaaatatatacgtgtatatattctcaacatcctgtgaaaggaagggaaaaataacaacaacaaaaaatatacatctacatattctctctgaaaccaggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggtatgtgggcttctttcatgttttggtagctctctccaaggcgaaggttttggtctgtttctcacttttcaaccctaatggaatgggctggagacaaagaagctttacagtgaggaaaatagccattgggcctggtgcatcggagcactgctttcagttttgcttgggaaaaagcattaacttccctatttatgcatctccaaaagtgtacctatcccactcttacacctgagagtgtggtatggcagtggttgcctgctttcaacagggagaggaacttggggactgcagtgtgtgctcagaggattttacagtttctaatgctttgagacgacagcccattttgtgaagacgacttagaagttacatcggcaggcgggtgcggtggctcacgcttgtaatcccagcactttaggaggccaaggcaggtggatcgcgaggtcaggagtttgagaccagcctggctaacttggtgaaaccctgtctctactaaaaatacaaaaattagctgggtgtggtggtgggtgcctgtaatcccagatactcgggaggctgaggcaggagaattgcttgaacccaggaggtggaggttgcagtcagccgagatcgtgctactgcactccagcctgggtgacagagcaagactccatctcggggggaaaaaaaaaaagaatttgcattgctgaccggggcgtagtggctcacttctgtaattccagcattttgggaggccaaggcaggtggataacttgaggccaggagttcgagaccaggctgaccaacatggtgaaaccttgactctactaaaaatacaaaaattagctgggtgtggtggtgcacaactatagtcccagctgctctggagactgaggcacaacaattgcttgaacctgggaggcagaggttgcagtgagccaagattgtgccactgcactccagcctgggtaacagagtgagactccatctcaaaaaaaaaaaggaaaagaaaaaaaaaaagggctgggcgcagtggctcatgcctgtaatcccagcactttgggaggctgaggcaggcggatcacctgaagtcaggagttcgaggtcagcctggccaacatggcaaaaccccatctctactaaaaatataaaaattagctaggtgttttggcgggcgcctgtaatcccagctacttgggaggctgaagcaggagaattgcttgaacctgggagactgaggttacggtgagctaagatagtgccactgcaggcctgggtgacagagcaagactccgtcccccccccaaaaaaaaaaggaaaaataatgttgctgggtgtggtagctcacccctgtaatccccagtactttgggaggccgagatgggcggatcatctgaggtcaggagtttgagagcagcctggccaatatggcgaaaccccatctctactaaaaatacaaaaattagccgggcatggtggcacatgcctgtagccccagctacttgggaggctaagacaggagaatcacttgaacctggaaggtggaggttgcagtgagctgagatcatgccactgcactgcagcctgggcagcagagcaaggctctgtctccaaaaaaaaaaaaaaaagttgcatgattttaaaacgcaacaaattgtctccatttcttggagacaagttttctctttcctccttcacattcccccctcagaaaaccaggtgccttgtgtgctttagaggacacttttgggccaggggtggtggctcatgcctgtaatcctaccactttgtgaggctgaggtgggcagatcacttgaggccaggagtttgagaccagcctggtcaacatggcgaaactccatctctactaaaaatacaaaaattagccgagtgtggtggcgcatgcctgtagtcccagctactggggaggctaaggcagaatcgcttgatcccaggaagcagaggttgcagtgagctgagatcacgccactgcactccagcctggacgacagagggagagtccatctcaaaaacaaaagaaaacaaaaaagaagacttacaaaattttttaaattaaattaaattaaattttttttgagatggagttttgcccttgttgcccaggctggagtgcaatggcatgatctcagctcactgcaacctccgcctcttgggttctagtgattctcctgcctcagcctcccgagtagctgggattacaggcacccactaccatgcctggctaatttttgtatttttagtagtagagacggggtttcaccacgttggtcaggctggtctcaaactcctaatctcaggtgatctacccgccttggcctcccaaagtgctgggattacatgagcctccgcacctggccaaagaagacatttttcccaggtaataaaggcttcacccacttgctccgtgaaaaaggcttttattgatggagtttcatgttaggatgttttccagcaattggattattggtagtggcctctgcacagctgaggcgcccactctggccagccagaagaactcaggccgagttctgttgcttgcctactcttctaaccaagtgaaatcagtctatacccagggttcagtcttcttatggagctgagaatgaattagtttcacctcagccaggatcctgcaagggagccacagaattcagcctagtgcagtgggaaattacatctcatgaaagcagctttgggtcaggccgaaggcctctgtgtcactcctttcagctgtcccagcagtgtcaggcagagggacgtgcaagggcacctttcatcctcaggcttaaagcattccatttggcaagatgggttgccatggctgcgtttgtgcttgataaacagaatgaacatgtttttattcatggagcaggagctggcaggaaggacaaaattggacacctgcacaaactgagaaaattactgtggtataaaatgaatggcctttgacaaactgtagtggcatgtgatcctggacctgagttggcggagtgtagacctgggactcagtcactcctagtaggcagagaagaggtacttttcttgcactgcatggcagatgaggatattttgaagcccaaatgcagaactcattagaaagaaagaatgtctgctcagatctgtcctccagggctggtttgagttttctttgttttcaaacttgcaggcccattggaactacttcagtttgatcacgggcagtcaaatccaacttactacatcaggctggctaatcgtgatctagttctgaggaagaagcccccagggacactccttccatctgcccatgccatagagagggagttcaggtaagttttcagggccaggggagcacttgcccactagcctccactgtgcacaagctcagccctaaactgaaaagtcagcactccataaaaataccccaagacatttaaaactacaattatgggccaggcttggtgggtcacacctataatcccagtgccttgggagaccgaggcaagaggatcattgagcccaagaggtcaagaccagcctaggcaatgcagcaagaccctgtttctaccccccatccccccccaaaaaaaagcctgggtgtgctggcatgaacctgtagtcacacctactcaggaggctgaggtgggaggattgcttgagctgggaggttaaggctacagtgagttactgtggcatcattgcactcccacctgggagacattgtgaaaccctgctccaatcccccaaaaagccaaatgtaaattagaactattctggaaaacaatatgatacaatttattaaaagcctcagcgttttcatactttcagacctaataattccaattctggggctctgtcttaaagaaataattctaagtagggggaaacagctgtatgtattaatatgctcaccataaagttgtttaataataagaatttggaaggccaggagcagtagctaccatagtcccagcactttgggaggctgaggcaggtggatgacttgaactcaggaattgaagaccagcctggacaacatagtgaaaacctgtctctaccaaaaatacgaaaaattagttgggtgtggtggcacatacctgtagttccatctactcaggaggctgaggtgggaggatctcttgaacctgggaggtggaagctgcactgagccgaggtgggcaccactgcactccagcctgggtgacagagcgagactgtgtctcaagaaacaaacaaaagagtttggaaactacttaaatatactataatctgtaccataatcaggaaataattaagtaaaccttggtatatatactgtcgcaatgacagtaatagtaatagctaacatttatcgaatggttaatatgtgccaggcactaaaataaatgcttcgaatgtctgttactgcagagcatcctcacaactctatgatatgttacaattatagtcctcatttacaactgggaaaagtaagccttaaagaaaccaaggcaggcagatttgctttgagctcaggcgttcgagcccagcctgggcaacatggtgaaaccctgactctacaaaaaatacaaaaattagccgggtgttggtgacttggacctgtagtcccagttacatgggaggctgaggctggagaatcacttgaacccaggaagcagaggttgtagtgagctgagatcgtaccgctgcactcacaaagtgagaccctgtctcaaaaaaaaaaaaaaaaaaaaattaaccagcatacccagggtcataaaactagtaagcaagtgctagagtctggctttatagccagtctgtgagatttcatagctcacctttaatgattatgctgttattgcagctaataaaagtatgcctataataacaaatgtgtatgataaaattttaagatagtaaaggcagatacaaactgcatatatagtattagctgattttttttttttttttaggcagagtgtcactattgtccaggctggagtacagtggtgtgatgatacctcactataatctcgaactcctgggctcaagtgattctccgcctcagcctcccaaatactacaggcacatgccatcatgcctggctagttttaaaaatttttttgtagagatggggcctcactatattgcctgaactcttggcctcaagcaatcctcccaccttggcctcccaaagtattggggattacaggcatgagccagcgtgcctggccaaggtttttgattattaattcaatttaacaaaaatgttgttactcagatattttatttcatcttgttttagatttggtaagttgtaatttctaaggagtctgttcatatcacctaagctgttgaatttatgatttataatattcccttactatccttttaatatacgtaggatctatagtgatatcctttttttttttttttttttttttttttttttgaaatggagtcttgctttgtcatccaggctggagtgcagtggcatgatcttggcttattgccacctccatctcccaggtccaagtgattctcctgccttagcctcccaagtaacagggattatagtcacacgccaccatgtccagctaatttactatttttagtagagatggggtttccccatgttgaccaggctggtctacaacccctgatctcaagtgattcacctgcctcggcctcccaaagtgctgggattacaggcgtgagccactatgcccaccctagtgatatcctttctttatcactgctggtattaactgataatttgtattctctctctcttgttagtctagctagggatttatcaattacattgatctgggaaccacagtttggttttgttacttttttctattgtttgttttgttttgaggcggagtttttgctctgtcacccaggctggagtgcagtggcgcaatctcggctcactgcaacctctgcctcccaggttcaagtgattctcctgtctcagcctcctgagtagctgggattacaggcatgcgccaccatacccaggtaatttttgtatttttagtagagatagggtttcaccatgttggtcaggctggtccgaactcttgacctcgggtgatccgcctgccttggcttcccaaagtgctgggactacaggtatgagcctctgcgcctggcctgtttttcttttctaatacaagcatttaaatatataacttttaaggctgggcgcagtggctcccacttgtaatcccagcactttgggaggccgagccaggtggatcacctgaggtcaggagttcaagaccagtcttgccaacatggtgaaaccctgtctctaataaaaatacaaaagtaagccaagtgtggtggtgcacacctatagtcccagccaatctcgaggctgaggcaggagaatctcttgaacccaggaggcagagattgcagtgagcggagattgcagtgagccaagattgtgccatggcactccagcctgggcaacataatgagactctgtctcaaaaaaaaaagaaaagaaaaaaagaagtgcattgtttaattttcaaatatttgggggtttttttcttgatattatatgtgaatgaattctagtttaattccattgaagtctgacaaataccctgcaagatttcaattttttggttttttttgagatggagtcttggtctgtcacccaggccgtagtgcagtggtgcgatcttggctcactgcagtctccacctcctgggttcaagcaattctcctgcctcagcctcctcagtagctcggactacaggcacataccaccatgcctggctaatttttgtatttttagtaggtatggggtttcaccacttcggccaggatggtctcaatctcctgacctcatgatccacctgcctcggcctcccggagtgctgggattacaggcatgagtcactgcgcccggccttttgtttgttattttttgagatgcaggtttgctcttgtcgcccaggctgcactgcagtggcatgatcttggttcattgcaacctccgcctcctgggttcaagtgattctcctgcctcagcctcctaagtaggtacaattaaaggcatgaggcaccatgcccggctaatttttgtattatttttattattttttgagacagagtctcgctctgttgcccaggctggagcgcagtggcacgatctcggcccactgcaagctccgcctcccaggttcacgccattctcctgcctcagcctcccgagtagatgggactacaggtgcccaccaccactcctggctaattttttgtatttttagtagagacggagtttcaccatgttagctaggatggtctcgatctcctgacctcgtgatccacccgcctcagcctcccaaagtgctgagattgcaggcatgagccaccaagcctggccctaatttttgtatttttaatagaaatggggtttcgccgtattggccaggctggtgttgaactcctgacctcaggtgatccgcccgcctcggcctcccaaaatgctgggattataggcatgagctagtgtgctgggctagattttaatttttattgaaattttttgagatttattttatggaccagcacatgacttatcttggcgaacatattgtgtttacttgaaataatgtgtattttgcaatatctgagtgagtggtatacaaatgtccatcagatcaagttggtagtgggttcagatgtatgtctttagataaatctatttttgtctaattctatcattactgagaaaggagtgttaaaagctcaactaagacttgtggatttctccatttttttctctttaattttgatcatttttacttgatatatttcgaagctctgttgtttagcacatacatacttatgattgtaatatctttctgatgaacttgcagttgtatcattttcaaatgtccctctttatctctggtggtacactgtcgtaaaggctgctttatttgatattaaagtagcctcaccagctttcttatgcttagtgattgcataatgcttccatttccatccttgtttttgcagcctatctatgtttatatattcagcgcatatctcttgtagacatcatataattaggtcatgtttttctgtccaggctgaaaacatctgtcttttatttttattttatttcttttatttattttattttatttttttttgagatggagtctcgctctgtcacccaggccggagcacagtggagcgatcttggctcattgcaacctccgcctcctgggttcaagtgattctcatgcttcagccacccaagtagctgggattacaggcacgcgccaccatgcctggctaatttttgtatttttagttgagaaagggttttaccatgttggccagggtggtcttgaactcttaggctcaagcagtcctccccctcagcctcccaaagtgctgggattacaggcaggagccaccatgcatggccaacttctgtcttttaattggaatctattcatcttttgagtttaatgtaattattgatatgtttgatttaggtctacaatttcaccattggttttttgtttgtcccatcatttttttgttcttacctacttttgggtcaattgaatattttttagaatttcattttaatttatgtaccatttttaattcagaaaagtaatttcaggccaggcacaatggcttatgcctgtaatcccaggactttgggaggccggggcaggtggatcacctgaggtcaggaatttgagaacagcctggccaacatggtgaaaccgcgtctctactacaaatataaaaattagctggttgtggtggtgcacatctgtaatcccagctactcaggaggctgaggcctgagaatggcttgaacctaggaagtagaggttgcagtgagccaagatcgtgccactgcactccagcctgggtaacagagcgagactgtgtctcaaaaaacaaaacaaacaaacaaacaaaaaacaaagaaaagtaacttcaagaaaatctcatcaattcagccagcaattttgtttattttcatttgtccttgcaggattatgaaagcccttgcaaatgctggagtacctgtccctaacgttcttgatctctgtgaagattcaaggtaaagttcagatgtttttgctattgcactttcaagctacaggagagaaaagcccatatgctaacacaaattccaatttgttaaagacaaataaaatttgggtaggagggaaaagaaactttatcacaacctctcccagaagttctcagatatttaagttatcctgcaagataagtatatgcctgctttagggataattggtagaaaacatcttttttaacattcaaaaaatacatattaatctagtttcatgttgcttgtctttatttatttttttaatcagagtctttctaaactgttttgttttgtttttttgagacggagtctcattctgtcacccagactggagtctcattctgtcacccagactggagtccagtggcctaatctcggttcactgcaacctctgcctcctgggttcaagtgattctgctgcctcagtctcctgagtagctgggattacaggtgccccctactatgcccagctagtttttgtaatttttgagtagagacagggtttcgccatgttggccatgctggtctccaactcctgacctcacgtgatccacccactttggcctcccatgatgctgggattacaagtgtaagccaccgtgcccggccctaaactatttatttatttatttatttatttatttattttttattgataattcttgggtgtttctcacagagggggatttggctgggtcataggacaatagtggagggaaggtcagcagataaacaagtgaacaaaggtctctggttttcctagcagaggaccctgcggccttccgcagtgtttgtgtccctgggtacttgagattagggagtggtgatgactcttaacgagcatgctgccttcaagcttctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggtggccgggcagaggcgcccctcacctcccggacggggcgggtggccgggcggggggctgacccccccccacctccctcccggacggggcggctggccgggcagaggggctcctcacttcccagtaggggcggccgggcagaggcgcccctcacctcccagacggggcggctagccgggcggggggctgacccccccacctccctcccggacggggcggctggccgggtggggggctgaccccccctcctccctcccggacggggcggctggccgggcagaggggctcctcacttcccagtaggggcggccgggcagaggcgcccctcacctcccagacggggcggctggccgggcgggggggctgacccccccacctccctcccagacggggcggctgtccaggcggggggctgacccccccacctccctcccggacggggcggctggccgggcggggggctgacccccccgcctccctcctggacggggcagctggccgggcggggggctgacccccccgcctccctcccggacggggcggctggccgggcagaggggctcctcacttcccagtaggggcggccaggcagaggcgcccctcacctcccggacggggtggctggccgggtggggggctgacccccccacctccctcccggacggggcggctggccgggcggggggctgaccccccgacctccctcccggacggggcggggggctgacccccccccccacctccctcccggacggggtggctgcccggcggagacgctcctcacttcccagatggggtggctgccgggcagagaggctcctcacttctcagatggggcggctgccgggcggagggcctcctcacttctcagacggggcggttgccaggcagagggtctcctcacttctcagacagggcggccgggcagggacgctcctcacctcccagacggggtctcggccgggcagaggcgctcctcacatcccagacggggcggcggggcagaggcgctccccacatctcagatgatgggcggccaggcagagacgctcctcacttcctagatgtgatggcggccgggaagaggtgctcctcacttcctagatgtgatggcggccgggaagaggtgctcctcacttcctagatgggatggcgtctgggcggatacgctcctcactttccagactgggcagccaggcagaggggctcctcacatctcagacgatgggtggccgggcagagacgctcctcacttcctagatgtgatggcgtcacttcctagatgtgatggcggccgggaagaggtgctcctcacttcctagatgggatggcggcggggcggagacgctcctcactttccagactgggcagccaggcagaggggctcctcacatcccagacgatgggcagccaggcagagacactcctcacttcccagacggggtggcggccgggcagaggctgcaatctcagcactttgggaggccaaggcaggcggctgggaggtggaggttgtagcgagccaagatcacgccactgcactccagcctgggcaccattgagcactgagtgaacgagactccatctgcaatcccggcacctcgggaggctgaggctggcggatcactcgcggttaggggctggagaccggcctggccaacacagcgaaaccccgtctccaccaaaaccagtcaggcgtggcggcgcgtgcctgcaattgcaggcactcggcaggctgaggcaggagaatcaggcagggaggttgcagtgagctgagatggcagcagtacagtccagcttcggctcggcatgagagggagaccgtggaaagagagggaggggagaccgtggaaagagagggagagggagaccgtggaaagagagggagagggagaccgtggaaagagagggagagggagaccgtggaaagagagggagagggagaccgtggggagagggagagggagaagactattttaaacagctttgtaacatgctttttgagtgtctcttctttcctaatgttttaattatgtaacatttgaaaccttcagaaaaggtgaaagaagaaaaactaatacaatgaatacctgtttacacttcatctagatcaaaaattaaaacattgttaacattttgccacatttattttctgtatatgtgtgtgtgtatacatgtatacttttaacatgtagataatgattttttttggctgaaccttttgaaataagtttcagacagcatgcatctctcaagaataaagacattgaccgggcatagtggctcactcctgtaatcccagcacttaaggaggctgaggcaggtagatcacttgagcccaggagtttgagaccagccagggcaacatggcaaaaccccatctctacaaaaacaaacaaaaaattagccaggcgtggaggtgcacacctgtagtcctacctacttacccggaagattgtggtgggaggatcacctgagcctgggaggtggaggctgcagtgagctgtgatcacatcactgcactccaggctggatgatagagtgagaccctgtctttttttttttcctttcttttcttcttcttcttttttttttgagatggagtctcactctgttgcccaggctggagcgaaatggcgcggtctgggcacactgcaacctctgcctcctggattcaagcagttctcctgccttagcctcccaagtagctgggattataggcatgtgccaccacacccggctaatttttgtatttttaatggagacggggtttcgccttgttggccaggctggtctcaaactcttgacctcaagtgatccatccgcctcggcctcccaaagtgctggattacaggtatgagccactgcacccggccgacattgtttttcataaccacaacaccagtatacctaactaacaattatttaataataatactgaatatctaacccatgttcaaatttccccaatccaaaacatcttttgtaataatttttcaacttgaaacatttgtaatggtaggattttcaaaacaattttttagagtagtaaactggaggctgaggcagatggatcacttgaagccaggagtttgagaccagcctggccaacgtggtgaaaccccgtctctactgaaaatacagaaattagctgggcatggtggcgctcacctggagtcccagctactttggaggctgaagcaggagaatcatttgaacctgagaggcagagtttgcagtaggccaagatcgcaccactgcactccagcctaggtgatagagtgagactccatctcaaaaataaataaataaataaatagagtagtaaactgtttgctagtaatgaccaaaagatggattagtgacatgtcattgggtcaccttagtactgctgggtggtatatacaccactcataccaccaaaaaatgataaaaataacctcaataacaagaagggatacttattgaacccttattggaaccagagaccatgtcaggcactctgtatgtttgttccctaattcatttctttttttaagtaacaaataccctggaagctcccttaattcttgcaattaccctttgaagtatgtatgttttacagattaaaaaacaacaacatggctgggtgcagtggctcacgcctgtaatcccagcactttgggaggctgaggcggatggattacgaggtcaggagattgagaccatcctggctaacagagtgaaacaccgtctctactaaaaatacaaaaaattagctggttgtggtggcacatacctgtagtttcagctattcgggatgctgaggcaggagaatcacttgaacccgggaggcggaggttgcagtgagccaagatcgtaccactgcacttcagcctaggcaacagagcgagactccatctcaacaacaaagctcagagaggtttaataagtctctcagggtcactcttcaactaagagcagagttgggatttaaacctggttccaaccaggtgcagtggctcacacacgtaatcccaacactttgggaggctgaggcagtcagattacctgaggtcaggagtttgagaccagcctggccaatatggtgaaaccccatctctactaaaaatacaaaaattagtcaggcgtggtggcatgcacctggagtcccaactatttgggaggctgaggcaggataatcgcttgaacccaggagaaggaggttgcagtaagccaagatcgcgccactgcactccagcctgggcgacagagcaagactccatctcaaaaaaataaataaataggccgggagcagtggctcacgcctataatcccaccactttgggaggccaaggcgggtggatcacgaggtcaggagatcaagaccatcctggctaacacggtgaaatcctgtctctactcaaaatacaaaaaattagccgggcgtggtggcgggtgcctgtagtcccagctactcaggaggctgaggcaggagaatggtatgaacctgggaggcggagcttgcagtgagccgagatcgcgccactgcactccagcctgggtgacagagcgagactccgtctcaaaaaattaaaaaataaataaataaataaacaaaaaataaaaacctggttcggtgtgactccagaggtccttctctgagccttgctgcttgctacattattacactttgaatccattcctgtggcttacacaaatgaaccagggagaagagaaaagcatgctgtccaagaagcatagatgggtgtgcatgtgtgtgtgtgcacgtgtgtatgtatatgtgtgtgtgcatgtatgtggatcgatccattgcaagagaggatacttctaatgcactgtgcttatgtgaaaggaaaaaggaagtatccagtgctctgggtctgaactcttcaccagctctcaacctgtatacccagggaaagtgacaaagaatagggtcatgactaacagcctgccacattatgactctgatccctgaaaccccttctgtgttcctcccagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggtgagcaggaggccacgtctcccatgctggttgtttcatcactagtgcttctgcttttaggatctgaatcgttttgggtcgttttgagtattagcacaccaagcgtaaggcagacttagcttcttccttggaaatccagtttagttttaatggaggtgttgctgacttaggcatttgggccttcaataaatccctttatgaactacacagtctttcttccctgcaacttttttttttcattttttctttttttcccttaaatattctgctatccaattccctgcaacttttatctcactagaccatttaaattttttttctgatactgaccataggtatttaaaatgtatttttctccgttttttaccctttcccctaaatattcttttcaacaggaatatatgtattttttgagatgggggtctcactgtgttgcccaggctggtctcaaacttctgggctcaagccatcctcctgtctcagcctcccaagtagttgggactctgggcatgtgccaccgtgtccagtttcaacagggatagtttttttgtttgtttgttttttgagacagggtctctctctgtcgcccacactggagtgtagtggtgtgatctcggctcactgcagcctcaacctcttgggctcaagcaatcctcctgcctctccctcttgagtagctgggactacaggtacgcaccaccatgcccagctaatttttgtatttttagcagagacaggtttttgccacattgcccaggctctacccaaactcctgcgctcaagtgatttggcctcccaaagtgttgggattacaggcatgagcctctgcagccagccctcatgtagttcttaccacatgccaagaatagttctaagggctttacatattttattctcccaacagctctatgaggaccatctcaagatgaggaaactaaagcatagagatgttaagtaacctgcctgagatcacagagctagagaacaacagagctgggtttcatagcctggcagtctggctccagggttcatgtgctcagctaaccactgttgtttagccaaaaagtgatttatgaaaggctattaggaagcacagaagatctttttttttgagatggagttttgctcttgtcacccaggctggagtgcaatggcgcaatctcggctcacttcaacctccgcctcctgggttcaagcgattttcctgcctcagcctcccaagtagctgggatgacaggcacccaccaccacacctggctaatttttgtatttttcagtagagatgcgctttcgccatgttggacaggccagtctcgaactcctgacctcctgcctgcgttggcctcccaaagtgctgggattacaggtgtgagccaccatggccggccacaaggtctttaagaggaccagagatcatacttggagaccatatagctaggaacagcacccagaccacactaatccagccaaagagctggtgacttccaccttggggcagcaggagcatcatgtgggaaattctccagtcataggaacgtgttcaaagacactgcaccacccagtgcagagcatgacaaagggtttcactgcactggtttttttttccgctactttcagaggttgctgaaattgcacaccaagttctaatcctatttcccgcaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggtagatgtggtggcagggagagctgaaaaatgacagcaaggatgctccaagggggaattgagcaattggtcttggtgcaatttacagctgggaattattcctattacaaagcacctgtctgtgtgtggccttttcaggcagggtttctcagctctggcactgtgacatgttgaattggataagtttttgtggtgggagctactgtgcattgcaggatgtcaggcatcatccctggcctcaacccactcgatgacagtagcacccctccccacagagtgtgacaaccaaaaatcttcgcagacctggtccagtgttcccagggagggcagcattcctctgttgagacccactgtttgaaagtaaggcagagtctatggccataccaccctgaacaggcccgatctcatctgaaagtaaggcagagtgagggtgccactcacctcccaagaggcctggggatggacattctcactgggtgtaatgaaaggattgaaagagagtgacagggtctctgggggtatgtgatgagtctgtagcacggctaaaatgggaacttcagtatgcctggcgtctggcggcagtgtctagctttatcttatcatctcttgctgtgaaaactgcccgttaggtacttttatagggtagtgtttatagtgttttctgcttcgcagcacctggagacctgcttttgatgcaagcatgccttatttggcttgtcttcttgcccatctggggactcaggccttttattaaacaagactagacagtgaaggctaattttaaagacatttccgtttcttttttttttttttttagacatcgtctcactcagtcgcccaggctggagtgcagtggcgtgatctcagctcactgcctaccccacctcctgggttcaagcaattctcccgccccagcctcccgagcagctgggattacaggtgtgcaccaccatgtgtggctaacttttgtatttttggtaatccaaaaatacaatacatttttagtaatacaaaaatgtgagatggggtttcatcatattgatcaggctggtctcaaactcctgccctcaagtgatctgcccactttggcctcccagagtgctgggattataggcatgagccaccatgcccagccttaaagacatttctttgccttccaaatttgattggcctctcttcattggcttgaccggtgtccctcgctcccggcttcttccgttagccagccacctttggggatccccctgggtctgagagtggacagctgagctttctttgtcatgtggtcatcacgggagcttgaggaacctgcttctgcatcagagactgatggggccaagtgcttcccccacactgccttgaacgtggcatgcagttgggctgcatttgaccccctcctccatcttctttctccacttgggattctagagcacttgcctgacaacactttccttgccagccattgccatgtatttcctttggcggggaagacctcaggtggcctttgtgtcaccagcccacaacagctgctccgtggaccttgtctttgcttctcttggcacctcaacaatccacgaatgtgatcaagtatacagcaggcaggagatatccagtgcagtctgagcaccccctcccctagctatagtgaagtatgatgatcatttaggatgttgcctccaggaaaggcatcctctgattttagagagcgtgctgctgcttattgatcaacacagtcagagatagttctgtcttttgatggatagaagaacatttcttgctagtggagtgaatcagcggtggtgggagcataaactgctgcagctactttgaaaagtagtaggcagtggccaggcacggtgactcaagcgtgtaatcccagcactttgggaggcgaaagcgggcagatcacttgaggtcaggagttcgagaccagcctggccaacatgccaaaatcccatgtctattaaaaatataaaaattacctgagtgtggtggtgcccctgtaatcccagctactcgggagggtgaggcaggagaatcacttgaacccgggaggcagaggttgcagtgagccaagaccgcaccactgcactccagcctgggtgacagagtgagactccatctcaaaaaacaacaaaaaaagaaaagtaatgggcagtaacatggaagatgggaatatgctacaacccatcgtttcttgtaaagaagcatctgctgcagctttgcaccaagagactcaggtgaagatgtttgttttggtcatgcttgtaattataatacatgataaataaagtgtagtttggccatatgttggaattctatttagtgagtaaaataaaccaatttgctgtacataagtcataagtctcaaaaaagataatcgaagtagaaaaaagtttcaaaagggtaatatatcatttatgaaaatttaaaaataattgaaagaacactatatgtggtatataggtacaggtatagataagagaaatatagaaatgtctgagactgatatataccaacttcagggtagcagtaaatctcatttttaaaaaatctgaagcaaatgtaacaaaaaagcacgtacaatatctgttaaatctggaaggtggacacatgagttctgtcattatgtcattctctgtatttttctgcatgcttgatgtttactttttcttttaaataaagcatgcattacagacagccctggcaggaaacagaaagcatgaaagaggctatctggggagagttcaatatagggttatttagttcaatatagcgtggtttagaggaaccgctgaagaacagcgtggagtcccggggccagtaacagtgaggggtcagtctgacagggcaagcatgtgctgtggttattgctactctacaacaaactttgtcagaactgagtggctgtcaacaacgacagcagtcattttgcttatgaatctttgcagtctggggacaggacagcttatttcaaagtagggcggctgtcgggtggggctggatcttctgaagacttgctagcatgctggccctgggcagagaagatattaacagccgggctccttgggcctctctttctgtctctttgtggttcccacatggtctctccagcatggcaacttctgggtaactggactttttttttttgagacaggatcttgcactgtcacccaggctggagtgtagtggcaattcataggctggaacataactcactgcagccaccaactcctgggctcagtgatgctcccaccttagcctcctgagtagctgggactacaggcgtgcactaccacgctcagctaatttttaaatttttttttgtagagataggatcttgttatgttgcccgggctggtcttgaactcctgagcttaagcagtcctccgaaaatgtggggattacaggcatgaaccattgctctcagccctggacttcttacctgggggctcagggctccaaaatagtgtgtttcaagagacagagggctgggcagaagctgtatcacgttttctgacctagtctagtttcaggaatccctcagcatcacttccacgtgtcttatatctgttagaagcaagatgcttcactgggccaagcattagactctaccttttgtgggaggagtgtcaaaggatttacagatctgttttaaaaccatcacagggagggagtaattcccggaacccagagaggctagctctctggggaaggctgcagagaaggagctggggaaataaataaccaggccctttcccatctcctgcttttgattggctgagtccagctggaagccagagggcaagggagcctttggagcacacagcccagggagctcaggcacccgggcacagaggggatgggagggtggggagccaagcctaaagggcaaacagaccacgcagaatccaccctagccggcagttttcttagtgctgtctctattcctcctgcgacttttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtaggaactgctgctggaggatagtgggggagcaagccagttctccaagcatttgggagcaaactcagctgaagtagtccgtgattgggcgggggaagtgaaagtgaggtcctggtggttctggtgggaaacataactagaatgcagtcctgtcacatttacgggaaagtggatataggatgtgttttaagtgaaaagtatgcctgtataggtaccgcttatgcttttacacagctaacttctatttagggttttaaattaaaaacacattcattgtggctgggtgtggtgtctcatgcctgtaatcccagcacgttgggaggccaaggcgggtggatcacaaggtcaggagttccagaccagcctggccaacatggtgaaccctgtctctactaaaaatacaaaattagctggacgtggtggcgtgtgcctgtaaccccagctactcgggaggctgaggcaggagaattgtttgaacctgggaggcagaggttgcagtcagctgagatcatgccattgcactccagcctgggcaacagggcgagactccatctcaaaaaaaacaaaaacaaaccacatttattgtgaaaatactagagccaacagatagcaacaacaacaaaacagttaaaatcattagtagtcccagagataaccatttgctgacatttcagtatctatccatgtcatcttttcttctgtgtgtatatgtacatttcctaaaacaaaacaaaaatgtaacatgatctaatggcatgctttttttcacttcattgtatactgtagacatgttttcatgacattaagtatttcttctatagcataatttttaatgagagcatataattttattgtatagaattaagggaagacggccgggcgcggtggcccacgcctgtaatcccagcactttgggaggccgagacgggtggatcacgaggtcaggagatcgagaccatcctggctaacatggtgaaaccccgtctctactaaaaatacaaaaaaattagctgggcgtggtggtgggcacctgtagtcccagctactcaggaggctgaggcaggagaatggtgtgaacccgggaggcggagcttgcaatgagctgagatggcgccactgcactcgagcctaggcaacagagcaagactccatctcaaaaaaaaaaaaagaattaagggaagacatttgggttaattcctatttagatatttaatttgtttccaattttttagtattacttcccctacttccatgaaaaaaaggcagtgaacatccttgtagtaatatatttgcctatatataaggtatactcctaagattaatacctaggaatggaatatattacatgcttctaaatcatgaaaatgtcacaactggaggaaataagtgaattttttttttttttgagacggagtctcgctctgttgcccaggctagagtgcagtggcgcgatctcagctcactgcaagctccacctcccaggttcacaccattctcctgcctcagcctcctaagtagctgggactacaggcacccaccaccacgcccggctaaatttttgtttttgtagtagacatggggtttcaccgtgttagccaggatggtctcgatctcctgacctcatgatccgcccgccttggcctcccaaagtgctaggattacaggcgtgagccactgcgcctggcccgtgaaattattttatttgctataattatcattttcataatttggtgagatctttttatttttatatttatttatttatttgtttatttgtttatttatttttgagatggagtctccctctgtcactcgttttatttatttttgagatggagtctcactctgtcgcccaggctggaccacagtggcgcaatctcggctcactgcaacctctgcctcccgggttcaagcgattctccggcctcggcctcctgagtagctgggattacaggcgtgtgccacaatgtctggctaatttttgtattttcagtagagacagggtcttcaccatgttggccaggctggtgtcgacctcctgacctcaaatgatctgccctcctcggcctcctaaagtgctgggattagaggcatgagccactgcacccagccaattgtttttttttttttttttttgagatggagtcttgctctgtcacccaggctggagtgcagtggcgtgatctcagctcactgcaacctctgcctcctggattcatgcaattctcctgtctcagcctccctcccaggtagctgggattacaggtgcacgccaccatgcctggctaatttttgtatttttagtagagacagggtttcaccatattggtcaggccggtcttgaactcctgacctcaggtgatccacctaactcggcctcccaaagtgctgggattacaggcatgagccactgtgctcgacctgagatcgctctttccatatcatttttgatcaaatgactggttgaagataatatgcatccacccttaactgtggccagatggaattggaagctcccattccttcctttactgccagttgagtctgaaacctgtaagagccaatttgtgaataatgacttcatgcctggatccccagccatctaagggagcaagagccaatgcaggaataagctaacccatggaactggtcgtgaaactaatttgcaagggacatggcgattttcagaatttaaatatttgccagccacaggggcgtgtcacgtcagtgactacccatgaatggctctgtctttctcgcaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacaggtaatgggatggctgccctgaagagccactgcggggtgagtcacagcaaggaccgtgcctccacctggaaaccctctcagggccacagaggctttggagagaccgatttggccaggattctctgaggttcagttaatctaaccatttgtccataaatattttctttacaatatttatttatttattatttgtttttgagacagggtcttgctttgtcaccctggctggagtccagtggtttgatcctggctcactgtaatctctaccttctgggttcaagcgattctcctgcctcagcctccagggtagctgggactacaggcctgcgccaccacgcctggctaatttttttttgtatttttagtagagatgaagtttcaccatgttggccaagctggtctcgaactccgggcctcaagtgatccgtctgccttggcctcccaaagtgctgggattacaggtgtgagccaccatgcccagcctctttacaatatttaaacttgttttttaattattaaagtaatgcacaaagaaatttttccagttaaagcattcatgcacatgatcaaaatttggtcatatagaattatgtaaaattgtatctcacccttttcaacaccattcctcaaagataaatgttactgttaagagtttcctgggccctccagtttttctgtttatctgtcttctctctctcctcctacttttacacaaatgtgatcatcctatgtgtatttttcggtactttgattttaaaattttgtaagcttaagaatttctgtgaaatatgtgtgtgaccatttgcatatttaacaactatatgaggcaaatttcttggtgtgtgtgtgtgtgtgtgtgtgtgtgttgagacagtttctcactctgtcgcccaggctggagtgcagtggtgcgatcttggttcactgcaacctccacctcaccagctcaagcaattctcatgcctcagcctcccaagaagctgggattataggcacataccaccatacccgcgtcatttttttgtttgtttttagtagagatggggttttgccatgttggccaggctggtttcgaactcctgacctcagatgatccatccacctcggcctcccaaagtgctgggattacaggcatgagccactgagcccggccagtccccaagtctttaggtaaaacccctgtggtctttgacaacttccttgctcgctagtatgacaaaatgttccaggttcatcttgtctatccagcctacccaacatggtgaaactgtgtctctactaaaaatacaaaaattagccaggcatggtggcgggtgcctgtaatcccagctacttgggagactgaggcaggagactcacttgaacctgggacggggaggttgcagtgagccgagatcgtgccactacactccagcctgggcgacaagaatgagactctgtctcaaaaaaaaaaaaaaaaaaagacttgggagccaacctgaacaggctcccacttgctaacaataggaaactttgggcatcaccaaggatgatagctgaaatggatgaaacacatcaggtatgtttaaatccatgagtagtagccgggcatggtggctcaggcctgtaatcccagcactttgggaggccaaggtgagcagatcacttgaggttagggattcaagaccagcctggccaacatggtgaaaccacatctctactaaaaatacaaaaattagccaggtgtgatggcgggcgcctaaaatcccagctactcaggggactgaggcaggagagagaatcacttgaacccagggggcagaggttgcagtgagctgagatcgcgcctgtgcactgcagcctgggtgactgagcaagacactgtccccccaaaaataaaaattaaataaataagtccatgagtagtgatacaaaaacaaagagacaaagtctcattgatgacctcagaggttgccaggaaagcaacttattattctgaaaattggaaaatggggtgggggggtggggaatcaagcatttgtcctgtctttcctgtacaaatgatactgcaggctatccaaataatcaatgagggaatgtttctctctagagaagtatcctggacagaataatatagaatttgcatatcaccaatttgcaactcctaatgcattaatggatgtgggcaataagcttcaatgaaagccaacaccactgagagacagacagccagacattatatacctcctgatgcttccctcaaaagttacactgactctgcccaggtctccagtgctagctgccaactcatgggaaacacagggttcagagggacatgttcagcagcaccctgggcacagcactcacaaaatccagattctggaaaacatcacagggcaaacaactcagtttcttcaaacacttacatttcaaggggaggaaaagggtgaaaaaggaacctgtagattgagagagacttaaaagaaacatcaggctgggcgtggtggctcacgcctgtaatcccagcactgtgggaaaccgaggtgggtggatcacctgaggtcaggagtttgagaccagcctggccaacatggggaaaccctgtctctactaaaaaatataaaaattagccaggcctggtggcgggcacctgtaatcccagctactcgggaggctgagataggagaattgcttgaacccaggaggcggaggttgcggcgagccatgattgcatcaccgcagtctagcctgggcaacaaagtgagactgtctcagaaaaaaaaaaggtggggggagcggggagagacttaaaagatacgttagccagttacagtgttgggaccttatttggatcctttcttgaacaaattatttggaaaaaattttgatgatagtcactgaaacttgaattctgagtggatagtcgatgatatgaagaagttaacagttaacgattttttaagggtaataatagtattgtgggttttttaaaaaacatttgtttttagagttttgaaagaatcctagatgagatatttgggatttactccaaaaaatccaggacagtgggagtggggatggcagggaatgaaaccagactgggctggcatcgatcattgcggaaggcgagcagtagaacccgtaggcttgttattctctcctctctactcctgtgtgtctttgaaattttccaaaaggaggccagtcatgatggctcacgccggtaatcctagcacactgggaggccgaagtaggtggatcacctgaggtcgggagtttgagacccctggccaacatggtgaaaccccgtctccactaaaaatacaaaaattgcctgggtgtggtgatgccgcctataatcccagctacatgggaggctgaggcaggagaatcacttgaacccgggaggcagaggttgcagtgagcagagatcgtgccactacactccagcctgggtgacagagcaagactccatctcaaaaaaaaaaaaaaaaaggccaggtgcggtggctcatgcctgtaatcccagcactttgagaggccgaggcggggggatcacgaggtcaggagatcaagaccatcctggccaacatgatgaaaccccgtctctactaaaaatacaaaaattagctgggcttggtggtgtgtgcctgtaatcccagctactaggtgtctgtaatcccagctaactagggaggctgaggcagatgaatagcttgaaccagggagtcagaggttgcagtgagccgagattgcttcactgttcactccagcctggtgacagagcgagactccatctcaaaaaaaaaaaaaaaaaaaagaaaagaaaaagaaattttccaaaagcaaaacttaaaaacaaaaggcaaggagaaagaaggagaaaggaattcatcatgggatttgctagtgctgatggagtgtttagctttgcagtcagtgacaccccaagcttgctggcagcctgtgttctcagccaggttgccagagtcttctgagagaagcagttgcagtaggggaattgatcattcattcccaagtatatgagcctctactaaaagccagcactgtgctaggtggtcctggagatacacagtcatgagaaaaactgtccggagaaaaaccagtacccagagaatttctagtttaactgtacctggtctgataagcaggggatgctggaagcaggaatttctggaaacaatattttccctcttttaggaaaatacagtatcagctgtaagccactatttcccattttttttatagttttccaataaacactaaccagaaatatttacttaaacagaatggctgctaagtccttatggtgatgaatagtcctggtcacctctgatatttcctagccggctgccaagttttctccctgctctgctccagtgacctgggaaaagcttaatagactgcccattttagagtctccacactgagtgtcctcagcctgtctctcaggaagccctttgacatgtttttaagatcctgtgagccatcgttgtggcttctggtttctctcggcccagagctaaaacaccccacctgtttgccaccagacagaaaaatgtctgtttgttcaggcctttattcctcttatcttactgtgcactcctttccctccctctgggaagccagccagacacactgaggaaatggcttagttttctcatgtaaaaacaacaaaatccattttttgaaagaataatataaaaacgtatgatgaatggggaaaaaaccaactatacaaacataaatattacttctgtacatttgtcttctacaattagctttaaaatcatttttgtttgaacagctgagatatttggtactggccaggaaaactggagcttagagaaggggtatctgtttccaagacattctctctatggtgtcatttacaaaagacttcaaatcagcattagattgggaaggggatgagagagaccagagcccagtgagcagaagattaacagtatgtacctgcccagcccatgtgtccttctccttccttaataagtgggtgcagaaattagatttctggtagatggccactgaaattctataaagtgcttatgactgcaagttaagtggacaccagtgatgtggtctcttctgctggaactacattttggaaaatataccagaagcaatagatctaaatcaatccaagcttatacaagtgacttttttcagggacaaagtagcagtctcagagtgggagccaaccaaatagaagaaaattaagaatacacctcttactctgttagaagaagaaaatccttatgaataataaggaacataagggagtatctttcccttcaatgtgctgtgtgcagtccgaggaataaggaataagcccccactgtgtgtctgcaaggaagaggctatctggtttctgactgacttccctgggttaggttcatacctagcacccagaaggtcctcagtagagacctattgaggtccagtaggctaactctctgcagggtagcaaagaatttgctctgagtttgttcctaactctgtaaggaatagtttaaactatctttaacaccaaagctgcatgaaaatggctgtctcagctgggcatggtggctcatgcctgtaatcccagcagtttggtagactgagacaggaggattgtttgaggccagaagttcgagaccagtttgggcaacgtagtaaggccccatctcttatttaaaaataaataaaatatttatttttttgagacggaattttgctcttgtcacccaggctggagtgcaatggcatgatctcggcccacggcaacctccacctcctgggttcaagcgattctcctgcctcagcctccccggtagctaagattacaggcgtgcatcaccacacctggctaaattttgtacttttagtagagacagggtttcaccatgttgcccaggctggtctcgaactgacctccagtaatccacccacctcagcctcccaaagtgctggggttacaggcgtgagccaaagcacccagcctaaaatgaaatcatttaaaaaaagaaaatggctgtctctttagaactatcaatttatccatttattgggtacagtctcttggggacatggaagtgctagaagtaatccaggagagctggctgtgaaaaagttcactgtgaggagacattgtacacatagcaatctggatgtgtctcagatgcagggctcagagtgatggaggccatactgaaaaggccacatgctgagtgacatatgtatttatgggacatcctggaagagacagactacagaaacagagatcagtgggtgctggggatcaggggggcaggggttgagtacaaaagtacactggggaaatttccagatgatggaaatattctgtttttttttttttttttgaaatggagtctcgctctgttgcccaggcaacctccgcctctcgggttcaagtgattctcctacctcaggctcccaagtagctgggactacaggcatgtgccaccatgcctggctaatttttgtatttttagtagagacaggtttcaccatgttgaccaggctggtctcaaactcctgacctccggtgatccacccgcctcagcctccaaagtgctgagattacaggtgtgagccattgcgcctggccgaagtattctgtatcttgatggcaatggtagttacccaactatggatttgttaagacttgcagagttctacattaaggaggtgtatgtacaccactcctcaatttttttatttttatttatttatttttttgagatgggtgcctcactctctcccaggctggagtgcaatggcacgatctcggctcactgcaacctctgcctcccaggttcaagcgattctcatgccttagcctcctgagtagctgagattacaggcacacaccaccatgcctggctaatttttgtatttttagtagagatgggggtttctccatgttggccagcctggtcttgaactcccgacctcaagtgatccgcccacctcagcctcccaaagtgctgagattacaggtgtgagccaccgcacctggccaccttaattttttttaatggggaaaaatatgtttgtaaaaaaagtcttgatgcacattttacaagaagaaagagacgctgtgagagccaaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccaggttcaagcgattctcctgcctcagcctcccgagtaactgggattataggcacgtgccaccatgcccagctaatttttgtatttttaatggagatggagtttcaccatgttgttcaggctggtcttgaactcctgactttgtgatccgcccgcctcggcctcccaaagtgctgggattacaggcgtgagccaccatctctctcttttttttttttttttttttttttgagacagggtctcgctttgtcacccagggtggaatgcagtggtgtggtcatagctcactgcagtctcaacctcctgggctcatgtgatcctcccacttcagcctcctgtgtagctgggaccacaggcacagccaccatgcccagctcctcatatcatttttttgggcacacgtgcatgtttggttgtctgccttgtttcctccaatccctttcattgttttccacggttcaaaataaaatgaaatcttccactgtggtttcctgacttattttccccatgataggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtgga

SEQ ID NO: 568 - DNA, 71055 bp, Homo sapiens; identical to SEQ ID NO: 567

SEQ ID NO: 569 - DNA, 43099 bp, Homo sapiens
attggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcactttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccattggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatataagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttac

SEQ ID NO: 570 - DNA, 43099 bp, Homo sapiens; identical to SEQ ID NO: 569

SEQ ID NO: 571 - DNA, 3134 bp, Homo sapiens
aaacggtcaacacaagtttatttattctcacataacaatactgagtggatatttaggtcagtaaggcacagttctcctccacttaggaatctcccatcttcaggccttgccttctccagagcctggtcaccatctgcttccagttggcagaaggagtaacagcacaggggagcacctgttggaggtctgtatgggccaggcctggaaactgcacacctcttctggtcactttccgctggggagagcataggcacagagccacacttaaattttactttgaggaatgcagtgtaggtgtatgtccgacaaagaaaacaataattcggtagacaaataagtctccactccaatattcaattacttacttaacttatgctctggtatgtctcaaattaacctagatagaaatgaactctgaatcttccacttccatcaagtttttcactcactcaatggcatcattatccatccagttgcttaagcatacatttgaaagttatccttggtctgtttcttatccttcccttccacatctaatccttcaggaagtcctgacaatgttacctccaaaatatgtcttaaatccatcttctcagccaggcacggtggctcacgcctgtaatcccagtactttgggaggccaagggaggtgaatcacttgaactcaggggttggagagcagccggggcaatgtggagagacccaatctctacaaaaaaaatacgaaaaattagccaggcatggtggcatgcgcctatagtcccagctactcaggatgctgaggtgggaggatcgcctgagcccaggaggtctaggttgcagtgagctgtgatcacgccactgcactctagacagtgggaccgtttaaaaaaaaaaatccatcttctctacacctttaccgccacctccttagttcagacagtgtaataatctctcatctgcattattctccaatagcctcctaatagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgt

SEQ ID NO: 572 - DNA, 51197 bp, Homo sapiens
gtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaagaccaggttttttgtctgtttgtttgtttttgagacggagtctcactctgtcgcccaggctggagtgcagtggcccgatcttggctcactgcaagttccgcctcctgggttcacgccattctcctgcctcagcctcccgagtagctgggattacaggcgcccacccaccacgccctgctaattttttcttttgtttgtatttttagtagagacggggtttcaccgtaatagccaggatgggctcgatctcctgacctcgtgatctgcccgccttggcctcccaaaatggtgggattacaggcgtgagccaccgtgcctggcccaaggaagacgaggttttaaatcataaagattctaaaagactgccttgacatatccttcttttgttttgggttttgtttttttttttgagtcggagtctggctttgtcatccaggctggagtgcagtgggatgctcttggctcactgcaacctccacctcccaggttcaagtgattctcctgcctcagcctccccagtagctgggactacaggcacgtgccaccacacccagctaatttttttgtatttttagtagaggtggggtttcactgtgttagccaggatggtctccatctcctgacgtcatgatttgcccgcctcggcctcccaaagttctgagataacaggtgtgagccaccgcgcccagccttggtttgggttttattggcacagaggcatgatatgccgcctgaagttatttaattgggttgtgaatcaaagcgtatgtggccagtttttaaacattgtctcctgtgtgccagatggtgtcctagacacaaatggtacaagccagactcctagatgtccctactgtcatgtagcttatattctagagggtggggttactgctaggtggttttaattaagtgtggaaagggtgaggagtactgtgttaaatagggtagtccgaggaggtgacactgtagagttctgatggaaatgcgagagcaagccaccactgtctcagggaagagtataacaggcagtgggaatagcaaggacagaccttgaggtagaagcaggtgtagtgtgatgtaggaagagcaaggtggctggaatgcagtgggtcagtggagatgatgtagagcagcaatgggaagcaaggcacttagggccttgtaggccatcgtaagaactttgggtttgaccctgattaaaaggggaactataggagagttttgaacagaagagagacatagttccaggagataagtatacaaatagggcagcaatgtcacttagtggttgttatagcttctctaggtagactcagttgaaatctcaccctatgtttttttttgatacagagtctcactctgtcacccaggctggagtgcagtggtgtgatctcggctcactgcagccgcctcctcccaggttcaagcaattcttgtgccttggccctccgagtagctgggactacaggcgcacaccaccacgcccggctatttttgttgttattgctattttgttgttattgttgttatattgctagaaaagatggggtttcaccatgttggccaggctggtctcgaactcctgacctcaggttatctgtccgccttggcctcccaaagtgttgggactacaggcatgagctaccacgcccagcccagcgtttctattttattagccgtgtgtctgagtacgacatcacttcacttctgtctcgttagtttcctcatctgtagatgggataaaagcactcccagcttatagggttttttgttggtttgtttgttagtttttgaggattaaatgagcagatatacccaaatgtgcttataataatacctaggccaggcacggtggctcacacctgtaatcccagcactttgggaagcctaggcgggcggatcacctgaggtcaggagttggagaccactctggccaacatggcgagacccccgtctctactaaaaatacaaaaattagccgagtgtggtggcacacatctgtaatcccagctactcagaaggctgaggcaggagaatcgcttgaacctggggggcagaggttgcagtgagctgagatcatgccactgcactccagcctgggcgacagagttagactccttctcaaaaaaataataatacctaacagcaagagctcaatgaatattagctcatagcaacttaagggtgctttagaaagagttgtttttttcacttgactcttgcccagcccaattttcttaaaatttttttagcttttcttcactcagaagtactcaataggtcatggtgaatctacgctaatttgggcatttccagccaatacctattggtggacttgaaaatcagtactgattaggatgtactgctttggaagcaagccagcattacatcaaataaaaaacatttggtctgtggcattgtgttgtattcattgttttgctttttggggggtgttcagcagatggtgagcactgagacaaacctgtagtgttcagctggaaagctattttcctggcctccagccacaacactttaactcttgctgccagactacctgagagtgggttgattggactttaagatctcatcctcccttatccacggttttgctttccacaattttagttacatatggtcaactgcagtctgaaaatattaagtggaaaattccagaaatcaataattcataagtttctttttctttttttttttttttgagacggtcttgctctgatgcccaggctggagtgcagtggcgtgatcttggctcactgcagcctctgcctcctgggttcaagcaattcttctgcctcagcctcccgagtagtagctgggattacaggtgtgcaccaccatgcctggctaatttttgtatttttagtagagacggggtttcaccatgttggccaggctgatctcgaactcctgacctcatgatccaccctcctcggcctcccaaagtgctagagttacaggtgtgagtcaccatgcctggctctcataagtttcaaattaagcactattctttgtagtgtaatgaaatctcttgccatattgcctgggacatgaatcatcccagcatgttcacactgtatatgcttcctatcctgtagttacttagtagtcatcttggttatcagaacaaacagtatgtatagggctcactactatccaagatttcaggcatccactggaggtcttggaacatatcctcccttatctgtggggactactgtactcttaaaaactttaggataaggggctgggcgtggtggcttacgcttgtaatcccaacactttgggaggctgaggtgggtagatcatttgaggtcaggagtttgagaccagcctggccaacattgtgaaacccccatctctactaaaaaaaacaaaaaaaaattagctgggtgtggtggcaggtgtctgtagtcccagctactcgggaggctgaggcaggagaatcacttgaacacgggaggtggaagttgtagtgagctgagattgctccactgtactccagcctgggcgacagggtgagactctgcaaaaaaaaaaaaaaaaatttaggataaggtcaaatggctgtaagtggaggctctatcttctattccctgtatcttctattacctgtatctctagtcccatagccccatgactttgctacacccaaggcacttagctaaatctggagagtgggcattttgggattagggattcttacatattgttttctattatgtatagcgagtcgttaatatttgatggagtttgtgaaaatccatttccttagtttttaaaattaaaaaaaattgtatagtttgtacatcataaaaatacccccaatataaatgtacagttcagtacattcagtgtaaatgttcagtaatttttagtaaatttatagaggcatgcagccatcatcacactctggtgtataatatttccatccctgctagaaagttccttctgcctggttgcagtcagccctgttcccattcctcgccccttacggccactgatttgctttgtcactatagtttttgccttctccagaaattatttccttaatagcttaccaattttatgtgtttgatttcttagcaaatttctcaggttcatccacgttagtgcatgctttagcagttcattctttttattgagcagtagtctttattgcttatccattctcagttataggacatttagattatttctagtttttagctgttgtgaataaagtgataaaactgtacaagttttgtgtgaatatatgtattcatttcttcagtgtagatagctagatgtggaataactgggcagtatagtaaatttatgtttaactttttaagaaaccaccgaactgttttccaaagtggttgtaccattatacattcccactggcagtgtttgaaagtcctgtttttttctaccatcttcacaaatattaggtattttcagtcttcctattttagtccttctggtgggtgtgtagtggtattatgcttttaatttgcatttccctaacgactaatgctgttggacatctttttgtgtgcagatttgacattcatgtttcttttctggtgaagggtctgttccaatcttttgccccatttttttttttttttttttgagatggagtcttgctcagtcgcccaggctggagcacagtggcacgatctcggctcactgcaaccaccgtctcccgggttcaagtgattctcccgtctcagcctcccgagtagctgggattacaggcacctgccatcatgcccagctaatttttgtattttagtagagatggggtttcaccatgttggccaggctggtcttgaactcctgacctcaggtgattgcccaccttggcctccaaaatgctaggattataggcatgagccactgtgctcggcctctttttgcccgttttagaattgcttttttttgttttgagatggagtctcgctttgtcactcaggctggaatgcagtggtacgaccttggctcactgcaacctcttcctccggggttcaagcgattctcctgcctcagcctcctaagtagctgggattacaggcatgcgccaccatgcccagctaattttttgtatttgtatttttatttttttatttattttttgtatttttagtagagatgaggtcttcaccatgttgaccaggtggtctcgtacttctgacctcaagtgatccgcctgccttggcctcccaaagtgctgggattacagatgtgaaccaccatgcccagcctaaaattgatttctttgccttattgagttataggattatttatttatttttttattaatttttttagagatggggtctcacaatgttgcccaggctggtcttgaactcctgggctcaagcgatctgcctgcctcagcctcctgaagtgctaggattactgcacctggccaagagttcttttttttttctttcttttttttttttctgagacaaagtcttgctgctcttgttgcctaggctggagtgcaatggcacgatcttggctcactgcaacctccacctcccgggttcaagtgattctcctgcctcagcctcccaagtagctgggattatgggcatccaccaccatgcctagctaatttttgtatttttagtagagactaaaaattttagttttgccatgttggccaggcttgtcttaaactcctgaccttgtgatctgcctgcctcggcctcccaaagtgctgggattgcaggcgtcagccaccgcacctggcctagagttctttataaactgaataaaagtcatttatcagctatgtgattggcaaatattttctcccagtctgtggcttatcttttcattttataatggtgtcttttgaagagcaaaaggttttaaattttatgaagtccagtttagcacatttttttctttttcttttattttgttaggacagtctcactccatcacccaggctggagtgtagtgatgcgatcacagttcgctgcagccatgtccttctaggcttaagtgattctccctcctcagcctcctgagtagctgggaccacaggtgtctaccaccatgtttggctaattaaaataacttttttttttgtagagacacgggtcccactgtgtagcccaggctggtctccagctcttgagctcaagcagtcgtcacactttggccttccaaagtgctagaattataggcatgaaccaccacgactggttgtgaaatatccttttttttttcatagatggagacttgctctgttgaccaggctggagtgtagtggcgtgatcttggctcactgcaacctctgcctcccaggttcaagcagttctcctgccttagcctcccaagtagctgggattacaggtgggtgccaccatgcccgcctaatttttgtctttttaatagagacggggtttcaccatgttggccaggctggtctcgaactcctgaccttgtgatctgcctgcatcggcctcccaaagtgctgggattacaggcatgagcaactgtgcctggccaaaatacctttttatttcatattgaagatgcagcttttacgtgggtgcgagagtgctataagaaaggcataactatagactctaatatttttcgagaaaaagtcattgtgtcttaaaaggaaggtaaaggatctaaagttggagaatttaatgccagcaaaggatggtttgataactgtagagaggtttggcttaaaaaaatgtcagggtaacaggagaagcagcttctgctgaccaagaggcggcaaacaagttcccagatgccattaagaaaatcattgaggagaaaggatatctgcttgaatgggtttttaatgcagacaaaaatgccctgttctggggaaaacaatgccacaaaggacatttatgagtaaggaagagcagtgagtgccaggatttaaggcaggaagagctaggttaactgccgttttgtgtaaacacagtcaagtttatgatcaggactaccctggtctataaagctgctaacctctgagccttcaagggagaagataaaacaccagctgccagtctgtttttaccaaaagaaagcctggataatgagaacccattttcttttttttttttttttttgagaggagtctcgctctgtggcccaggctggagtgcagtggcacgatcgcggctcactgcaagctctgcctcctgggttcacaccattctcctgcctcagcctcccgagtagctgggattatagttgcctgccaccacgcccagctaatttttgtattttagtagagacagggtttcagcatgttggccaggctggtcttgaactcctaacctcaagtgatccgcctgcctcggcctcccaaagtgctgggattacaggcatgagccaccgtgcccggccaggactgccttttaaagtttttttgacacaatgcccctggccactgagaatcccatgagttcaacactaggctttgaagtggtctacttgtccacaaacagtgtctctaatccagcctgtagatcaggaggtctcaaggactttttgagaaagagtctggctctgttgtccaggttggagtgcagtggggtgatctcagctcacttcaacctctgcctcccaggttcaagcaattctcatgcctcagcctctcgagaagctggaattacaggcatgctccacaatgcctggctaatttttgtatttttaggagagatgaggtttcaccattttgcccaggttggtctcgaactcctggcctcaagtgatctgcctgcctcagcctcccaaagtgctgggattacaggcttcagctgccgcacctggtccaggactttcaagactcattacatgggatactctggaaaagattgttaacaccaaggaagagaatcctgatagaatgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatgacttgatggagatgagtgcttctgtgccagacagtaaggaataagatgtacaagaaacaggggcaggaaaaaattgacattagacaatttgccagaagggttccaattattcaagacttcctttagctttgtttatggaatatggaatggaaccttctgtgatactggcactgaagtgaaagcaaatggtggaagaaggattagtattgtatagaaatgtttttagagaaatggaaaagcaaaaaagtcagacagaaatgaggatgtatttttgtaatgttacaccagatgtgcctgcctctcctgccttcctttccatgcccttcacctcttctacctctgctgccccaagacagcaagaccaaccaactccttttctttctttccctcagtctactcatcctgaagatgggtgaagacctttatgatgatgcacctccacttaatgaatagcaaatatgttttctcttatgattttcttaataacattttttctctatcttactctattgtaacaatatagtatgtaatacataaaatatgtgttaattgactttctgttgtcagtatggttaacaggctattagtagttaaattttgggggagtcagaagttatgtgcagatttttgactgcccagggtgtcagtgcccttaaccttcacgttgttcaagggtcaagtatattatcttatctattaacgtagtagagctttccatttctttagggcttcttcagtttctctaagcagtgttttctagtttccagtgtataaatctataaatcttgccttttgataaatttattctttttttttgagacagagtctcactctgtctcgcaggcttaagtgcagtagtgcaatctcggctgacggcaacctctgcctcccaggttcaagcaattctcctgcctcagcctcctgagtagctgggattacaggcttgcttcaccatgcctggctaatttttgtattttcaatagagacagggtttcaccatgttggccaggctgatcttgaactcctggcctcaggcaatccacctgccttggcctcccaaagtgttgggattacaggcatgagccactgtgtccagcctgataaatgtattcctgttttcttcttcacgcctgtaatcccagcactttgggaggctgaggtgggcggatcacgaggtcaggggatcgagtccatcctggctaacacagtgaaaccccctctctactaaaaaaaaaaaatacaaaaaactagccaggcgtggtggcaagcgcctgtagtccctgctgcttgggaggctgaggcagaagaatggcgcgaacctgggaggtggagcttatggtgagccaagatggcgccactgcactccagcctgggtgacagagcgaaacttcgtctcaaaaaaaaaaagaatggaattgttttcttcatttcatttttggattgtttgtcactagtgtatggaaatacagttgatttctgtatgttgattttgtattttgtatccttagtacatttgcatactagttcttatagatcccttaggattttctacatataaaacaaaatttttttgttttgagatggagtctctctctgttgcccaggctggagtgcagtggtgtgatcttagcttactgcaacctccgcctcccgggttcaggcaattctcctatctcagcctcctgagtagctgggatgacaggtgcctgccaccacacctggctaatttttatctgtttagtagagatggggtttcatcttgttggtcaggctggtctcgaactcctgacctcaggtgatccacccgccttggcctcccaaagtgctgggattacaggcttaagccactacgcccggcctggctgacagttttatcaggaatgggtgttgagtttttgttaaatattttcccttcatctattgagttaattatgtggtttttgttctttattcttaatatagtatatggtaatattacgttattttcagatattaagccaatcttgcattcctggtataaaccccactcagacccacttagtctggtgtagaatcattcttacatgttgctagtttcagtttgttaatattttgttgaggattgtttaatctatattcatgatagatactttcttgtgatgcctttttcgagttttggtatgaatgtaatgctagctttatagaacaagttagaaagtataccctcctctatgggatcattactatgaacatagtaaagattttcttttctttttctttttctttttcttttttttttttgagatggagtctcattctgttgccaggctggagtggagtgcagtggcatgatctcagctcactgcaacctccgcctccctggttcaactgattattttgtctcagcctcccaagtagctgggacttgaggcgtgcgccaccacgcccagctaatttttgtatttttagtggagatggggtttcaccatgttggccagatggtcttgatctcttgacctcgtgatccacctgcctcggcctcccaaagtgctgggattacaggcatgagccaccgtgctcggccagtaatgattttcaatatgaaataaaagggtattttacagccaggtgtggtggctcacatctgtaatcccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgagaccagcctggccaatatggtgaacccccatctctactaaaattacaaaaattagctgggcatggtggtgtgcacctgtagtcccagctacttgggaagctgaggcagaagaatcgcttgaacctgggaggcagagattgcagtgagccaagattgcgccactgtactccagcctggtgacaaagtgagactccatctcaagaaaaaaaaatgcgttgtttaatttcttttttttttttttttcttgagatggagtttcgctcttgttgcccaggctggagtgcaatggcgtgatcttggttcaccgcaacctctgcctcccaggttcaagcgattatcctgcctcagcctcccgagtagctgggattacaggcatacaccaccatgcctggctaattttgtacttttagtagagactgggtttctccatgttgatcaggctggtctcgaactcctgacctcaggcgatctgcccaccttggcctcccaaagtgctgggattacaggcgtgagccactgtgtccagtcgtgttgtttaatttctgaatatgtatggatttcccaactttcccttctgttcatttctggcttaattccatggtggttggagaacttcatataatttattttcaattcatttagttttttttatgatctagaatatggcctatcataagccatttcagattaagactaactttaaattaatactaatagtttcagtaaaatatagaaaatgctccagtttagctccattgtctccctcttctttttttttctttcttttttttttttttgagacggagtctcactctgtctacccaggctggtgtgcagtagcatgatctcggctcactgcaacctccacctcctgggttcaagtgattctcccatcccagcgtcctgagtagctggaattacaagtgtgcaccaccatgcctgtctaatttttgtatttttagtagagatggggtttcaccattttggccaggctggtctcaaactcctgacctcaggtgatccacctgccttggcctcccaaaatgccagggttacaggtgtgagccactgtgctcagccttctccctcttcttttgtgttactgttgtctatgtattatatatgtatatattacaaaccagaaaatacagtgttgtagttatttgtttatgcagttaaatcttatgtgttttaaataagagagaaaggaataaaatatatttacagccttttatgttaacctacagtatatttaccatttttgttattcttcattttttccctcttgatccaagttactatctgatgtaaattctctgttgattttctggatatgtatttttgaaatgcttttatgaggattataatatgcatctttaatttatcacagtccactttgggttaaaattgactaaagtctggtaatatacagcacctttgctccaaggtagctctatttcctcctttctcccttgtgttcttattgtcatgtatatctttatatgttataacctatcttatgtatatttatgaaattaagagaagaaaataattttttccatgtttacctgttctagtactttctgttccttcttgtggatccaagttttcttttttcttttttttttttttgagatggagcctcgctcccgttgcttaggctagagtgcagtggtatgatctcggctcactgcaacctccacctcccgggttcaagcaattctccttcctcaccctccgtagtagctgggaatacaggtgtgtgccaccatgcctggctattttggggttttattttgtatttttagtagagacgaggtttcgccatgttggccaggctggtcttgaactcctgacctcaggtgatccctcccatcttggcctaccaaagtgctaggattacagacgtgagccaccgtgcccggcctgatccaagttctcatacagtagcattgccattctctccaaaggacttcctttggtagttcttgtaggccaagtctactagcagtgaattctttcagtgtttatttatttgataatgcctttatttcactgttaatttttgagggatagttttgttcaatatagaatttatgcttgacagttgttttttcagtactttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgatccgcccgccttggcctcctaaagtgctgggattacaggcgtgagccaccgtgctcagcctgttgagcacctctgatcagtttttcatgccagtcattataatttttaactctagaatttccatgtggttcctcttcattttttctgtttctcggctgaaaatctctatttatcattattttttacttcgtcatcagttttctttaattctttggacgtttaaaatagttgcttttaagtgcaactacttgctcaatctagtatctgcatccaatcagagatggatgctattgatttctctttttcctgagcttaggtgacactttcctggtttttacaagtctagtaattttggttgaaaactggacatttagataatatagcaactctggattctgagttttcccccctgtggcttgttatatttacagttaattgcttagaattaaaccagaatctatttttcctttggtgtgctaatgtctctgcttagttttaaattattattagttttttcgagacggagtctcactctgtcaccaggctggagtgcagtggcatgatctcagctcattgcaacctccgcttcccaggttcaagcgattctcctgcctcagcctcccgagtagctgggattacaggcacccgccaccacgcccagctaatttttgtattctcagtagagatggggtttcaagctggtctcaaactcttgacctcgtgatcctcctgccttggcctcccaagtgctgggattataggcgtgagccactgtgcccggtcaattttaaaatttttattttcagctgggctcagtgtcctacgcctgttatcccagcacttctttttttcttttcttttctttgcttttcttttttttttttttgagactgagtttcgctcttgttgcccaggctagagtgcaatggcatgatctcagctcactgcagcctctgcctccctggttcaagcgattctcctgggttagcctcctgagtagctgagattacaggtgcccaccaccatgcccggctaattttgtaattttagtagagacggggtttcatcatgttggtcaggctggtctcgaactcctgacctcaggtgatccacccgcctcagcctcccaaagtgctgggattacaggcgtgagccaccgtgcccagcgaatcccagctacttgggaggctgaggcaggagaattgcttaaacctgggaggtggaagttgtagtgagccgagattgcgccatcgcactccagcctgggcaacaagagtgaaactccgtctcaaaagaaaataaaatattttcattttttcttcccagcctggcttttggtgggttgtccctgtatctgtttaacttagttgtcagccagtgatttgggcagaggttctcaaatactttcagcccctgaggcttttaccctatcctgatcaacttacagtcaaatgctctactgctgagctatacccccctgatcaatgtgtatgtgggtttggagaaactctaaaaaattgctgctggctctaaagtctcctttggttttcagtttttcctggttctcttaggtataatttcccagtcagtgatggtcatgtgaagagcttaactcagactttctatggctctgtttcaggattttcccattaaatctctggatgttctgcccatctaacaaagacaactgccaaagctgttcatttccatccacattcaccacttttagctggtagatccatgaattttcttcctcaccccaaattgagtccaccccctagagcagcagaactgctgattttcatagctggccccatgttgggaaaactagcattgtcaccagctgactatgctgtaagcagtggggatagaggagtagaaggatggcaggatcctaggctagaaagcttactatttttacctgaacctctagcagattttcaagaatctgtacttctcagtttgtttgatttacactgtattgaaatagttctttctgacaattttaatttttaacttttccattgtggcgaggaattgcctaccacttcatgctgtgaatacaagaatttctatgcctgtaatcccagcacaggcatggaaattcttgtattcacagcatgaagtggtaggcaagtgaggccgaggcaggcagatcacttgaggtcaggagttcgagaccagcctggccaacacggtgaaaccctgtctccactaaaagtacaaaaattagctgggtgcagtggtgggcacctgtaataccagctactcaggaggctgaggcaggaaaagcttgaacccaggaggtggaggttggcgtgagccgagatcgcgccactgcacaccagcctgggcaacaagagcgagactccgtctaaaaaaaaaaataatttccattttttcttagtttttgagcttcagagaatgactagggtctgccttactagagataaaggtaagaatagaggactaatgcccaggccacttctcaaacaagtagtattagaatcccctttgtgtcaggtagtttttttgttttttttgttgttgttgttttgtttgttttttgagatggagtctcactctgtcacaggctggagtgcagtggcgtgatctcggctcactgcaacctccgcctcccaggctcaagcgattctcctgcctcaacctcccaagtagctgggattacaggcgccgccaccacacccggctaatttttttatttttagtagagatggggtttcaccatgttggtcaggctggtctcgaactcctgacctcatgatctgcctgcttcagcctcccaaagtgctgggattatgggcatgagccaccatgcccggcctgcatcaggtagctttaaaaaaatcttctcaggcgattgtgatgtgcagttattgttgagatccagcagtttagaacagtgtttagaaaagcaagctttctctgtaaagggtgatataggaaatattttaggttttgcggtccctgtggtctctgttccaacccctcaactctgttgttgtagtgtgaaagcagccaaagacagtatgaaagcgagtagatatggctatattccaatacactttatttgcaaaaacaggcaatggctgaatttgctgaccccttgtcttggagaattctcaaaaatgattttattccaagtgtttgtatccttgttaatttaaggtagtgtgtatatttcttagcacaacccagcctttgcatttgtcattgatgtctttgaagaattagtccataatttccttcagtagaagtgttttaattgaccatgccttcctaccttctcctttgtcattaaaatatgtgagaaaatgtgccagccgtgggcaatctagttgaaaggtgtgtgttaacttttttggcccagttgggctcagtgaagccttagctggctagtgtttatggcaccatcaacaaagatggaagaattaagcctgggaaaaaggacaggaggtataaaaaatggggtccagaaattcagctgtaggagagcctggtagtggttctcctaccttctgcaaagttcagtgtcaaaactccaatcagagtctctacaagttgaactttcttggctgtccatcaggtagagtactaacttagtaagtacagtggagggccgggtgcagtggctcatgcttgtaatcccagcactttgggaggccaaggtgggcggatcacctgaggtcaggagttcaagaccagcctggccaacacagtgaaaccccatctctactaaaaatacaaaaattagttgggtgtggtggtgcgcaactgtaatcccagctacttggtaggctgaggcaggagaatcgcttgaactcgggaggcagtgaggccagatcacgccattgtgctccagcctgggcgacagagcaatactctgtctcaaaaaataaaaaaataagtacaatggagaatttggtcagacaacttatttttacatccgaggggttgggcatatgaactctgattataatgaatagttcagtagaacaaatcttattttccatagagtctactgtgagtgtatgattccattagttgagtggaacagtttttaccacgatgcttaaattctgcttcaactccctccttcccactactctattcccctgggtctcgtcagatactcctaagtcaaacaggtcatgtagcagataagtgaaggaagtaggcaggttaagtgggtaggtttgagttctgttgaggaggtggtgagtgaagatggagcctaggacctctctgattgggcagtacttgttcctaatctttatgctggggcctgggcagttacccttaatagatggaaaggtgcttagggtaggggatggtagaggacgccagagccatagattatagcctagatagtgcccataactcactgtgtgaccttgacaagctccataatcctgacgcacagtttttcagaagggagtttgtatagcgatcttttgggtcctcctaactcaatatcccttcatcacaaggctttagtctgcctttctagggattaattcctttctagtcattcattccatagttatttactgtatgctgagaacctttaccaagaattggacacagaaaggggtggagatgaagactttccaagcctggcacattcactggatagaggccttgttttcatacctgaacttagcctggtatactagctgctcagtgagtgtgtattacgtaagcaaatatcctattcctgtatactagcgagcgggattcttgtgctacatagtctatcagattttcattgcaacaaaacaacgtgaaagtcttatggattttgatttttttttttttttttgagatggagttttgctcttgtcgcccatgctggagtgcaatggcgtgatcttggcccacagcaacttctgcctcctgggttcaagccactcttctgcctcagcttcctgagtagctgggattacaggcatgcgccaccatgcctggctaattttgtatttttagtagagatggggattctccatgttggtcaggctggtcttgaactcccacctcaggtgatcctcccacctcggcctcccaaagtgctgggattacaggcatgagccactgtgcccggcaggattttgatttcttaaggtctgcagttggtttcctattttacctgtggaagcctgcaaaaatgaattttagactatcacaatttaaatatgtgactttcttgcctgtaaccccagctatttgggaggctgaggcaggaggattgcttgaagtcaggagtttgaaaccaacctgggcaacatagcaagaccctgtctctaaaaaaagaaaaaagaaaaaaattagccagatgctgtggtgtgtgcctgttttcctagttacttgggaggctgaggtggtaggatcatttgagcccaagagttcaaggctgcagtgagaaatgatcacaccactgcactccagcctgggtgaccctcggtcttctcggctcactgcagtctccacctcctgggttcaagcaattctcctgcctcagcctcccgagtagctgggactataggcacgcgccaccacgcccagctaattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcctgcctcagcctcccgaatagctgggattacaggcatgcgccaccacgcatcttgtatttttagtagagacagggtttctccatgttgatcaggttggccttgaactcctgacctcaggtgatccatccgcctcggcctctcaaagtgctgggattacaggcgtgagccactgtgcccggcctttagtttttaaaaatatacattgggtttgtttttgtttctgtttgaaaccgagtcttgctctgtcacccaggctggaatgcagtggcacgatcatggctcactgcagccttgacctccttaagctcaagtgatccttctacctcagcctcctgagtagctgggaccacaggcatttgccaccatgcctggctaattttgtttgtattttttgtagacatggggttttgcatgttgcccaggctggtctcaaactcctgggctcaagtgatccactttggcctcccaaagtgttgggattacaggtgtgagccactgcccctggttatacattggttttaaactatctggatatggtaatgacattctaataacatgtgcaatgaaggacttcttttgcataaagaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaaatcaaacaaatgggaaaaaaacgcttatttttcacaactgtgctctgttggtgaaagcatttggatggaagctggaagcatatatgaaagaatggtagccaaaaatcacattaaaattttttttttcagaacatgagaatttttgctcttagtaactgtgttaccctggacttaggaagttgttacacactttgtagatgcagtatctttaggtcagcttcttaatgtttcagggttttttgtttctttttcttttttttttttttaacttaacaaaatcaaatgctttcaaacagggcccgactcttaattgtaatggagatgatggaagggggagagctatttcacagaatcagccagcaccggcactttacagagaagcaagccagccaagtaacaaagcaggcaagttaaccccaggtaccaatcaaactgccaccaaagttggttaacaagcacaatttcattggggggaagaaaagaaaacttaaagaaaagctctatttgacttctcattgcctgctttgttatgtaatcagaaaagatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaatttcaggatgccccagtgaagttgtgtgactttggatttgccaagattgaccaaggtgacttgatgacaccccagttcaccccttattatgtagcaccccaggtaagcatgtgcggtttctgtcctaagatctgtcaccaagctgcccatcaactcgtgttccttctattctacagcacaagtaggcatatattacagatgggagggggagaacttagctttagaaacctacagattgctttatttggtgtagatcttttattcttttaaaatcaactttagccaggtgcggtggctcacgcctttaatcccagcactttgggaggctgaggcgggtggattacaagttcaggagatggagaccatcctggataacacggtgaaaccctgtctctactaaaaaaaatataaaaaattagccgagtgtggtggcgcacacctgtaattcgtgctactcaggaggctgaggcaggagaatcgcttgaacctgggaagtggaggttgcaaggagccgagatggcaccactgcactctagcttgggcgacagagcgagactccgtctcaaaaaaaaataaataaaataaaataaactttattgaggtatgatttagaagtatgatttacatacagtaaaatacctccacttcaaggagagtttgatgagttgtgacaaatatataccccatatggcgaccaccacattgaagatgtggaacacgcccctcacttcacaagctgcctgtgccactttgcagtcagtcccctcccaacttaacccctggccctaggcaaccactgacatgctttctgtcattattggttagttttgcctgttgaagaatttcagaaaaatgtaatcgtggactttgtatgcttcatttcttttgcttagcatgtttttgagatttgtccatgttcctgcatttatcactcgttaattccttttcattgccaagtagtatttcattatatacctaagctgcatttgttttttccattcactgacaggattttgggttgtttctcatttttggctattatgaagaaagctgctaggaacacttcttttacagtttttgggggacatgttcccccatgcccatatcttttttccaaaatggctataccattttatgcgtctaccagcaacgtatagagttccagtcatttcacatttttactaacgcctcatgcttgttgcttgtcagcatttgtcatcttagtcattctggtagcgggcagagtattacttcattatagttttaatcacgacattgtcctgatggccactattttggagcactttttgtacatgtgtattggccattctgttgtaagtatgggcattcatcttttgccattttgttattgttggtttcttgttaaagaattgaggtataagaattttaaaatattctggacacaggttctttgccatatgtatgttgtattcttactgctgctgtaacatattgtcacaaacttagtagataaaaacaacagaaatgtattatcttatacttctggaaatgagaagtctgaaatggtactcagtgctataatcaaggtgtcagcagggctgtgttccttctggaggcatttcttgccttttccagcttctagaggctgcctacattatttggcttgtagcctcttccttcatcatcagagccagtagcatagcatcttccaatgagtgtctctctctatgactttgaccctcttgcctgcctcttataaggaccctactgatcacattggccttacctagataactccccattttaagattcttaacttaattgttctgcaatacaaggtaaaataatcccagggattataacatggacatcttggggggccattattctgccttccatatatatatcatgaatattcatctcagtctgtgacttgccttttaattttcttaatggcctttgaatagcagaagttttgaattttaatgaagtctgtttcaccattttttttttaatgcttagtactttttgttcctaagatccacaagcataaatattttctctgatgttttcttataagaggttatagctttagcttttacatttgggtctgtaattcatctgagtttgtgtgtgtatgaaatgagagaccaggttctttttttcccccttaagggtgtcaagttgttgcagcatcattggtaaaatgttttttacaaatcatcatttgtaaaaggatttgtaaaaggattgcatcattgaattgcagttttttgtttgtttgtttgtttgtttttgagacggagtttcattctttttgcccagcctggagtggtgcaatggcgcgatctcgactcactgcaacctctgcctcccgggttcaaggaattctcctgcctcagcctcctaagtagctgggattacaggagcccgccaccatgtccggctaattttttgtatttttagtagagacggggtttcaccatgttggccaggatggtcttgatctcttgacctcgtgatccgcctgcttcggcctcccaaagtgctgggattacaggcatgagccactgcgcctggcctgaattgcagttttgttgaaaaccagctggccatatatctgttggtcttttctggattctattctgtttgtttaatatatgtatgtgtctatagcaagagcatctgcattattgtagctttatattatatcttgacttcagattcattctttttcaaaattgttttggctattctagatcctttgcatttctctacattttagaattcacttctgtataacagaaaagcctcctgggatttgactggggtggtatttaatctataggtgaatttggagagaactgatatcttaacaatataagtctcccaatcgatgaacaaggtatatatctctccatttgtttaggtctttaattttcctaaaaaatgtttatgcttcttaatgttacaggtcttgcacatattttcttaaatttatccttaaattttgtttttggatgctgttggaaatgatattgtaaaacatttcagctgggcgtggtggttcacgcctgttataccagcactttgggaggctgaggcaggcggatcacctgaggtcgggagttcgagaccagcctggctgccatggtgaaaccccatctttactaaaaatacaaaaatttgctgggcgtagtagccggtgcctgtaatctcagctacttgggaggctgaggcaggagaatctcttgaacctgggaggtggaggctgcagttagtcgagatcatgccattgcactccagcctgggtgactagagtgaaactgcgtctcaaaaaaaaaaaaattcattttctaattttaactagtttatagaaatactagtgttttttgtttgtttgttttgggtttttttttttttttttgagatggaattgcactctttgttgcccaggctggagtgcagtggcgcaatctcagctcactgcaacctctgcctcctgggttcaagcaattctcctgtctcagcctctgggatgacaggcgcccgccaccacacctggctaatttttatatttttagtagagacagggtttcaccatgttggccaggctggtctcgaactcctgacctcaggtaatccacccactttggcttcccaaagtgttgggattacaggtgtgagccactgcccccagccatactagtgactttttttttttttttttttgagatggaggcttgctctgttgcccaggctggagtgcagtggcgcaatctcggctcactgcaatctccgcctcccaggttcaagcgattctccttcctcagcctcccgagtagctgggactacaggcgcccgccaccacgcccggctaattttttttcatatttttagtagagacggggtttcaccttgttagccaggatggtctcaatctcctgacctcatgatctgcctaccttggcctcccaaagtgctgagattacaggcgtgagccactgcacccggcccatactagtgatttttgtatattgactttgtgtcttgggaccttcctaaattcatttattaaatctagtaaattttttgtagatttattaggattttcttttttttctttttcttttttgagagcctaaaagtgggcatgcctcttctgttgctcggcctttagtgttgggtttgagggttaaatcagtctactcaaaagttgagctgagtgtgagttttgttgttgctatcgttgtcttcagtgcctcagtggcatgggattcctgttttgttaccttatggttaggtgggatctgaaatgccattttttttaaaatttaaaaaaaatttttttaaaatattccacttctaccctcagtcttggccttgctagtgcacctgtacctcagaggggatctctctttacagtcttggcccccccttagcaatagattgctgtcagttactgcttggtccctgcaagcctgcagaaagggagatggcaatgggggaccgagaggtatctgtttctctgctgttgggcaggacctgtgttcttgagtctcatgaatatctggtggaagtctgtgcagaagagtatgggagcaggcatgagtcttccttgtttgtatggctcctagagggtctgtactcttatcctagcccacattttgcctttagcagtttgttaaaaacctcgctgaattctttttacccaaatggcatgtgatatcacttcctcctgcgctctgccataggtgagccagctttcactccccatctctccttggaagggcctgacttaaagatttccgaataattggttaacctgagacctgatctttgatgggttcaaaaaaagtgatgggccgggcgcagtggcttacccctgtaatcccagcagtttgggaggctgaggggggtggatcacttgaggtcaggggttcaagactagcctggtgaacatggtgaaaccccgtctctactaaaaagacaaaatattagtcgggtgtggtggcagccacctgtaatcccagcttctcgggaggctgaggcaggagaattgcttgaacctaggaggtggaggttgcagtgaacaaagattgagccattgcactccagcctggtgacagagcgagactccatctcaaaaaaaaaaaaaaaaaaaaaggatgattttataatttatctttgacactttccagctttctatatcctagcagaaacagaaatcccaacaatttgggtggaaggagggtgaggatcaaaaaactacctatgtggtattatgcttatataaaacctgggtgatgaaataatctgtataccaaacccctgtgaagacactgcagttcacctatataattaacatgcataaagcacatgtacccctgaacccaaaataaaagttaaaaaaaaaaagtcccaacaatttgattatgtatgcattcttgttcctttgtttttcctgccagggatctcttgagctcctgggatctgttggtttatggtgtttatcaaataaacaccatatcaaataaaaattaggaaatttttcagacatcatctcttcaacgatttttctactcctctacttgttttctgagacttccaatcaatgacatatatattagactgtacagggaactggagttctgatcttttgtattttcatccttttttccttttctttcatccttttttttctttctgctttcccttcccttcttcccttctgatatatactcaatagtggcactgctggatgataaggtatttctagttttaatttttttaggaagcttcccactgttttccatagtggtcatactaatacacattcttacagtgtacaaaggctcccttttttccacatcattgttaacacttgttatcttttatcttttttaatagccactgtaaaaggtgtgaggtaataatttcattgtggttttaattttaattttaatttttttttttgagatggagtcttgctcctggcacaagttggagtgcagtagcacgatctcggctcactgcaacctccacctcccgggttcaagcgattctacttcctcagcctcccgagtagctgggattaaaggcatgtgccaccacgcccggctaattttttgtatttttagtagagacagggtttcgccatgttgttcaggttggtcttgaactcctaacctcaggtgatccactcgccttgacctcccaaagtgctgggattacaggtgtgagccaccatgcccagcctgttttttttttctttaatatttctggcctacaaatgactccatttgcttatttttttaatgcagtgtatgaaagtttcaggtcttctgcattttcacctgcatttggtatggtcagtcttttttattttggccattttagtgtatatgtagtggtatttctttgtagttttaatttgcattccctaatgagtaatgatgtctgccatcttttcttttgtgtacacatttgtgtatgcacctgccttctgtatattttcttcgggaagtgtctgttcagaccttttctgtatttacaaaattgggttgtttattttcttattactgaatttgagagttctttgtatatttcagatatgaattcctttcttttttttgttggagacagggtcttgctctgccacccaggctggaatgcagtggcacaatcatgactcactgtagcctcaacctcctgggctcaagcgatcctcccacctcagcctccttaggagctgggaccataggcatacgccaccacatctggctaattaagaaatttttggtttttttttttaagagatggggcctcaccacattgtccaggctggtctcgaacttctgggctcaagtgatcctcctgcctcagcctcctaacttgctgggattacaggcatgatctaccacgtccagctgactctgactctttttttttttttttttaaactctcccaggttgtcaagagatggatacgaatcttttattagatctgtgctttgcaaagattttctcccagtctgtggcttatcttttcattctttaacagtgtcttttgaggagcagaaaattctaattttcatgaatgccagtttatcagaaaacttttttaaggcctgtgcttttggtttcctatgttgaaaatctttgtctcacccaagatcagtctcctatgttttcttctagaagttttatatagtgttaggttttacatttaggtctgtgatccatgttgagtcaatttttatataatgcatgaggtatggatccaagttcacttattagcatttggatgtccagttgttctagcaccatttgttgttctatttatttattatttatttatttatttatttatttattttgagacggagtctcactctgttgccaagttggagtgcagtggcggatctcagctcactgcaacctccgcctccagggttcaagccattctcctgcctcagcctcccgagtagcagggattacaggcacctgccactacgcccggataattttttgtatttttagtagagacggggtttcaccatgttagccaggatagtctcgatctcctgacctcgtgatcctcctgcctcggcctcccaaagtgctgggattacagacgtgagccaccatgccccgccttaatttttatcttttaagccccaccctcagaagcaaccgttcatgaaaaaggctgtcttttctctgcggcattgcttttgagcctttgtcaaaaatcatggagcatatatgtgtgaatttatttttggactctttattctattccattgatctctttatctatctttaccccaataccacactgtcttgattactgtagctttataataattcttgaaatcaggtagcgttggccctccacctttgttcttcattttcaaagttgtttttgctattctgacttccttgcatttccatgtgaactttacagtcagctgttgatttctataaaaaagcctactgggagttttgactggggttgttttagagctatcattcaatgtggaagtgctgagattttagtgatattgagtcttctgacctatgagcaagctgtatcactccattcatgtttgtctcataattttgctcagcaatattatgtagtcagtttataggtctctcacatatttgtgagatttattcttaatgcttgatattttttctgctgttgtgaatggtgttttattttcgggtttaattaactcactttgttgttcttgtgtaaaagctctatatggtggtcgtggttagagcccaggtcctctgcatggagactttagagtaggtttttttttttttttttttgagatgggattttgctcttgttgcccaggctagagtgcagtggctcaatcttggctcaccacaacctccacctcccgggttcaagtgattcttctgcctcagcctcccatgtagttgggattacaggcgcccaccaccatgcccgtctaatttttgtatttttagtagagatggggtttcaccatgttggccaggctggtctcgaactcctgacctcatgatctgcctgccttggcttcccaaagtgctgggattacaggtgtgagccaccgcacccagcctagtgtagttttttataagatggtcagtgaatttctattaggtgagatagctgcaggtcttagaggtggcactgaagatggcctttgcaaagttgcccaagatggcactgcagcccctggctaagtggtagcagttgtatcccatccgccccagcttcatgggcacaggggctgagacagtatcaagtaggtcggggtgtgggatgaagtccccttgcacagaacctcagcatcctgtgacttttcaaggaacagtgtggggctgctaatgttgtgaccccctctggagttcctcctcatgggacattagagaggttggccaggataatggtctcacggtggcagtggctacctccttggagcacttaacacctagactgacatgactgtcatagtccctgatggtaacagatggcttgaagctcatctgctggacagatctgctttcgcataggcataagggctatccccaggaaaaagtcagtgatctcagattccttgatgggcaggaagaagagaggaatctcctctaggaacttcatcttcatgtccttgacctgagtatttccctggctgatggataaattactggttgtaagaaaaaaacgtttttggaagtgtagtgtttatgtggagttttttttcgatggctgattgccagttgtttacctccttcagtctcatagtagcctgtctcaaggcaggttatcggtggtgtgattttcattaaatggtcccctttggtctgactcttgacaggtactggaggcgcaaagaaggcatcagaaggagaaatctggcatcatacctacctcaccgacgccctacacttacaacaaggtacaggaagagatatttctcttcatttgacagatgcagcccctctcctttagtgaggtgtttgtggccctctgggagtgtggccaattcctttctcaccccttaatattcctgccccaaagaagcagccagactcgcagaaaagtatttggaattcaagtttttgtttgatgaaatatcagataaggttcagccagactcgcagaaaagtatttggaattcaagtttttgtttaatgaaatatcaaataaagtttgtacccaattagcttttgcagtggtaattagggaccgtgatcatcagtcaggttatttttttgactgtccatatggtccactggccacactgaaaacatatggttggcttgtgtttttgaggtggaggccatttctgagacacagacgctagagaacactttgtggtcatttatggcaccattctttgttaccccataaaacacccagcttagaacagtatctgatacacatagcaagggctcctaagtgttacttggtaatattacggttcttaatctgtagcccacattttttttgttgtttttttgagacagagtctcgctctgtcgcccaggctggagtacagtggtgtgatctcagctcactgcaacctccacctcctgtgctcaaacgattctcctgcctcagtctcccaggtagctgagatgatgggtgcatgccaccacactcagctaatttttgtatttttagtagagtcggggtttctccatgttggccaagctgatctcaaactcctgacctcaagtgatccgcccgcctcggcctcccaaagtgctgggattacaggcgtgagccaccgcacccagcctgtagcccacatattgatcctgtctgttcctttttttttttttttttttgagacagagtcttaccctgtcgcccaggctggagtgcagtggcacaatctcggctcactgcaacctccgcctcccgggttcaagcaattctcttgcctcagcctcccaagtagctgggattacaggcgcctgccaccacgcctggctaatgttttgtatttttaggagagatgaggattcaccatgttggccaggttggtcctgaattcctgacctcaggtgatccactcgcctcggcctcacaaagagctgggattacaggcgtgagccaccgtgcccagccgatcctatctgttctaaagcacaagaggtttagggcctctagaaataggccctggagtcactgagtaagtagatcagaaaaaagatgctacttggggacttgaggctagatatagatgacagaaggggctgagaatggtaaaaaggcagtaggctgggacacttgctgtggctccactactcttaatctgtgtaacattggtgaggtcacttggtttcactcttgacagaggacctgagagatgacatgatctctgcagtattagttccctttctggaaagtgagggattgaaggtccctttccacccctgtaattttattctgtgattctgttctacagcatgggctgtgtcatccacaaatatctactagtataatgtgaaaacatgggcaggcctggcgcagtggctcacgcctgtaatcccagcactttgggaggccgaggtgggcggatcacgaggtcaggagatcgagaccatcctggccactgtggtgaaaccccgtctctactaaaaatacaaaaaattagccgggtgtggtggcgggcgcctgtagtcccagctgcttgggagactgaggcatgagaatcgcttgaacccaggaggcagtggttgcagtgagctgagatcgcgccactgcactccaacctggcgacagagtgagactccgtctcaaaaaaagaaaatacaggcgagagtacctgagacaccccattattcagcctttatgcagagcaccgcacagctgtggtgtgagggggagtgtggggccccagtggcaggctcacggggctgccatcttaggcaggcacctcttttatctcgctgttcaagaaaggcttgaattgaagcctctgcaaacccagttttcaaagcaaatggagctgcatttaactaaaataggagtcctttatgcagtgatataggccatggagtcaccttactacctgcagacatggtagttggtagcagttttctttttttcacagtatcttcccccagaatggtgtaagagcttgcaaatggacctagtgagtccttcatggtcaaaggaatgcatttagaccttctgttcttccctccagtcctctccatgatctgtgtcaaactgctttgggcctttatgaagtggcctgtgctgtactgtaggtgagcctacctgtctcttagttgctttgtttctacatagaggtttcacaaccagctggtttatatttatttcttttctggctggggcaaagcatcctatacctgtacacagggatcagataggtgcttgggcctaaagagtgagaatgaaagtacctgtacattttatcccagactggctttgtatgatgggatgcatgtatgtagtattggcagcttattgaaaatatggagagaggccaggtgtggtgagtcacgcctgtaatcccagcactttgggaggccaaggcgggcagatcacgaggtcaggagttcgagaccaacctgaccaacatggtgaaagcctatctctactaaaaaaaaaatacaaaaattagccaggcggcatggtggcacatgcctgtaatcccagctactcaggaggctgaggcaggaggaattgcttgaacctgggaggcggaggttgcagtgagctgagattacgccactgcactccagcctgggcaacagagcaagactctgtctcaaagaaaaaaaaagaaagaaagaaaatatggagataaagactagttctcctaagacttccttcagctttcctagtctctgttaagtgactctagtttatatcagcctatatattgcaggggctattcctgagcctgtcatggggtgtttatttgggggctctgcttctgctgtgagtgaccattttcttttttgctttcagagctgtgacttgtggtccctaggggtgattatctatgtgatgctgtgcggataccctcctttttactccaaacaccacagccggactatcccaaaggatatgcgaagaaagatcatgacaggcagttttgagttcccagaggaagagtggagtcagatctcagagatggccaaagatgttgtgaggaagtgagttcacgggctgctgggcatggaggccaaggaggcctccaggtggtggagcacaagggaatgtgggtagagaaaagtcactggtttcctaggcaggctcctccccgttttaatatcacagaaatctctctggagcctgaggtgactgttctcagtgtccacaccttggtgcgaatgaagctttcctccctcctgttgcatccctagactttgtccccagggtgtgaacccaggtccctccataggcagtctctgcacattaattcaagaccctaaattatagacctggtgtgctgtccttcttacctgtgagctggcatgtcatttgggacagatacaatgccaggaggtgaactaggtgccgagatgacaaacagcatccttggatgctgtggttatgtgggtttgtcaggcctggaccccaccctccaccttcgcgctgccagttggttgctttgagatggagtctcgctctgttgcccagggtggagtgcagtggtacaatcttggctcactgcaacctccacctcctgggttcaagtgattctcctgcctcagcctcggcagtagctgggattacaggagcccgctaacacgcccagctcatttttgtattttaagtagagatggggtttgaccatgttggccaggctggtctcaaactactgatctcaagcgatctgcccgcctcggccttcccaagtgctgggattacaggcgtgagccaccgcacccagctgctctggcatatcttaagatgggaagatttagtcagaattagggctagtgagtggatgagggagagttgatattcagagtcttttggtagctgtaggactaggtaagaagtcaggcctaaattagaatatgtttgttttttctgcccacctgtgtgggaggctgggtgcccatggacttaggcactgcccctgtcttcccactgctgggtcttcactgagcagtgtctcccttgttggtctcagtttcttcctctataatgggatgaaggtacatgtttaggggcaacacctgggagctgtctcccaacagtacagccatttctccgtggaaattactccctttcaaaagtaagcttgtcctgttgattagaaggtgggggttgggggcaggttctgtgtgctataaagagggactgttttctaaaatagacaagtacaagtttttaggaacgtgggtgcaatgattaaatcaccatctgtcttgacatgctatttccttgctgtattcccagctatttgaccaaaacctcaatgtcctgtaagtagttctttgccagttttctatagaatacatttcctgtccctagagcaacactgattatctttttggttttgggatcttccagataatcctttctttagaatctgaagccatctgttcagaatgatccagaagaaggtggcagacaagctgaaggagcagttaggcatgttgtcctgacatttgtaatgagagatggagttggaaggagggaacgggctgagatgagctaggaaccacatcagtgggaatgaacaagatggaaagaagcatgatctgaaggcagacagcacagaagcaacaccctgggcttagaaggaaatgccatccctgtctcagagactctaggtttttagcttttgaatgtctgtggaataatgggctcatgtcctgccatatggtgacatctaggagttttatattgggtagcaacctgcttttccagaacctcatgacccttcaactaattctgcagccactatcagccaaaaagagcactctgagttccttttggaagttaaagcccattgtcctagaaacctcagtatggagattcaaggtctgaggaactataagccatatgtaggattaccttattaaaccctagaactcaaaagtatcactggattaagcccttttctaccattttaatctcactttttccagtatacaaaggactgcctcaagccatagtacccctacaagtggttggagactagaatcccatctgtgctctgcaggtggaaagcccaggcttgcagaagtcagaagtaaccagaactgtttagagccaggtccaggaacttcctatggccttttggtagcaactgtgcatggcagccctgttggcgttttctccacaggctcctgaaggtcaaaccggaggagagactcaccatcgagggagtgctggaccacccctggctcaattccaccgaggccctggataatgtgctgccttctgctcagctgatgatggacaaggttttgaatgatgtttactttgttggctgaaaagactgtgttgggaaggaatgctggggcttggctcagtgaggggttagaggcaaaacagtgcagagtacacgatccttcccagagaaacatctctggtttcctgagagtcaggatccaaaataaggaatttctttcggtaaaagaccaaatcaaggcctggtgaatataaactaagggagcactcaaaggaatagcctccatatttctgctacagggctgcgggcacagaacagtttaagataccctccctttccccaaggggtttaaataagactggctgggaaggcaaggccaataaacatgaaacaaagagggaacatttcaaatatcagagctttgcatgttaactttcctgtgaatgctgtgggaattcagaaaaagagcacatctttgaagggatgtaattttcccaaagagaaggcagaacccctcacatgtattaactgtcttctgtgttgcagcatctgagttctttctcatgttcggacatgcgctgtccttgaagaatttgagtagacagtgtaaacgcccatgcgtggcgaacagcataagcaaaaaaacacatgcaaatacatcatcgggaaaaataatttggcctcactaatgggaagttaatgagatgggtgtggcagggccaggctttgcaagtggacagaggggtttaagtcttagtgggatgcagctgagaggccatagtagctttttgagaagagatttgccactaggaaggtatttagagatagtcagacttggcgacttgcagacttgccagcctaatacttctgcagtaatctagaagtcggaggtggctgtgggagcagagaagtagaggtgaatgaacaggctaaatatttttgaagaaaaatttctacagtttttcgtgatagactagatataaggggacagttgtggcatatctggtgataacattgacagattaggaaggaggctggtttgggtgagagggagtcttttaggttttagatattgtttgagatggcagaggaacattcaaatgaatgagatttatagggtgggaccatagtgtggctgtgagctcaaagcggtgacacagacttgagtgttaacagctttgaaggggtagggtggaagtgttagacgtctctttctaagtttagctggagcatggaagaaaaaggagaactggaaagtacagttctctgccttctctttgatttgtgggtggttgtcttcctgttgtccagaaatggtttggtcattcaaaaatccaaagggattacttagatcctggttgtcagcacatagaggttactcaagatcttaaaaatgaggagataaggccaggcatggtggcttacgcctgtaatcccagcagttttgagaggctgaggcaggcagatcacttgaggtcaagagttccagactagcctggccaacatgaggaaaccccatctctactgaaaatacaaaaattagctgggcgtggtggcatgcgcctgtaatcccagctactctggaggttgaggcaggagaattgcttgaacctggcagcggcagaggttgcagtgagtcaagactgcaccactgcactccagcctgggagacagagcaagactctctcaaaaaaattcttgttgtgaaaattcaggtggtacagccgtgttaaaaagtaaaagttccctttcattccctgccacagtcacacccctcagaggtgaggtaatctatggcttgatgtatacttcctgatcgttttctgggatacacacacacacacacacacacacacacacacacacacacattctgtccttcttttaaagtacaaaaatggaaaaaaaaatacaaaaatgggatcatattcctatgaagccttctgatgatttcgtctgcccgtagtgagattatacactgttcataaaagcacaaacttccagagttccagactccatgacagctatttctcactgtaaattacttgactggttgtggcctcggtcatgtggcctcagccttggccatgtgagatggtcagggctctgagctgtcagggctgaggtgaatcaataccgtctgtaaggcttcttgggcagcagcctgccagcctttccgctgatgtccatatgtgcctctttacacttcccctcagtagtggctttgagtggggttcctgctggtatttcttactcgcatttctgtccccccaccagggaagaagggctagttgttgtgtgacctttggttggcctggtgtttcctggttcctgttgatccatggggaaaagtcctttgccttatcaaaatatttatattccttcagcataagagtgaaattaccttcttagtactttgagcttttcctttccactttcttagactggctttttaggtgcccagcaatgaatatgaaaaactgacggcagtgtttgcattcaggcagtggttgcaggaatccagcaggctcacgcggaacagttggccaacatgagaatccaggatctgaaagtcagcctcaaacccctgcactcagtgaacaaccccattctgcggaagaggaagttacttgggtaactgagcttatttcttcgattcttcttcatggctggaatggctgagtactgggttctgaaatttaagaaatttaacttgctcagctaggggtctttagcctctgaagagggtggagaggataagttctttaaatagtatcaggagttggacactattgttatttttctgatacatctgttgccttatgtttagaggtaatatctgtccagagttggtttttggggtctcacgttgtcattacccctccctcaaactcttaaagcaccaagccaaaggacagtgtctatatccacgaccatgagaatggagccgaggattccaatgttgccttggaaaaactccgagatgtgattgctcagtgtattctcccccaggctggtaaaggtcacaccatttactaatcctctgtgtgtctgtgagtgtgtgtgtgcaggggtgggtgggtgtatgcatgcacatggcaaaaggaatggtttaattttgggttgtctgtttcatcttgtgttataagaaaagtacattatataaggtagtctatgcccactaaaaagattggacagtgggagcttagaaatgcagttaagttctgcccctcctttgtttctgtggaatttctagtttagacttaattggcagtgtcaggtgcaagcatgcaattttgtgttttcttagtttgacaacaagggcacaggttgggggatggagaatggaaaatgtgggtagggtctgaatctcattgcaggctgttaaccatttccagagcctttagagtgcaaggctgccattagctcataaataagagaatacctccttagttcagaagtggctcctgctgctactcatgtcatgggcagagtgacttacacgtgggtcctttggagtgagagctttctttcgttatgttctctctccactcatcggcgggtgaggggctattctcagcagataaatgagatgcttcacgtactaggccagaaaacagttgggttgacctatctatctccctagattccttgggttttaagagaactcatgtagtgtacctcagatagctttctaaagtaagaaatgagcttaggggagagaaagtagcccactctcccactttttggtctttggttgaccaggtgtcttttgttcagcaatagagtctgccacagcctatttcccatcccctggtgctaagactctggggccatcagtggatttgtataaagatgtcagagtaaaaaagagtccacataccagatgcggtctacataatgtagggactagcagtaaagcccttgtctggtgaagttttgcacattcagtcaacatttttcaaccagttggacatcacgtccctccatctctcacactaaaaccccatgatgctgcaggaaaaatgcaaattcctcttcatccttaccaataggagagaatgaagatgagaaactgaatgaagtaatgcaggaggcttggaagtataaccgggaatgcaaactcctaagagatactctgcagagcttcagctggaatggtaggagccttcatcaactcccttccccaggaatgcagacaagtgattatgtttagaacatataggatctctttggggcctgagctgcggctgttttgaagtgaagtgaggctggctggagagtgagtggagcattgtggaatgggggttagctctacattaactgcccaggcatacctggatatctggccctttcacttattttccggagttcaagtgaattgtgtattgcagattcaacactagaaagcccccatcacacaccacttgggtaaaaaaaacccccaaatttcagaactcctctcagataccaggactattcaccaggtcattaagaagcaacagatgctgaaggggagaaagaggacaaagtgccagcgagtccaccctgctgatcccgctgatctgcttggcttagagaagagctgtttcacgaaagaggagaaagtttgccaaatctactgctggttaagtttttttcccgaagcaaataaggtagagatgaatttcttgaactgccttgtttttcttgaggcggagtttcactctgtccctcaggctggagtgcagtggcgcaatctttgctcattgcaacctctgccttccgggttcaagtgattctcctgcctcagcctcccaaatagctgggactacaggcaagtgccaccatgcccagctaatttttgtatttttagtagagatggggtttcaccatgttggccaggctggtcttgaactcctggcctcaagtgatccacctgcctcagcctcccaaagtgctgggattacaggcgtgagcctctgtgcctggcttgaaactgattttaatattgtctttccagttgagcaaactgtactagacttatgctccaggatgctcagggaagggagcaaactgaagatttcaatgcctcacttgtttccgcgtttttttgttgttgttgttttttgttttgttttgttttttgagatggagtctccctctgttgcccaggctggaatggagtggtgcgatcttgacttactgcaacctccccgtcctgggctcatgcgattctcccaccccagcctcccaaggaactgggactacaggcacgtaccaccatgcccagctaatttttgtatttttttttttttagtggagacggggtttcaccatgttggccaggctcgtctcgaactcctgacctcaagtgatccacccaccttggcctcccaaagtgctgggattacaggtgtgagccactgcacctggcctgccttcttgtttcttagacatgccataagaaatctaaagtgctagcctggccattcccattcttggaggagattcacttccctgggatttttttaaagaaaaatttgagggccaggcacgatgggtcacgcatgtaatcccaacactttgggaggccaaggcgggcggatcatgaggtcaggagatcaagaccatcctggctaacacggtgaaaccccacctctactaaaaatacaaaaaaaaaaaaaaaaaaaattagccgggcatggtggcatgcgcctgtagttccagctactcaggaggctgaggcaggagaatcgcttgaacctgggaggcggaggttgcagtgagctgagatcacaccactgcactccagcctgggcaacagagagagactccgtctttaaaaaaaaaaaagggaaaaaaaaacttgaaatatgtcattttagaaaagtgatcacatatgaaataacagacttaagtgaattttcacaaagtgaacactcctctgtaaccagcacctagatcatgtagtagaacatgcatcctcttccagtcactccctccctccattcaaaggtaatcacagtcctgatttctagcactgtagcctaagtttgcctggttttgtattctttgtgaatggagtcagataagtctgtgttcttttatgtctggcttcttttagtcaattaaattttagtcattatatttgtgacatccatccatgttgtgtgtagcagcagatcattcattttcactgtatgaatgtgtgctatatttctccattctactgttgaatggactttaggattatttccagatttggggaattaagaaaagggctgtggtgaatactcttgcgaatgtcttttgatgagctcatttatcttacgtgtataggattagaattgctggttcatggaggtcttcatctgtctggctttagtgggtactgctaccagtttttcaaagtgaatttatgaactcccactagcagtgtttgggggttctggttacttcacgtccacaccaactcttgctattgtctttttaaaaaatcttcgttatcctggttagtttgtaggtggtattgcaatgtggttttagtttgcattacccttaaatgtacccttaaaacgtactgatatacattttaaatgtttatgggccagttagatttcctcttttgtgaagtacctattcaagtcttttgcccattttttttcactgagttgtgtttttcttatagatgtataggaattctttatatattctggatatgagtcttttgtcagctgtatgtattacaaagatcttgtctctctttgtggtttgcttgtgtgttgtgagctttggatttttactgccaggttagtggaactgtacaattgctacctgaaaaatgggggatctgaactgcttttgatcagtggtgggggtggttcccccactggtgagggtgaatttgatactggtaaggtggaccttattgggtctctgtcaagagtctgccacctctcaaagaatttgaggactgaccttgttctttttttgctttcaggtcgtggattcacagataaagtagatcgactaaaactggcagaaattgtgaagcaggtgatagaagagcaaaccacgtcccacgaatcccaataatgacagcttcagactttgtttttttaacaatttgaaaaattattctttaatgtataaagtaattttatgtaaattaataaatcataatttcatttccacattgattaaagctgctgtatagatttagggtgcaggacttaataatagtatagttattgtttgtttttaagaaaagctcagttctagagacatactattactttaggactgtgtagttgtatatttgtaagatgacagatgatgctgtcaagcaatattgttttatttgtaataaaatatacaaaaatcacttgccagcagtagaaaaaggaccgactataccgacctttctgattagtaaacagttgaatcaaggactctgga

SEQ ID NO: 573 - DNA, 51197 bp, Homo sapiens; identical to SEQ ID NO: 572

SEQ ID NO: 574 - DNA, 51058 bp, Homo sapiens
ggccgctggcattcctgcgcgggcgggagctgcgggcgctcgggggataaggcgaggacgcaccagcattaatggaataggagaactcccgaagcttttagggccctgggaaagggggcgtggctggaaacggagctactggcttcggagaattctgtgaccctcaccaccgcgacgaccccgaggaaacgctgtcaggtcgcctttggttggcaaggcgtggttgtcctcgctgtcccgcgccttggcggaatgggcacctcactagccctggcactagctagcatcgctctaaactcaaggttagaggttttcaaattccgtcctattgttgccagacaccctcttcgttcctggtccagtgaggctttcctccctcccgccttcttgccaaatcccaggctcctctggagactccaggcagagaagggaaacgcacagtggagctgaaatgaagccatgagaaggagcccctcctcagtgtcctgggaccacagagagttgcaagagcctgttctattatttagctgagtgtgttatattaggaaaatactttcgcatctttgggccctgtccttcaaacttgggctggatcagtaatattcaaacattttattaggcaaggaacttttggtaggatagtcattacaagcaagggactccttggattcaaatctgacaacaccacttacgagatcttggctggattacctaacctttaagcatcagcttaataggcgtaatattgatagccaataataatagtaactatgtaacagacttgttagattgaaatgagttagtgtagttaaaatgcttaaaccagccccttgcacataggaagtagtcttgtgaactatatatttacagtttggtgtttagcaggggtgggtggcccagcgcctatctgcttgagttcaccacacaataagctcttgcattttttatgactctggagaccacattttgaaaattactgggcgtgggccttccctggtttgaacattcagagagcatagcatagcattttaaaaatgtgggctttgttgtctgacggaactgacattaagagctgtcaatcattgttatccactaggtggtggtaagcaagttgtttaaccgctcacccttaagtattttcacctgtaaattgcaatgtatttatttatttattttttattatactgtaagttttagggtacatgtgcacaacgtccaggtcaggtttgttacctatgtatacatgtgccatgttggtgtgctgcacccattaaatctgtctctgcattcagtaattcaactatcaattgcggctatttaaatacattaaaaagcaatgtatttaaatagccgcaattgatagttgaattactgaatgcagagacattgaccggtaagaacgaacactggaagtgggctgttctgccacactgcttccaacctgagaatattacctgaacctcattgaactaaccaaaattaaaagaaaaaaaaaaagctaagaggatccagttttcagagaaacaaaatgtgtatctgaaggaatatacctgctaaagggcagaggccaatatgaataacaaagagcaccaagtatagcatacgcaagacttttaggaatgaattctacccagttacagtttggggtttagcaggggtgcccggcctagagcctatctgcctccgtccaccacacagtgagcatctgcattttttatgactctggaagctacattttgaaaattattggtcatggaccctccctggcttgaatgtgcagagacccaaagcaccagctttgatgggggtcctgggagcagtcaccagatgcctagagatgtacccagggtaggagtgaagaaactgccttgcatgggaagagagggatagcccaagttcctagtccaagatgttgcagattcttcatagcaaataattgaagaatctaagaatatgactgtggcttgaaggcatagaattttccataattttggttaatgtcacataactaagaacaaaaattggagtcaagtctgacaagacagcaagggatttaggggccaagatcctgatgaaaagggaatctttaagcagccaacctaaaacttggtggttttctcttcaaacattagcagaattcttaagatgaacagggaaagaagataagaagaaagctgttgaagtgcacagaaaattttcagaagtctcatcacagatcggaggagataaagattatagttcaaaacccatcaaggaatagatacccaactagaattcctggagagcaaaagaataagaacagaagcaaactggcaataaatagagatatagctgcaattcaactttgagtcagctccatacctgactggattgttattatctgccccctctctatctgcctatgagaggaactctctcaggaggaatattatcattcagaacttctacagtgtttcgtatacaatgtctgataattcacccaaaaattataaggacagaaagaaagacaatagaaacaaattcatggatgactaaattattgagccaacaaatatatattttaaacataatggtgattaatatgttcagtaatggtgaagagttgacaagatcaggaattttaattgaaaatcaaattaaaattttatgaataaaaataaaattgagaatgtaataggtgtgtatgacagcagatcagatccaccagagaagaggaaagaatacgaatacctgaatgagaagataaccattttatatacacatataaaattttaaatatgtttaaattttaattttatatatataaaatcttaaaataggtattttaagattgataaagtatatattttataaaataaaattttaaatatataattttaattatattacatatataaatatatatatcatgtttagcttggaaattttttatataaaaacatttttatataaaaacatttgtactataaaatttttattttatatatgtataaatctatttttacacaaaaatatataagtataaatatataaaaatttatgtattaatatataaaatatatttatatttatattaatatattttatttatatttatatataaaaatctccaagctaaagtgcagagaagaaagcacagaaaagaacataagaaattatattaggccatcttgcattgtataaataaataacttgagactggataatttataaagaaaacaggtttaatctcacagttctgcaagctttacaggaagtacggtgcttgcatctgcttggcttttggggaggcttcaagaagcttacaatcatgatggaaggtgaaggggctatgggcatgtctcacatggtgggagaagcagcgagagagggagagtagggagggaggttcctcacacttaaccagatatcatgagaacttactatcacaaggacattaccaagccatgagggacacacccccattacccaaataccacccaccaggccccacctccactgttagagattacatttcaacaggagatttcagtggggacaaatatccaaactatatcagaaacatatgaaacacaatgaaacaatgatctaacatacaaaattagagtctcagaaaagataaaatgagcaaagatcaatatgtgaagaaataataatttagaattttccaagcctgatgaaaaatactaatccacagtgtataatttcattgtaactctcaaatggtatattgaaatcctacaaatatttccagggatgcttggagccatggttttgatccttggccaaaccagaatagaatatgctacataggaattaatgcagttttgtgctaacgtagttttccaaaaaataccaagagggaaatctgtaacagcttgccaatattgcttatagaaaatttattgattcatggtttgcatctggtttctgttatgctatcttggtttctgctattgaacctggtcccatatcctggtttcagctacatgacaggagtagtataaaagacccctacttgaatgagctgtgccttccctgaaatcaaaatatcttagtagttcacttgctggccataaagcacaaccttgtgactgagagaggtctctggaatctgtgtgggtattgtggacctcctttcttacccctgctgctttgtgtccatatctgtcacaaatctttcatgagtgtgtgtgtgtgcatgcatacaagtctatgttatgctgtatttttataaatatctctaataagcttagaacatttgtacattttaatggaaaaaatatgtgagtaaaatgtgaaaaaagtatgtatttctaattaagcatgttagcaattgaattggaggagaaaaaatggtcactttttgtatcaaaaggtatcctatatgatttggttaaagaaatacctgaaagcatagaagaggaaaaagatagagatggaaatcatgaaaaaaagatgataggcttaaatagtagatctataagacttaatatgtagacacaaaagttctagaaaaaaagaaagaggagtttataaaagtgaagaaacaaatgactaacagaataatagaaaatgtctttgtgttgaaaatttttgagaaggcatgaatgtagaccaaataactcatgacatttcagtctggattagtgaataaagacacactagacataaaaaggtataatttctatactgtgagggtaaagagaaaagcttttaggtaaaaagggtaagttatctaaaaataaaaatgacattggacttctcttttgtaatgttggaagctaaaaaattgttcaatagcagtatagactagtaggataaaggggcttcaatacatcagccaaaatatcatctctccctaatgtagtgaaataaatgtttaaggattttcaagaattcagagcctgtatcactcagatgtcccctgagttcacaattcaagaaagtactccaaacaaataacaaaccaaaaacagaaataccccacaaaaaattatggacaaggaaacagagaaagccaagatataaaataaataataaaccaaaagttacatgtataaaggatgcaataaattattagtcattatgctaaatgtgaatggactgaatttttcaatagaaagaaactctcagagtcactcaagtaacaaaatccaaccctatgctgttttctagaaacatctgtgaggtgagtaaaaaaagatacgaggcaaatgagcaaaaatgtcaaataattgaaggttaatttaagaactaaagaaagagattggccttatattttgataacaggtacaatttatgaagaagtataatgccatcaaacctgctaaatacatggagctaaatacatgcataaatttgagtacttgattaaaaaaatacagttctatgggaaaattcaatatttgtgtttcagaattagaactacaatacaataaaataaagccacgcacagattgaatagtataataatctgaatttcaaaggtatatatagaaaccttataaccctagaattgatagtatattttgtgtacatagaacatttacaaaactgattatgagttttgccatcttcatcctcaactgatgaatgtgtttttaattgctctgcataggcatgggcaaggacttcatgtctaaaacaccaaaagcaatggcaacaaaagccaaaattgacaaatgggatctaattaaactgaagagcttctgcacagcaaaagaaactaccatcagagtgaacaggcaacctacagaatgggagaaaattttcgcaacctactcatctgacaaagggctaatatccggaatctacaatgaactcaaacaaatttacaagaaaaaaacaagtaaccccatcaaaaagtgggcaaaggatatgaacagacactcctcaaaagaagacatttatgcagccaaaagacacatgagaaaatgctcatcatcactggccatcagagaaatgcaaatcaaaaccacagtgagataccatctcacaccagttagaatggcaatcattaaaaagtcaggaaaaaacaggtgctggagaggatgtggagaaataggaacacttttacactgttggtgggactgaaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatagactggattaagaaaatgtggcacatatacaccatggggggtagggggaggggggagggatagctttaggagatatacctaatgctaaatggtgagttaatgggtgcagcacaccagcatggcacatgtatacgtatgtaactaacctgcacattatgcacatataccctaaaacttaaagtataataataataataaaaaagaaaagaagcaaagagaacttccatacccttgcccatccacacaatgcattcacacacctacctgcatcagtgcccctttttagctagaagcctgttcatgtagtcactagtttccatccattcttgctcacatgccacatgcacctaactccagtaattcccctccctttcaatgtcaatttttccctctatactatatccttcccatcatcaagtatgctgtcatttctctaaaacaaaacaataaaattttctggggccctgttttagttagtgtaggctcttataacaaaataccataaactagatggttgacaatgacagaaactcacagttctgggggttggaagtccaagatcaaggcaccagcagattcagtttagtgagggccacttcctggttgatttatggctgtcttcttgtagagtcctcacatggcagaaggaaccagggagatttctggaacctcttttataaggacaccaattccattcatgaaggctctgccctcacaacctaatcatgtcccaaagtctccacctcctaatatcatcagattgaggattaggtttcagcatatgaatttgggaggacacatgtagtctatagcaggcctacttccctctcagctactgtatcgtttctgtccttccttttgagccaaacttcttagaaagtagtccattgtcttcaattttttctccttccagtcttttttggcctagttcaattaggtttcaccctaccgtctcactgaaactactgttttcaaagtaactattgatctcaatgttgctaaattcaatggtcagttttcagtctcatctcgttctatcagcagaatttggcacaattgatttcaagcatttggtacaattaatctctctttctaccttgaaacattttcttcacttggagttttagacagcacgctcttcaggtttttcctctctggatgttctttttcatgcttttttgaaaacaattttattaccgcctcccaggtctgctccctctctgtgacttctaaacagtagagtgattcctcagggatcagtctttgaatgttctattctcactcccggaatgatcttccatggctttaaattccacctataagctagtgacttctagtttgtatctactgctcagactttgaattctaactccaaactccttccttgtcaatttgacttcaatgtttaataggcatcccaaatttaccaaaaatgtactcctgaaatgcctcataaacttggttttttaaacaatcttctcaatctctttcttccagattcccaagtcagtatcttagatttgcctttgactcctttcttttgtcttacctcccaatctgttctgtcagcaaattcttgcagttctatcttaaaaacccagaatatgactactttcagcaccacgactgctaccggcctcgccctagacatcattttctctcatctggattattataatagcctcttaactggtctgcttgcttctgccattgctgtactccaggatacttcatatagaaccaggatgattctcttaaaacataatagctattattcactttgcccaaaaccctcagctggcttcctagtttactcagagtgaaagccaaggaattacagtgacatatagagctctacatgatatctctcttcctacctttctcatttccccccatttctctgattcgtattccattatttcgctgccttatcccatattagccattctggactaattgttatttcttcaacttgccattcttgttttcactttactcccttctttcattaatgaggtgctgttgattgattcattcactgctttaggtactgagaattaaaaaaatgaatgaaataaaaatctttatcttttatggatccattctctaggtgggaaggtgtggagtaaggaaagatcaatacccactaaataaataagtaaaattatttattgggtgagagtaaaaatacaaacaaaagagtaactcaaattttgttacttgtatttgtgtgtgtgactgttaatttaattatgcagcatgaagaaaaaatgtaaaaggatacataccagagaattgatatgttcaatgtgtattgtttattgggagggattgatgtaagtacagacaggaagaaattaggggcctataaggaagtctctcaaactcttagtaaaaatggaatactaccacttttattttacctttatgcttgtggtagacaagcgaagtgacaagttctttcaatttggcaaagaaatcctacaagcatttttacctttttgcaacacagagatgtcatttaaagtatattaacagcaacaaatgaacaagtactacaatcactcatatttgcagaccttttagatattaaagatcactttcacgaggcattgcaataacttcaaaagtccaggtttcttataagatctctctgaagaaataacacttccaaatataagtttatatataaacgcctctatcctcttccacacatttaccacagaagatacagtgttcaatataggatctttgcgctcagcaaacctgtgggcacacgtccttccaaaacaaaaatagaacaagataataacagtatgaatatttatacggatatctttcatgggacagcaaaaatgttctatttcatggttttatgtgcatgttagaaacaatttcaaaaccaaacctagaatttatagtttctcttaagatgcacatactcgtgaatgtaatattcagcacattatagcaatttaatatagtatgttgtaaccaaactaaaaagagtttaccttttctctcaccctacacttggttatccttttgaggtagtttttgtatgaatctttataatctaagcttctgatttctggttgttattgaggttgttgggcccatcttgctaactagcatgcctgagtccttagtatcagttgcctagagtgtacattttcttaatgccaacgaatactggctcctcctttgccaataacgcttaaagttctccatgaagagtccagctgaagaaatgctgtcttaaataaggataaatcacccaaatctggctgctatatgaatatgaaaacttgttccaaatgggtaatccttagaaaaaggaagccatcagaacagagcatccatttacccatgtgatccagaggtttctcatctgagaggcaattctcaatcctgaagctactggatctattagcttctaagactgtcttcaggggccaaggccatgaattcatcttagagcagttctagtcatgtaggatttgaatgaaattgcactatccataaatcaacacacagccttggtgactactgtggtcgatttgactcagctgttccttaaatatatcgagtaggctcttaactgagggtctctgcacttgctatttcttcctcctggaatgctccatctcccagatatctgcattgttcacactttcacattctgcaaatatcgccttagcagtggcttctcttgctattcaaagagaaataggacccacccccacttttcacccccagcgctgtattccttgccccactctgattttctccatagcaatgattaccacctggtatactacaattcattatttgtgccccttcaacagaatgtaagctccatggaggtaagggctagatgagcaagactttggatattttattcactgctagacagggtccagaaaactgacaggcacaaataagatgctcaataatcgtacggattttagatggacgaataaagggacactgcttattgggagtcagccagtctgggaaaggtccttcaaagctggggttcaattccccgacttcctctttcccacatcgggaaagcaaggaggaaggacgtgcgcccacaggtttgctgagcgcaggggatcctatattgaacactgaatcttctgcggtaaatgagtggaagagcaagcatagaggcggagagtgggagcagagctcccttggcccctccagccaatgggaagagagattcgctaggtcaggcggtggggtccaaccacccacgctggcccgcagccctcttagcgggtttgctcttctctcaggggaggaggaaggtgaggcattaagggccagagtgcgttcccctttctggtggaacagcaaatgcctgttgatcctttcctgtccttctgaggcctggcttttggcgcttataccctttgccaccgacgcctggtgagaccgaggtatggaatgactctcctcttctctggatgcgtactttgtccactctaaaatgggaagttgggttctgtgcgagtccatccagcgtccacattctgtgtggaaaatgaaagggatgtggactcagggcccaagaggatgagctgccaggacaccccagggtgggacacttctgggcatggcgccggccatgaccagggtggaaaagcgaccttgagggtgcgagtccacggtcacctgcaagtagtcttcggctggagacctagtgtggcctgtatccatttgtcaaattccaaagagataaatgaatgcctgccaactgtgcttgaatttggcaggcactgcgtgcagtgcccgcttcttgaatctcctggattaaagcggtatgaatagccccactttcaccagccttgacgaatggaggcaagcccctcgcctctctaaccaggagcaggtgttcgtccttcagtctgaagctattcccgccacctgtgttctgccgtctttcattcactctgagtcttcccctagcccctctccctactgaaaacgaaacaaaccgcctgaaaactgctttgcaggtgcaacagctgctctcactggtgctccaggttatcagtatctgtctctccacttctccctagcaaagttcaagaaatattagtaaggtagcacatgcttgctcccggcgttggtcatcctctctagcctatagtgctttagtgctttagcacccccactccctctactccagcagtgacccaaaattgctctctctatgcaagttagcaattattgccaacacgccaaattcaagtacagatggcaggcattcatttctttaactttttggaatttggcaaatggatattgcctttttacctttttatttctccacttatttaaggaatgtattctaatgagagataattgtcaaaaattgtcctaaactcagttgtgttttgagttaggacaatttgtggtaattattttaagtacattttggttttttttatgtagaggttttgttttctttgcttagttgtaatcttcatatacctgccaactgttttgctgtatgacgaggtcattttcatgactaaaaatcaagtgtgtgctatatttttatacattcattataattgaatccttattgacaattatttactattctaaacaaacacccttatgcacaaaactttcttttctgtatttaggatttttttttcagtggatgatttcccaaagaagatactgtttgaaaactcatgcatgtttgtaaaattctcagtagacatgcagacatgcagtttttcaagagtgtagcaattaacatttatattaactccttttatatggtactgctttttaaagcttatttttgtcattttgttctttgagaagggctgtttcctggtttgcattagttgtgctatctgcctaagtttgaaaattttctgaaatacttgttagccatttgctttttgctttttttccccttctatgaataggctattcacaataaatttgctttattgctattctgatctatttgtatcatgtcattttagggatatgaacattttcaagacaatattttagtgtgaactgtaactcataaaagactgcactgagcataaacatgcagcttggtaaatgattaccaagtgttcactcatgtaaaacatcagcaggtcaaggaataggacattcgttaccaggacataaggcccccttcatccccctccacctcatctccacagaggtattaggaaatggacttttataatagctacttcataatcttgtttgatttggcttcttccactagttatgagatttattctagtggcatatagcttcaatcatatgttttctttgctgtttaggatttcattgtacgaatttaccacaatgtattgattggttctactatagatgaactcttggatcttttcaagtgcttaggaattacaagcagtgctgctgtagttattgtatatctcctggtatacctacacacatatttctattggatattttctaagaactttaattgctctgtcatagtgtatgtatatttccagttttaaggaataaccattttagaatagtattttttagaattacagaaatttcttgtcacccaatttccccaatttttaatatcttgcattactatggtatatttgtcacaatgaagacaataaggcaattaagttgcacttaatttgaagttcactagtttttccatagtgttctttttctattcctgaatattacatttttctattcctgaatattacatttacatttattattacagtacagtattgtcctgggtggacatcttcaattttagtagttaatacaaacagttttaaagtggttttattaatttacacttcagttgtctatttgccatattccctgtaaacatttttctgtttttggttggccatttgtgtttgaattctaaggacaagaggttttaatttcagcatagttaacgaacattttgtctctgtagattcctctggtctgtgaaagtttctcagtctttccttgttttctgatgaccttgacagttctgagaagtactagtcaggtaatttgtatcatgtccctcactttgttttttcttatggctagactaggatgatgggtttggggaaggaatatcatggtggcaacatgccattcacagtatcaatagcacatacgatcacaatgacttatggctggtaatagtagccttgatcttgggagagtgtttgtcaggtttctcactaaaaagtttctccactgtccccacctgctcccatactgctctctttggaaagaaatcaataagcacagtcagcgctctgggaggtggggtgcagttgggttaaccgccacttcctggagggaagaatatcctacacacagtatttggaaatcttctctaagagagatttgtctcttttctctcatatattcggacatttgtcaatatcagtacggactcatggacatttgctttgtactttgggctataatccaatactgttatttattttggccatcaggagctctttctggttttatcttaggtctttttgcataccccattattttcctttccttatttctggcactatgagatgctatcggctcatcgtatctattccctgtcccagccctagaatcagcagtttctcagaggagccctgattccttttattggcaaatggtacagttagaaaccaaaatttgggcctgggtggacatctccaattgtagtagttaattcaaacagttttaaagtggttttattaatttacacttcagttgtttatttgccatattccctgtaaacatttttctgtttttggttgaccatttgtgtttgaattctaaggacaagaggttttaatttcagcatagttaacaatatatcttcaaatattcattgtggttcttggtcaattcccttactgtgtccaaactggtaagtcccttctttcctaagttgtgatgaatattctttgctgttttctcctccctggtttgaagtattaatgatgtactacttactatatctgggatttattatgaggatactaattaattcttgtcaaaatggtttacaagttgtgctaatgaacgaccctgaattatttcctcccaattatggtgtctcttctataatatattgaaatctaatgagaatgtattttcttggctatctactctttttctttgatttaattatcatgacagaagttgtacatttaggccaggcaccatggctcatgcctgtcacctgtaatcccagcactttgggaggcctaggtgggcagatcacttgaggtcaggagttggagactaacatggccaacatggtgaaaccctgtctctactaaaaatccaaaaataaataaataaataaataaataaataaaattagccaggcatagtggcaggcacctgaagtccaagttacttgggtggctaagccatgagaatcgcttgaacccaggagggaaggcagaggttgcagtgagtggagatccaccactacactccagcctgggcgacagagcgagactccatctccaaaaaaacgaagttgttcacttagcagtagaggttagactcttgaagttttttcaactggggggaaatttgctgccctggggtcatttggcaatatctagagacattttttgtttgtcacaactgtagaagatccagggttctaattggcatcaaataggtagaagccatgaatgctgctcaacatcatataacgcacgtatagtatcccccaaggaaatatccagcctaaaatgtcagtactactgaggctgggaaactgctataggagatttaattagagcgaccaagaaaggaaatcaatccggactatatgaaaagggtggaaacacctggcttcctaggtcaaatcttacctccctgagacctccatatctctcccctctctaggtgagattcccttctccctttgtgtcctcctagaactactctggcccagatgatagtcatgctatatttagaggtcttcctcttctagtctggtgttcagcatagggtctgctatcacagagcatggccacacagattttgtataactctgaatttccaatgcctaggaaaatgaagtgaaattaaaaggcaatgctatgtagtagaaagagaatgagctttgtagtatgataggccatttgtcaactctatgacctgggcaagtttcttaatttctgagactccgtatctataaatgtggataaaatcaaactttcaggtctgttttaaagtctagagaaaatttttgtaaagaatctatatacactaggtcctcacaaatatagtcattattaatatgagctaattattttgaacaaatatgctttgttataggcaaaaatttacatcaataaatttgcaaattaaaatcctcatagaccatgggttcccattttagttcagggcatttttgaatgaatgaatgccttcctataagagaaacagtgccaaacatgtgttcctctttctaaaaaggtaaaaagccaaaacaaaacaacaaattccttcgaggacagcgtaaaacctttgggaaggagactatagtatattctactctactataattgtagatatcatatagtagaaagctaatagggttcagactcatatagatctcggctcaaagggacacccagaaaggaggaggaaaatgaaaaaagtgtgggattatgacagcaaagagacaagtgtaaatatcaagatgtaaggcattgttaaaatagtattattaacatatggcaccttgttaaagttaggtgcatgcgttagcttttttaatccttgcagaggtaggtactcttgctattcctgcttacagatgggaaaattgaatcccaaaatgccccttgagttttgtaacaaggaggttattggtatgagttatttcagtggaattgtggtggcaaaagttctattgcagtggattgaggaggtataatataataggtgatagagtatagaagattgaagaagtttgactatgaagatgaaggggatttggagtaaagggaatatttgtaaaagactaagtgagatttgggcacatttaagtgctaatgagtaggacttaggggacagggagaagttgaagatcaagaagatagatttctaatggattaaatcccttcaggaacaattgcttatgagatttagatcacaggtagagaaataagctatagaaaagggaagagagcgcccctcatttgttacaggaaagacaaagataaagatggacccacatgtagggatacctgcagatttctagaaaggaagcggaagatgtattctgtgccttgctttccctcacctaccatattctctatgtcctggagaaatttcagagttcttttttgaagtttcctcaaatcttttcctttatgctttttaaaaaattactataggacttgtttttgtcagatttatctgtaatctagaatatttttaccatgtagttaaacaaacaaccttaaaacagctgatagctcaccaattactgtaggataaaatccagatttactatatgtttcgagacaattcaccttctgtttaaaagaaaaactctcccttctatatacttttatttcccccatccgtcttttttttccaatcatattagcaagaattgggggagacattatgaaagactggaaagggcaggaattttagtgaaagatctaagttgagttccagctgcatcacttactagctctatctcttcaggcaattcaccaaaacagattaagaaaacttgatggtgcttgggagagtatggattaagtgattaattggagcacccatgctgaataagaaattgaataaggcccttaagatggctgatgaggggtaaacgcagggctcaaaaggatttgatgatgtttgaagaactgtcaccgagtaagggcatgaaaccactcagttaactggaagatattagtaaaaaatgggttatgggagtttgcagcttaaaagtttgagtagtcattgacaaagcctggggtgagagcattagagtaaactgccagagagcagtaaggtcatgggagttgatgtcaaagacgtgagatgaggatgtttttgatgcactttaacactgaactcacccagactaactgtggtgttggggaaagtgcatgaaaggagcttgtgtactacaaaagaccctcagtaattatatatgtatttatgaccagaaatgacatgacaagaagaggtagatggtggcatattctaattgcatgtgtttgttgagtaataatgtgttggcaggggtgcaataacaatgttttataggttgagatgtatattagatgttgttgggggatagaagggatgaggatggacagttagcaatacttaggaggagccagttctgtgccaggtgatatatgaaccctatcttatttgatccatactaaaattagaggttggctctgctatccccacttagcagaagagtaagttgaggttcaaagagaggaattacctttatttatatagctcataagtggtaggactgggaacagatcataagaagatggaataaatatacagtacagtggtctatatcagaggaatgctttgtgaaagaagatatattacagaggacactaggtcagtaccgagcctaatacagtgggcttctgcaaatgtttgttaaattaatctatataagtatttcattttcaaatctgtctttttcatgtgtcccatttattccatgtgcttttggttattttttttccccccacagaggcctgaatatttggacaagatggcagattcatcatcatcttctttctttcctgattttgggctgctattgtatttggaggagctaaacaaagaggaattaaatacattcaagttattcctaaaggagaccatggaacctgagcatggcctgacaccctggaatgaagtgaagaaggccaggcgggaggacctggccaatttgatgaagaaatattatccaggagagaaagcctggagtgtgtctctcaaaatctttggcaagatgaacctgaaggatctgtgtgagagagcgaaagaagagatcaactgtgagtgatgctaggggcaaatcgggggctaggcaggaaggaagtgtttcctggagcccagtggaatgtttctgtaagagggatttagggattaaaccatgttgggggacataagctccatggtggtcttgtgcatggggagcttgttgaattatttgaggaaggaaaggcagaagcgttttgagtactgttactcagcctagctccttaactggcggcaattcatccatcttgtaccagttgaaatgatcaaaggaattgagtgataggaattgtcccataaagtgccttcaccaaaactacaagttataagttaggcaacattttgaggaatcaaatatgatttaacatatttgctgaaatatgaggaatgggctgaaaattattattggacgtaatccaaggcagtatttttagtcattctcaggtatgaaatattatagacctctagaattccttacgcgtatacaaggctttagagttatatatatatatgtatatatataatattcatatctattatctcctttgcacctcaccgtatcgtagtgaagtcagtatagacaaggaaactgaggcttatacactacactatttgccctggagctacaaggtgggggccatggcaagaggtctcctacttcagtgttatctgtatcacattgtttcttctctcagctaagcttatggagtctgaggctctggcagctctagttttcttaaacccagatagtcatagaattggaccacttatgtgaatgctggcctctgttctagccatcatgaaagctcactttgttttcattaaatatcatgatcctatcggaacctgttgcagggtcggcccagactataggaccagatgatgccaaggctggagagacacaagaagatcaggaggcagtgctgggtgagtagttaggcctttcatcagatttgggaggcattcaaagttttgatacaggacggtgatttatctcccgaggacttttgttcaaatcttgttaacttcttctaataccccacctgttccctgaatgtcacccaaaaaggatcagcaaaacactccctggccaaagtcagaatcagggccttgttaattcagatcctcaagagaacagtgtttagaatgcctgctaaaagaagggctgacgcacaaaggtatattaatgtttatattttatggactaaaagtcactgaattgggaggaaactttcagtttatcacatctactttctttaaagatggtgctgtaattaaattctaggagtggtgaccaactggttcatataaaaactgatttctagaaccaggtcttctcagtcatagttaacacaggggtccccaactcctgggccacagacccctactggtcggcggcccctcgggaatcaggtcgcatagcaggaggtgagtggtaggccacgggagctttaccacctgagcttcgcctcctgtcagatcagcagctgctttagtctcataggagcacgaaccctattgtgaactgtgcattcaagggatctaggttgtatgctccttatgagaatctgatgataaatgtaatgcaattgaatcatcctgaaatcatctcccctccctgccctgccacccctgcctcctacatccatggaaaaattgtcttccatgaaactggcccctggtgcccaaaagattggggatttcagaccactggtttattaacaccatttccccactttgttttgaattctacataatttaattccaatttatataaatggaattacagtagaaagaaaattagatcaagtgagaaacctttattcttaacccagccacattctaacaagccacattatttcattcaagaaataattgaaaacttagttcatcccaagcactaaaatagaaaaattacttgttatcttaaatgaccttgaatataacatcccactgtgaccttaatttctgattcaatataaagaagtatatctttatggtatgagaaaaatcacatggctaataatttttgttttattattatttcaaacctaatggctatttccctcttatgtgcagataattgcacacagatagctaataaatgtcttcaaattattatttgaaaattgtgataaaagtaaactatttattatgggaactttggaaaatactgtaagtacaaaatagaaaataagaagtacagcaatgatttactgattattttctctgtgagtataccaatatcacactgtttgaattactatagtttcgtggtaggttttaattttgggtaaatagtgtttttcttctccctgcctggccaatcattattttcgctttttgggattttttagttatcatttgtttatgttttatctttgtttttaaacttcacataagcaaaatgagctatttttttaaaaaagattcaaatgttttaaaattacataaagtgagtttctcactcttcccactccccatccccaatcctactattcagaaataaccagtattaatatattggtgtatatggtacatgttttcagatacataaagtttgttcatcttttttccaggagaggatcatattctacataattgccagaaacttcatatcttttttggttattatttggggggatattagtacctatagttataccttattcaaaagttgtaaagtactcaattatatcattgtattctcatttttttattgcacaaatatatttgacacttatgtgcacggaaatgtgttagacactgaccatgcaatgatgaagcccctagccaagtgcatcatttattttaaaaataaagtaattgtagctagtgacatgtactgtgaatgaaaaatatactgttttgagaatatataaaaaggggaagtagtctagcgatgaggttcagagaggtcttccctgagatcctatccttttaatagagatctaaaggagggatcagacttaaacaagtaaagatgaattatattttcattctatttcactcaggatgtttttcttttttcaaaatattatttaagctacgattcaatgtttatttctattaactttttacttgtacaaagaaaattattttgatctgtagattcaggtctgtcttgggggtcttccctattattgttaatggttgcctctgttctttttttttttaatctggatgacatctctgttctccacatctattatcttttttctatgtagaaggaaaagtacaaagaagaaaaaatatttctaaagtgaatccagtttttatttcccatcacaaattcatttttctgcatcatctattctggtttttattacagtatctaatacaggttttaaatctataggaatatttttatttatattatttttaaaaaatcaaaaccagctctgatttcagcctatgttctttcttgttcctaattccaagttcggtattcttgacattacatttcatagaatttgttttgatcatgtgtctttgtttttgtttttttacctttgccattctgacttaggtgatggaacagaatacagaaatagaataaaggaaaaattttgcatcacttgggacaagaagtctttggctggaaagcctgaagatttccatcatggaattgcagagaaagatagaaaactgttggaacacttgttcgatgtggatgtcaaaaccggtgcacagccacagatcgtggtgcttcagggagctgctggagttgggaaaacaaccttggtgagaaaggcaatgttagattgggcagagggcagtctctaccagcagaggtttaagtatgttttttatctcaatgggagagaaattaaccagctgaaagagagaagctttgctcaattgatatcaaaggactggcccagcacagaaggccccattgaagaaatcatgtaccagccaagtagcctcttgtttattattgacagtttcgatgaactgaactttgcctttgaagaacctgagtttgcactgtgcgaagactggacccaagaacacccagtgtccttcctcatgagtagtttgctgaggaaagtgatgctccctgaggcatccttattggtgacaacaagactcacaacttctaagagactaaagcagttgttgaagaatcaccattatgtagagctactaggaatgtctgaggatgcaagagaggagtatatttaccagttttttgaagataagaggtgggccatgaaagtattcagttcactaaaaagcaatgagatgctgtttagcatgtgccaagtccccctagtgtgctgggccgcttgtacttgtctgaagcagcaaatggagaagggtggtgatgtcacattgacctgccaaacaaccacagctctgtttacctgctatatttctagcttgttcacaccagtagatggaggctctcctagtctacccaaccaagcccagctgagaagactgtgccaagtcgctgccaaaggaatatggactatgacttacgtgttttacagagaaaatctcagaaggcttgggttaactcaatctgatgtctctagttttatggacagcaatattattcagaaggacgcagagtatgaaaactgctatgtgttcacccaccttcatgttcaggagttttttgcagctatgttctatatgttgaaaggcagttgggaagctgggaacccttcctgccagccttttgaagatttgaagtcattacttcaaagcacaagttataaagacccccatttgacacagatgaagtgctttttgtttggccttttgaatgaagatcgagtaaaacaactggagaggacttttaactgtaaaatgtcactgaagataaaatcaaagttacttcagtgtatggaagtattaggaaacagtgactattctccatcacagctgggatttctggagttgtttcactgtctgtatgagactcaagataaagcgtttataagccaggcaatgagatgtttcccaaaggttgccattaatatttgtgagaaaatacatttgcttgtatcttctttctgccttaagcactgccggtgtttgcggaccatcaggctgtctgtaactgtggtatttgagaagaagatattaaaaacaagcctcccaactaacacttggtaagtgtgttagggccattccctggaagtgccctgtaagggagagacgtagatatttgtcagagggaggaggcgtttagctgaggtcccagagctgagataaccctctggagttgtcccatcttgaggcagggaggctaagcatttaaaccccttattgaccaatcatggctactggtgaggagtgggcaaaaactttcctgagatggctttttttggcctgaaggcaataccaggagagggactgggctgaggactctcaattgttgacaatctcaacaactcagggggaatgagcacttcagtcttcaaggaggaatgtggcatggcacaaacttgcatccatgataataagtatatttgatttctaaagataatgtcatccagaataagggaccagaaattttctgctgaacctggtaaacacaggttatctctctgtattatattcctccgtactccactgacctagctcgctttctctattgcccagacattggttggcctttgttttgtagtttgtgaagggtctcagccctttaatgcctatctggagacactggaggttaataagaaatagtaggtgctaaataaatatttttgaaaaaagaaatgaaccttaagtgttttacgtacattattctactctacctcctttctcaagttgccttttctgactacccatctaaatctgaggaaagatttgaactatggaattcattcccagatgtatataaaattaattgaggacttcctatgtgctatatagttgtatagtgaactggatatttaacataatgtgcaatttaatgttgttggcaaccatctctatttttaagattacaaaactcagagacatatacctagaaaatttattgattcaagcacacatcaaataatagttaagtggctaagtgcttatcacataacctgacagtcttctaagtccttgatctcatttagtcttctgatagtcttattaggtaggtgctattatttccattttacttaggacaaaattgtgataccaagaaggcatataacttgactgaggtcacacatctgattgtaatttcttggtttgctaactttatccaagctgtttcagtaccattatatacaattgcagaatcactcctttcttataagagcatacatttcatttatttgcaaactgtgggagtagaaattgtgggccctgatgctatgacctttacccaccttggaaaattgtgagtaatcgtcagtcaattttcttaattctgacttcagagttctatttaaagaagatgtgatttaacagggcattaaaacgtcttttatgcctaatagtaaatgctagaacagtattctggccactagattgccagttctcctgctagctttccttacctatgttgtagagttatctagtactagagttgattgttgctaaaataaggagccagagaacccaatgttttaaaagaaaaactgtaggtgacctcagtctcttctataatataactacattgtaagctttgtgagagcaggagctctgtatggttcaccattttatctcgtgttcgcacagaggaaacacttgaatgcttgaaagaataatttattatcctgtttttataaatttaagacctcaagtgatatagaccatcactatgaactgtcattcattccaatttaagatatgggaatgaatatttattgactagctgttatatataaggcaacacactagacttttacatgttttgtatatattatatttaatatatacatatatatgtatataacagttactgattactaggaacacttatagcatgagacatttgctaagcattttctacatactgccttattgaattttcacagttgtcctaaaaaatagatactattatcttcatttatcaagatcatgaagctgaggctcacataggttagtaaattttccagaataactaagttcagtgagtggcagtgttgaattgggactcagagccgctccattgtcgagcttataaacaccaggttgtcccctgttttattaccctttatttgttcatgagtttattgataatattcctaataattaaattataaagtatttaaagtttacagtgtgcttttgtgtaccctttaaaatgcactattaaatttccacatctttgtgaaaggagacatttccattttatagatgatgaaaatttgcaagttatagaacttatgcaactctcttaaaataatatggctagtaagtggtagacctggggctcaggcctgtggtttttaatctataccactttacacctaatgtctacccactaatcctaatcatattctttgtgaccaaattttatttttctttttgatattggctcttcaagtatttgaatacttctctcttatccctcctgagttgcttcctctaaagtaaagcttctctggtttttattttgtgtgtgttgaagggagtggatgggaaacgggagagctattggacaaataagacctctggagtgcccagaggaagacttcctggtggactgtgcccacggtggagctgcactggatgctcttgcctttccaaagtacacttacttttactccaatactatcctctgagagttggctaggctgaaataaaatcagcattgtttttcttttctcaattatttatgcaaagggatggtgatcgcattactcactgttggcaagatctctgttctgtgcttcatacaaatgaacacttgagagaattggacctgtaccatagcaaccttgataaatcagcaatgaatatcctgcatcatgaactaaggcacccaaactgtaaactacaaaagctactgtaagtctggtatgagaaaatttaatggagttattctaatttctttctgtgtcccatcttccactcatactcgttaggggaagccaatgctaaacaaatacttacaatccattttgtaaaataaacaggaacaatggaatcctctggggacatgggatcattactaactggttctcagagtgattccacagggcatagtagctgttcacatgggtttttcaggcttgattaggaactttctaaatgaagagcacagagctaaaacattctaggcaggtcaccaatgcactttcaaggacatgttctggaacttactatcctcttaaatttttttctattgaggaaaaatttgcatttaacaaagtccacaaataatgttcagtttgttgtgttctgacaagtgtaaacatctttataaccaacacacccaaaacaagatagaaaatattttcatttatctcagaaaggtcccttgtacccctttcgtttttttttttcctgagacagggtcttactctgttgtccaggctggaatgcagtgatgctatcgcagctagaactcctgggctcaagcaatcctgccacctcagcctcccaagtagctgggattacaggcatgtaccaccatgccaggctatttttttttaattttttgtagagatgtggtctcactgtgttgcccaggctggtctgaaacttctgggctgaggagatcctcctgcctcagcctcgtaaagtgctgggattacaggcatgagccacaatgtccagcctatccctttctgttcaatcttctcaccccatccattcccagagacaatcattttctaatctctgtcaccagagttcagctttgtatctttttggaatcattttgattgatttatacagtatgtattttttttaatttatcttctttctctttcttttcttttcttttttttttttgagacagtcttgctctgtcaccaggctggagtgtagtggcacaatctcggctcactgcaacctccgcctcccaggttcaagccattctcctgcctcagcctcccgagtaggtgggactacaggcacgcagcaccacacctggctaatttttgtatttttagtagagacagggtttcaccatgttggccaagctggtctcaaactcctgacctcaagtgatctacccatcttggcctcccaaagtgctgggattacaggcatgagccaccacacctggctatatccatcttcttgtgctcaacaaaatgtcttctaaaatttatccattttgttgcaacttttagtagtttcttttttattgctgattagtattccattgtataactatacttatactataatttgtttattcattctcttgttaatagacccctggaggtttccctaacctgttaggaataagggtaatctttgccaacattagatgctgtcagtcttttttaaattttaatttatcttaattggattctagataatcactttaaaatgttgattgttcacatgtctcttacctttttgtgtaaggactccactaggagctgaaactgatcctaatctctgtattttgtgcctgtcaatatgtacaaggtacatttgttgcttagtatgaactgaatgctgaacaaatgatagatctttgtttccattagcactgaaaatagatgttcttttgggtgggggctggggacaggcttctcaccaaatattttcctcctgatctcagtgtttttagtgagttctgaccttagatttcaagcatctagagtaggcttggtcttacatatagatgtagtaagacaactagatgtatgttatgattacggggttcctggaagtcctttccactcatccctaaacatttcccccatattgtcccttcattggatgtcatcaatccggatcttcacaatagccaatgccttcttggttaactgacttcctttcttagaatgggagggttgcatcagtgggatgacaccatgatgactgttctcagtctgtgccaccttaatgtggtctgtcttactgtggtccctttttcctaataagtgagatggtgccatttatgtttactgagtgccttaggcacttttactagatgaggatggttagtgctataaatgggtaaaggctttattttcctgtgtgtacttgcctggggtgaggggagtgagggtggagggtgggtggtgggccgaaaggaggaaaggtggtgttacaaagcgaggttttggacagtgaacagaagggcattggggactagcagagacactatagaagaatcagaaatatctgacattgactgagttaggaggtagaaagtaggaaaaaaattggcagatttaacttcataatattttgcttgggctgcctccgtacacctgcctccgtatgcctaacgaagtccccaagatggcacagcatgttttgcaacagcgttttgttattactgcacatcagacagttgatgctaattttgaattaaccttggattatttaaagatttggctattgtgaattaatgttattgtagtacttggaatggccctgataatttttgatagtcattcctgggattacaagttaaagaggctcctcttctgcttttcatgatgttatcaccttcttttccgttaaggtaaaaaaaactggggagtgtcaattatcaggtcataaatagaaattgaagttataacccaattgttttagatgaaaataagataaaagaatattcatgtaatatccaagaattagattgaaaagaaagggatcctgtaaccaaggagagaaatggttttgtaatacctcctgcatatttttcttctgaaggttgaaatttatcactttccctgatggttgtcaggatatctctacttctttgattcataacaagaatctgatgcatcttgacctaaaagggagtgatataggggataatggagtaaagtcattgtgtgaggccttgaaacacccagagtgtaaactacagactctcaggtaagctttgaattgttttgtcttgttttgtttttataattgaggcttttgtctatccaagtagactcttacagcctggatttgctattcataggaccggcttaaatctactttcatgatatggggtagcaagcatctgtagaatcaagctgatttcatcctggtaggacttctcattcctcccatctccccaggaagatttctcattgtgtagttctctgtgtctccatctcctaaatctgctggtggtgggaataagagcagattcagaattataaatatttaacacttctaatatttaagtgctgcaatagattcgttgtatctttgaactctcgtagaaaataatacagtgggggatgttctttaatgtaactgggggcagtgctggggcagactcactattatttgatttttgttggtgactccccctcaatttagaacttcaactcagtgaccagcccagaaggctgagaaagaagagcatggaaatggtcctctttcaaggtgcttgctggctaccacacactattgatctgagtggtgactcttctttggccgatgaaagtgaaaggattagcagtcatactgttctccacattgtgtgacaggttttaagaaagatcttatttttcaatgaaagtcaatgaaataggtttctgacaaaaccagacaaaacaaatagttacagtaagttttgcattagaagtttttataagccctggactcagttcagggtggccaagactgaagcttgatgcatgaagggccaaagtagatctgtatttgtaggaagcaaattataatccaggtgtaggaaaaataaatgaagtctggaataagactttctttgacgttttaaaaactcttatcggtttttataagatggaattcacttacagcatatctggaaagttgttggataattctcaaacataggttgagttcagttgttaggaggccaggtcagagtaaaggttttacctactaagcagttttaagatattatgaggcattttctgtaacctacatatctagtctgaaactcaggtaagaagtatgtcactgtttcctatatctaaaaataaaatgtattagtagcaaaaagctgttaaattgaggaaaagaggaaagatgttttcttacagtgggagctgtggatccaagacaagaaaagcttggtgcttgacagatcagtaggacttgataagatcccttccatttgaggtttgagtaatgtcgtccgctggtaagccttgatacagaccaagttgccaggatttcaaataggaaaccatctttctgggtcaactagtagggctccttgcaacagtaaatacaatgctttggcaaaagtcatcagagctttgtaataatctcatactccattatgtgggactgcatgttcccccagtgtggatggccactgaggagcaatcaatggtcctattaacatttcgtgtgggagaaggtccagttttctgtttgcttcatatctcatgttataagagccatgggtagtatgaatgtcctcattagtttggtttgtgtatagaccatgcacaagtttttagaattgcattttgatgttatactctctctgtagatgtgggcagtgtcgatacatcagtaggactttgccagtctgtcttgcaacatatgatccccagtgattgttagaacttggctaatttaaaaataaaataccttctaaaactttaaattgctcatatgagcccctgtacatgaacatactgaaaggatacataatcactaattttcttctttctttttttgagacagagtctcgttctgtcacccaggctggagtgcagtggtgcgatctcggctcactgcagcctccacctctgcctcctgggttcaagcgattctcctgcctcagcctcctgagtagctgggactacaggcccatgccaccatgcccggcttatttttgtgtttttagtagagatggggtttcaccatgttggccaggatggtctcgatctcctgaccttgtgatccgcctgccttggcctcccaaagtgctgggattacaggcatgagccatcgcacctggcccataatcactaattttcatgagaatgctttactataatatttacccaaggcctccctcaagaagaggagaaagatctattctctttgtcttgataatttttttccacattataggccttataataggtcttaaaatatgctttaaggtaagctcttaaaatttgctgagcaaggagagaccaaaaacaaaaacagaaaccttggcatagtccaataatttctgattgtgcccaggatctcttcttagtttgcatatgctctgctattggggctttataagcaaggtaagggaatgattgttgcttccacaaaacagccacctgaagggtaccaaaatggcatataaatgcagagcactctctatatcttcatagactttgaattagaagactaatatttcagaaggggggcaactagaatagttagataaggccgggtgtggtggctcacgcctgtaatcccagcactttgtgaggctgacaaccttggatcacttgaggccagtaatttgagaccagcctggccaacatggcaaaaccccatctctactaaaaatacaaaaactaactgggcatggtgatgcgcacctgtaatcccagctactcaggaggctgagacaggagaattgcttgaaacctgggaggcggaggttgcagtgagccaagatggcgccactgcactccagtctgggcaacagagcaagactgtgtttaaaaaaaaacaaaaacaaagctggctaagaggaacttgcctgagaatggcaaatatccacagctgtgtctcattatcaactagagtaaaatattacttaacaggtagatagcatatggaccaatagaaatttttgcttcttcaggagtgaggaaactctgtggctcaatacaattgtttataatcatgaaatgcctaatgaatcatcataaatgtaaacagaatttggggaaatgagaatacaccgtttaaaaccagaggttctgccacctgggaagactaccagcaagcagagactaaactaccagtcctcttctccattcaaaatttcttttattcattaataaaccatgatatatatgtatacacagcttcataatcataccaaaaaagtttaagtgaactatcctttaaaggctgagaccataactttttgaacagaaataatattgattatgagacagtatattgatttttgctgtctttattttaatatgaagaacaaattgtgtggtaagactgtaatttattttcccactttgaaattaaacctctctagaaacatttagataaattataaactaatctttaaaataccgtattacttcaacatttcaaaatcagtaagtttggaaactgtatttaagttaatattaggaataacataaccactgttgataactaacaatatagccaaacaatgtgatacctcaaaacttgacccagatagtacaaaatatttataatcttggctgattcccagatttacaagcttccggtttataaagatgctcatcatttagttaactcatttaaatcatatatatatgatttaaattatatatatatatatactttaaaatattagtgtaagtaatatgtctacaggagaattgtaggatacttaggaaattatttaatttagacttctcattaaagaaatacagaagttttgtggtctaaaaagccatcatttgtatttttttctgagaggattttgtatttttttttactttcacttctgtattttcaattttttaggtacatagtaggtgtgtatacttacgggttacatgcaatattttgatacaagcatgcaatgcataataatcacatcaaggtaaatggggtatctatcacctcacgcatttatttatcctttgtattaaacaatccaagtatactcttttagttattttaaaatgtacaattattttttacgttagtcaccctgttgtcctagcaaatactcagtcttattcattatttctaactatttttttgtacccattaaccattcccctcttcccctcattcccccactgtgcttcctagcctctgataaccatcattctactctctatgtccatgagatatctccatattttcatttttcactcccacaaataagtgagaacatggaaagtttgtctttctgtgcctggcttatttcacttaatataatgatctccagttctatccatgttgttgcaaatgacaggatctcattcttttttatggctggatagtactccagtgtgtgtatgtaccacattttctttatccattcaccttttgatggacatttaggttgcttccaaatcttggctattgtgaatagtgctgcagtaaacatgggagtgcaggtatctcttcaatacactgattttctttcttttgggtatatactccacagtggaattgctggatcatacggtagctctagttttggtttttttgaggaacctccaaactgttctccataatagttgtgttaatttacactgctactaacagtgtatgagggttcctttttctccacatcctcaccagtatttgttattgactgaattttggataggtcatttttactggagtgaggtaatttctcattgtagttttgatttacatttctctgattattaatgatgttgagcatctttgcatatgccatttgtgtgtcttcttttgagaaatatctattcagatctcttgcccattttaattggataattagatttttttcctgtagtgttgtttgaactccttatgtaatatattctcgttattagccccttgtcaaatgggtagttagcacatattttcttcaattttatgggttgtctgttcaccttattggttgtttcttttgctgtgcagaagctttttaacttgctatgatcccatttgtccatttttgctttggttgcctatgcttgtggggtattactcaagaaatctttgcccagtccaatgtcctggagcatttcccctatgttttactttaatagtttaacagtttgaagtcttagattgaagtctttaatctactttggtttgatttttgtatatgttgagagataggagtctagtttccttcttttacatatgaatatccagttttcccagcaccatttactaaagagactgtcctttccaccatatgtgttcttggcacctttgtcgaaaatgagtccactgtagatgtgtaggtttatccctgcatgttgtatttttatttatcattgtggtaaaaccaaaatctcaaattacagagccaattaatttatctgatgattcaccttggtttagaataggcccatgaagcctatcctcttagtggaaatgctccttctcttggcaatatcattcctctgtcacctgcagtacatttatattgatccttagaaacaaaaagctcctgcaaccatatagcttcggcaacaactctcctgttatctctcaatttctaattcatatcagaaaaataatctcatactcaaaaaacaaaaataaattacgaagttcttgagcaacctggaaattacacagcagacattttcagaagggaaaaatacattcacgcagcatctttgagttcctgggagttcatcttcaggagttagcagttcctctttattgaggaatagcccctttttcaggtaatggcagttttctgattcttgtttgctagcaggacaggagaacttactccaacagggctcaactcataaagaaagctccagcgtcttgcatccgttaaaatcctaccctgaccaactctcaaagcagagcttattctaggtagatggaacatgggttctctaagtcaacagcatctgtaccatcttatggacctataccaaataacagctggtcagtgctacagatagcaagcagtaaggacaacaaaaacatttataacttgctgacttttaaggagctttgggctttggaaatttttgccaaggatgttgttttggtagcactattaagaggaagtcgtgcaggctcttaagaaggaactaaatataagtgataagctaatctgtctcctgttttgctggcttacatttaggggtcagtttggagccataatcctcagcttttggcttcccttttgattgaatcactggtgattgatgttatatattaatacaggtgagaaaaaacctccaaactctagaaaactaggaaagagttttattttttattactttatacatgtgagaggagagtgttaatgattttttttctgatttgaaaaaatctttccaatatttataaaatttaggaattcagaaatatcaatgtgaatattacaagagtgacacaaagcaagacaattgataaaaagtacagacttaatagtaggtaagggttgttttcacaaggcatagcaataatttctaaagtccaggtatcttataagatttcattattataataagacaaaatcattcttataaaagattttctgatttgtaatgatctcttctttgcagctgcaagggaaagagggaacattttattttaatgaggctaagatttcatacataaagagttaggcagtcccatagctgaaattctattagcactaatacaaaaaaaaaaaaaaaaagaaatctcaagaaactcataatatgggaaggataagagaaaatgaactatcaagcatttaatatttatatctacagttagaaacatttaaaaatgttttcagtaccatttttccttcataagtgggatatattttctttcatttttgttctgttttgcttccaagatttggaagcaacctaaatgtccatcaaaaggtgaatggataaagaaaatgtggtacatatacatttgtgtccagaaacttccaagtaatttttaacttaaggtgattattagttatgggttagtgcaaaagtaattgtggttttgggcaagctgagctttttcagccttaggccatgttctaggtcatctattaagatttaattctgggcttaggaggaagcttctctgttccttcctctatagaccctgattttgatgacgagaaacaattcttgagtgactcaagttggtaagtctttgattataaaggaatacccagagaaattccaaataccagaaatgctgctgctgctgctgcctgactcattacaaagggttagtattactccccaacatgtacaaggcacaggttgtctctaaatatgagtctctctacatgtactttttctgtttctcttccttttaatctttagaaacaattttgttttatttatgatttacttattgtttttcactcttaaggactggattcgtcagaaaacacgggctcatgaataaatgagctcacgggagacacagcttttgctcccaacttcctgtccatttctgttctgtttcagaagtcagagtgtagaatacagtcatccttcacgccatatcttccaagttgtagttagcggaaattcctcccagactaaaaaatattatcatttaaagatatttttgaatgctctcaaatgtattttcatagggaattaaggggatgggaatgtgataaacaatctccttcccttccctccttaactctgtcagagccttatgctttagttaaataactttttttctgtgtagagaagttggatttttcaggcaagattccaaagattaggaaacttcctacctttgggatcggtaggtgttggttgtaattattctctaaggagtggtcattcctgcttttctgtgttgttttccaggctggaatcttgcaacctaactgtattttgttgtctaaatatatctaatgctctcatcagaagccagagcctgatatttctgaatctgtcaaccaataatctgttggatgatggagtgcagcttttgtgtgaggccttaagacatccaaagtgttatctagagagactgtcgtgagtgtttctgttttgttttctgtagagtcattttgcttggttctgtgtagcttaattgtgatctgatagggaaacttcttgggtcttggcactaactggctcgtttgtcaattctgaataagctctacatgcatcccccttctcttcctctacttccctctcttttacttcacttttagacctatcatttttttctgattgacctctttattttcattcttttccaagcttcccctctccccttccgtgttttgtttcatcatatcctgcatacagctgcaatggaattcgtaatttaaataggtttgttgaggttaattttatagttgaggtatgggggttataagtgccactgatttccctgtgaaggagaagagaagcatgggctttgggaattgacagatctcttctcatctctttctctttcagcttagaaagctgtggtctcacagaggctggctgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgtaagtgtcttcaagtttttatccttaatatatattgtacattttgaaatatgtttaaaatagtaaaatattatgaacacattctgtcccttgctttttccctgttacccttaatgaagaaggtgaaagtgatattaataattgccatttattgtgtcctaactctactctggatcttgttttaaacatgcttaatctgcaaaatagtacccgatggtgtcaaattgaccacccaattttgaggggcctcactctacaggtgaggaatgtgagccttagggagataatgcaccttgcttaatatctcacaagaaaatgatgaatttagaactaaagcctaccacctatcctagtctatgatctgagctcagaacagaaatatagcactctgttgtatgtctgaatcacattgtgattattctgctcatttttgttagataattttctaaacattgaattaataagccaaggttttaatttggccaaatatggttaaattgccttccagatagattatttatattcccagcagcagtctagggacctgcactttaacaccctcattggacatctacaatctttttgatctgtattaattaaatagttgaaaagtaacttttaaagtaatttaaatcttgagcatcttttcaaatgtttttggccttttatatttaggaatttcctcttcatgggctgtttttttctgatgttttctattatatatatcttatagttattaatatcacatatattattattttttatatattacaaataattttcttagcatgttgctttatttctaactttctttatggtcatttttagaacagataagtttaaaattttttgtgatgtcaaattctgcctcatgacctcaaggagtttggaagtacctttcttttaaaaaaaatacacatatgtcatctcatactcttcatggtttaattttaacgtttacatgttaaattattccaaatttattttgttataaggcttaaacttattttcccccatatatcagatctattgtacaaaagcaataatggcataatatggattttccttactgtttgaaaatgccgcttctattacatacaaagagtacttactttattaagattactcttattctactccatctgcctgttcttctagtccatggagctacttctacaacagagtactatgtatatgtgtaatgtaatgaggttagcatttaatttattgtaagaaaaatgctgaagaatatgagtctagtttgtagcccaatttgatgtatatctgtttcccaagtgagacaggctggcagtgagggtgtttcatctgagatggaatgttggcaaatagataagggatcaaatcatgaaatctcttcagagaaagaaatctctggacagtagagcaatgattccatctttcttcacattgtccttcctgtaggctgaggcgttgccatttcacttcacttagcagtgaatatctgtcaacttctcttctacacaacaagagcctgacgcatctggatctaggatcaaactggctacaagacaatggagtgaagcttctgtgtgatgtctttcggcatccaagctgtaatcttcaggacttggagtaggttttctgttgctttacttttgtgtagtttcaacaacagagtgtctggggagatactgaaagaaaggctgagaaccgagcatctatcagagaaaagaatataaagctgattttccctctctcttctgcctgagacaagctggggaagtctgctcatcagatttctaaaaataattaccatagtaattctaataaactttcctcaggtaatgaggaccagaggcatcaggctgaacagtggccattttattctttccttggttgtgccccagtgaatctactgtgtgtcctctacttttaatccagaagctaaaattgttctctactagtttttctcttagatttatatttaaactcaggtttataattaggtcaactttcaaagaaattgggaaggagatttttacagtatcctacaatctattgctgaacagtagccattttattctttccttggttgtgtcctagtgaatctactgtgtgtcctctacttttatccatgaagctgaaattgtgctctactagtttttcttttagatttatatttaaactcaggttataattaagtcaactttcaaataaatggaaaggggatttttaacaatatcctacacatttttaaactccaaccattttcattaatattatgttttctcactctatgagcagatttgcatacatatccattgcatgtgcatacataattgtgattgctttatggacatgatttggggtttccttttcacttgatagtatttcagaaatacatttatcgaggtgtgcatgctgagaataaaaaaagaaatacattgaaatacttatttcaaattatcttcttgattattttaatgactgtatggtatttagtatttcattgcataaatactttggccagcatgaatcaaaacagaggcgtcacttagcaacctcagctcactttcctaccagggcctcccaagtgaccagcaacttttgtgagtcattaatggtctaaccccaacatagttttttagagctataaagtcaagctctttggttgacccagaagtatttgtcttgaccagactgactcatgataactaaacttccaaatgagtttaataatttaatgtgacacctataaacacaaggcaattacactgtagggttcaataaatacatttacttactttaggaaaatgtagatgacatgggttactatgtgattctctggaatttcattgatcattattcaactggaagacaaagttttacttaatggatgttgttaaatccaatgtcttcatttaactacagacgtataatttctaagtgacctatatacccaaggtctttgctagcccactttctgtccttagcattgctgtaaacaaagctgtactttcttaattaccttccaaagcctctatgcagaccatgtcaattctcttaaccaatattttcaaccaatatgaactagatgctgagggaactaaaagtcattaaggtgatgcttttgtccccaaataacataaaatgctgataacagggaaataaatataaagcaaattacaatatattccatacgttgttataaggatatgacaacagtctcagggattgaggctgggacttctcagtggagacagagttactttaggctagagaaatgatgaagattctgttatgtggggatatgctaaacagaaggaaaggagagagaatagaagagacgcaacaacaaatatggtttagttggagaaaaatgcatgtgtatggttagagaataatgtggggacaaaatatggaaagagaaagcttgaggccagattgtgagtgctcttgaatgccatgcaaaggacctggaataaatatctttttatatgtagctttcttctttgaagataatactttgagatagattccaggaaacttttttcacttaaagatatattaaaaactgaaagcacagagatctattagttccttgggaaagtttatattcatttttttaagtattggtaaaaataaatgtttatacccttgatttttaaagctctgtagataacctgtttgtggaagaaaacagttttacctgctggtttattctgctcattaagaaatcccatcatttttactgataaattagaccctcccatgtatgtcctggattgtagatagaaaagagtgagaaaagaggttcaaatacctgggtatatctcctaggaagaaacttatttaacctcacaatggaaggattcacttttcctattgtaattcttacagattgatgggctgtgttctcactaatgcatgttgtctggatctggcttctgttattttgaataacccaaacctgaggagcctggaccttgggaacaacgatttgcaggatgatggagtgaaaattctgtgtgatgctttgagatatccaaactgtaacattcagaggctcgggtgagttcatagttttccattaggaaaatgatgcctatttggtagctagtatagctagaagatatttagtgtatggagagaggataaaaactaaatggggctagaaggtaagttactctcagaaataagaatctaaatttcaaataaatggatcaatgtactgcatgttctttagtatagaagccatatttcacatttctttgtgtcccctttagtaccttggacagatacttagtacgcaaatggtacctggtttgggtcttcatgttctgtcatccttcagatagtctacttgtctttgaattaatttttttattaaattgaagacttttactaattatcttctatctgtaaaatactatgttcttaaggagcttgtaataaaatcacattctgtgttgtggacatttcttacgttcaattctgtgtttagatttttatttaattttgaactgatattggctagtacattttcacttatacaacatgaattattgacctcagggtcaagaattgtgctctatgtgtgggaagctcagacataatgacatgtgtcatcctttagaaatttaacagtcttccagagaaatctcccctgactcttccaagaaaatgaagctgttatatttccattgactatatatttttataatagcaatgatgatgatgtaactgttaggtctgagatttaattttatcctacttacaacctaataaattcaccggttactgtttcatggatgctggacaaaaaacaaaaccaaacccacaagactcttaggagagacaaaggactttattgcttgtagcagagcaagagcatgagtattagcatgtttgcgtcagttccttttgtcccccgagtctcacagggctgatgaagagggtccagatggatgcctgcacatgcaacattgagactgagagacctaggattttacaggaggcagtaataagcctgctgtttgtccctcaaggttgctcattacaaacacaatcctggaaaatggcccaggtaaagcgctgtcagggccttgcatttttgttagcaaacatgtagcagagagaaagacctatggaagaatatctccccaaaatatctaccccttgtttctacacagtaaaatcttggcttctggtgaattttcacataaatatgctactccattggccactctgattaacagagactgggaccaaatctgttcagttaatctcatctaccatttaattaaggccactaataacaaaactccaagcatgtgatgagcccaacttgtagtattgatttcaaacattcccacaggggtctgactcagtcaactgagtaagtcccaggaaggactactaggtcttttatgctttagaacccatacaagggagtctaaaatgagctgccattctttggtgtcactggcaataaataaacaaagatgggccaaaagcagccctcctccccagtaaagagacagttagcagtccactcttccccacatgcaaacatgtaactgaaaggggtagaggtcactctaattttggatttgctgttatattttatttggttagccattgcactagtttggttaagccaggtaagcagtctcactggtagttgtagcttcctcattctcatacgtggtatagtccaaggctgttctagcatcaagagaagcttgcagatttgtatcgaattgaaacaaggttgtgctagtgattgtgtttgtatacatatgataagattccacattaggaggttgctattgatggcatcaggcacagcaaagtagttcaggacctgctatgtctacatgagattttctattttcatagtatatagacaggcatgacaaaccaggccgagggtcagtctgtcagctgcagttgctgcttagactccacagaccacataattattttgccaggccaaggtgttggatctaggagaaaaaagagagagtgaattgttctcctcactctccacacctccaggttctaaagtgttccattccaaatattgttgctgctcttcccctacaccaatgaaatcagtttgtgccatcccagtggctagaacttcacctattctccaattatcctttacttgcatggagacctttggtctggaggaatcatacaaatgggagagagagaaaagcatctttacaatatttacagaaacccattatatcttatacattatataccaattctatattatctgaatatcaaaggcaaattaggaagctttggagcctctaatctaccttttaaaaatatatgtagctgtaaagttcaattttataattttcctatatactctttttttttccagcaaaaagtattgaaatttttatcccctctgcttggtagggacatctttgttataaaccacattttcattggtgcgtggatctgttcctgggttctgttttcctttccactgacctgtttgtaattcccagttctaacaatgctgtcttaattaatatagctctatgataagccctgatacgcactacagcaattcttcccatcttcttaaagagaattttggctctccttcccctttacatttgcaaataaattggaaatatcaacttatcaagttacatacatatgtactgccccccaacctacctatatgttggcgtattgaatcgaattgcattaaatctatcagtgagtctcctgatacaccaaaaagacatatctcatttatttaggtctatcaataaagcttagtaattttttcttgagtggtcttgtattttgttactggttaactttattccaaagtgcttactatatttcatgctgttgtaaatgattgttttagttattttttcattgtgtttatacatagaaacataggagtttttaaagttggtttcttatccaatagcctgccacattctcttgcttattctagttgctaatttgtagatacttttgtattttttaggtatacaatcacatcatttgggaataatacaatgtagttgttttttccttttctgttcttatattcttttttcattttttatatgccttagtaactgttaatatatgtgatataatgttaatatgtctggggataatgaactttcatatgttgttcacaatgtttgaagcacaacttcagtggttcaccaatttatcaatttaaggaaattgccttctacacctagttttctaggagtattctttttcttttttttaattatactttaagttctgggatacatgtgcagaatgtgcaggtttgttacataggtatacacgtgccacggtggtttgctgcacccatcaacccatcatctatattaagtttttctcctaatgctatccctctgctagcccccatcccccaacaggccctggtatgtgatgttcccctctgtgtgtccatgtgttctcattgttcaactcccacttacaagtgagaatatgggatgttggattttctgttcttgtgttagtttgctgagaatgatggtttccagcttcatccatgtccctgcaaaggacatgaactcatccttttttatggctgcatagtattccatggtgtatatgtgccacattttctttatccagtctatcattgattggcatttgggttggttctaagcttttgatattgcaaatggtgctgcaataaacatacatgtgcatgtgtctttatagtagaatgatttcttatcctttgggtgtatacccagtaatgtgattgctggatcaaatgttatttctgattctagatccttgaggtatcgccacactgtcttccacaatggttgaacaaatttacactctcaccaacagtgtaaaagtgttcctgtttctccacatcctctccagcatctgttgtttcttgactttttaatgatcaccattctaactggcatgagatggtatctcactgtggttttgatttgcatttctctaatggccagtgatgatgagctttttttcatatgtttgttggccacataaatgtcttcttttgagaagtgtctgttcatatcctttgcccactttttgatggggttgtttttttcttgtcaatttgtttaaattcagattctgaatatttgtcagatggatagattgcaaactttctcccattatgcaggttgcctgttcactctgatgacagtttcttttgctgtacagaagctctttagtttaattagatcccatttgtcaattttgggttttgttgccattgcttttggtgttttagtcatgaagtctttgtccatgcgtatgtcctgaatggtattgcctaggttttcttgcagggttttgatggttttaggtcttatgtttaagtctttaatccatcttgaattaattttgtgtaaggaaggtataatgcgtaaggaaggggtccagtttcagttttctgcatatggctagccagttttcccaacaccatttattaaatagggaatcctttccctattgcttgttactgtcaggtttgtcaaaggtcaagtggttgtaggtgtgtggtgatatttctgaggcttttgctctgttccattggtctatatatctgttttggtaccagtaccatgctgttttggttactgtagtcttgtagtacagtttgaagtcaggtagcatgatggctccagctttgttctttttgcttaagattgtcttgactatacgggctcttttttggttccacatgaaatttaaagtagttttttctaattctgtaaagaaagtcaatagtagcttgatggggatagcattgaacctataaattactttgagcagtatggccattttcatgatactgattcttcctatccatgagcatggaatatttttccatttgtttgtgtcctctgttatttccttgagcagtggtttgtagttctccttgaagaggtccttcacattccttgtaagttgtattcctaggtattttattctctttgtagcaattgtgaatgggagttcactcatgatttggctctttgtctgttattggtgtatatgaatgcttgtgatttttgcacattgattttgtatcctgagactttgctgaagttgcttatccttgaagaattttgccaaatgtgatgaatcacatcgatataatatgcattatatcaaccttgcattttttggagtaaaaccaacttggacatatctcctgtgtacattgtgtaatttactttgttaatgttaatattagtgacagcatttaaccattttgttcataatggagataggttataatttcttttgcagtcttcatcaagtttttgtgtcagaattacagtattttgatgagttcaggagtgtttcttatcttttagtttcctgagaagatttttgtaagattggaattatttcttctttgaactttgtaacaatttctggtgaagctgtctaacctggagtttctttgtatgtaggatttttgacttctgattcaattttttaaataattatttaggttttctctttctcatagggtactttttagtaagtatatattgttgattttatctatttcatctaaattttaaaacttattggcaagcatctagtattttattatttgcttaacttcttaatcatctatagtgatgtgttttttctcatttctgatattgaatttgaccatttctttattttttattcaaagaacacaacattgatccactctgttgtacatctacattctatttcattaatttctgtttttatcttatttttcttcttgtacttttgttgggtttattttaccatttactaaattcttgagttgtatgcttagacatacatattccctttcttcttctccaacaaagatatttaaggttacaacttcccttcaaatgactgcgttaacttaatcataaaattttgatgttgtatgcagtgtttttgttatttttgagtccacaatatttgtaaacttccctagaacttttttcttcaactaataggttatttgtaaacatactccttaattttcaagcatgaggcttttctttttatattcagtctgtagaattgttgtctgagaacatactgtgcatgagtacagttctttgaagtttgttgtcatttgctacatgactttttaaacatacttaagaacacaaaaaattgttatttctaatttaatttatattttttctaagtacggggtctttttctttcacccaggctggagtgcagtgatgtgatcatagctcactgtagacttcaatcacctaggcaaccaagcctcccagcctcacgagtagctaggactacaggtgtgcactaccatgtctggctatttttttcttcttttctggtagagatgaggtcttgttctgttacccaagctggtcttgaattcctggcctcaagctactctgttctcttagcctcccaaagtgctggtattacaggtgccagctactgtgcctgggcagtggcagtattctgtatcagttaattaagattattagttctgtttatctaaattttagtgatttttttccagataactcagttactgtgaaaaatgttaaaattttcattaaaattctagatttgagtctttgcagttctgttcgtttctgtcttctatattttgagactataatttgtgactgaaaatataaaatgattatatttcctgatgaattcatgataacactttgttttacgatgctttttcccctaaggaagattttgtgtgatatttacataccctgtctcataattagtgggactatctcttcatcacataaatgtgatcacttaacaaaaaaaaagttttgtatgctcagcatctatataggtactcagttgttcaatggccaggtaaacataaggtgaaaattagattcaaattgtttaggagaatgttagatgcagaaggctgagtttgacatacttcctcagttcacgtatatactattatcggcttgtgcagaggcccttggctgacagatgggtgggttggctaatttatctccattagccattctctttcccacctataggcagctgacctaatgtattcgaaataggccatgtaattgcatttttatttgcatcaatggcatgatgctagagaccttattatatttcttgcttattttattttattttttttgagacggagtcttgctctatagctcaggctggaatgcagtggtgcgatctcagctcactgcaacctctgcctcctgggttcaagcaattctcctccctcagcctcccaagcagctgggattacaggcgcttaccactacccccagctaatttttgtatctttagtagagacaaggtttcaccatgttggcctggttggtctcgaactcctaacctcagatgatctgcccacctcagcctcccaaagttctgggattacaggcatgagccaccatgcctggcctattccttgctttttaaacactcactaccaagcttccaatatctagttatagtgatgtatttttagtgatgttcaaggattcaactgcttcatagtattttgtaacgtgcttgcatattttatttattccttaataattacgaatttgtaattcatgattttggaagggataagttcagcctagaaatatctggtaataatgaatattataggtacttatagtccttgaatttatactaactgtgctcattttttaaagtttctggaattatcctccattctgagttcacagatctcttgtgggctttgttgtgtcatcgaataaattcatttttatcttttgtctctcttctctacaggttggaatactgtggtttgacatctctctgctgtcaagatctctcctctgctcttatctgcaacaaaagactgataaaaatgaatctgacacagaataccttaggatatgaaggaattgtgaagttatataaagtcttgaagtctcctaagtgtaaactacaagttctagggtaagtctccattggcttctcagggggagcatttcctataatgagggatttggggagccactcattaatacaggcctcagaatccacctaattgtgtatcattgggtattttctagacacttatttgtttttctgtcatagaacactgaatattgagagatacaatatagcatagtggttaaatattgagcaccctggaaccagcctagatgagcttgaattctgaccctaccacttactaaatgtttaattaaggctagtcccccatcactctttgttttgatttgcttatgagtaaaatgggtgaaatgataaaatctacccataaggttatcatgaggatctgagtcaatataggctaagtacttagaatggtgccttgcatgataataaacaataaatatgttctctgtttttattattatcagtagtaatattaattttgcttggatagcaaaaggctcttggaggatcctttttaattttaattggtttctctttctcttctgttaatttattctgtcttccttccactactttatctccctcactgtatctctctcagttcgcttccccactcctcacccatgttataatattatctctctattttaacagaacagttttttttctcctgaaataaatcctttacagagaaagtggagggctgtagggaaattgaatgcaggaaaagagatgttcccttgttttctcaggttgtgcaaagaggcatttgatgaggaagcccagaagctgctggaagctgtgggagttagcaatccacacttaatcattaagccagattgtaactatcataatgaagaagatgtgtcttggtggtggtgtttctgatttgaagaaactgacattcctttaaaaatataaatataaatacatacatacatagatatatacccagacttgggtgcttagcttcagatactctatgcccagagatagtgcacttggcagctgtcagataccattcatctacttctctgtaaaatgtctgttctacttcacacagtggtcgagaggctaaaataaaatgaaaagcataaaactctctg

SEQ ID NO: 575 - DNA, 67475 bp, Homo sapiens
cttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggtaagctttcaacatcctgcctttagcccatgggcccaaccattgcgtcagctccacccacccaccctcactgacctcaaccctttacagtcccaaggcctccccttcctgatggtgctgctcccctatcaccacgtggagccccacaggtatatccccgcaaacccctcttgctccagacaggtgatcagggaggcttcattactccaggagctgcccaggacctcagggaggtcccccaccatgggagtaagggcctctcccccagcctccagggctccggcagctccacactccggccctctgcctcttctggagggctcctccttccagcttctgcctgtctccccaccccccagtgcttcattcccatggctcaggtcatcactgccctcatctggactgcctgcctgcctgcctgccatccggggcccacagagtgagcactctatggaagtccctctaccctgatccatcacgtaactcacctactgaggcagctgagaccagggcactgaaggaggccttgagtgaccaggtgtggccaggcagcaggcagggatgatgaggtgaggctgcaaggatgtggagagtcaccccttcttttcctcctcaggagaacaaccaggaggaagtactggaaggaaggaagggagatcgctcggtgagctggaggggaggagggcgtgccggccctgggaaagggccaaccacaggagactgtgagggaggtgggcggaagacgtgggtggctcaggggccatgaaccccatatgcgcctgggagtgtgtgtgtgaaatggggtttaggggagggtgtgaccactggacaaagcctgctcttattgtgtgtgactattgtggccttgggtttgtccctcttggatcctcctgtggtctttttgccttgactctaaccgggtgatgctgatgagcaggtccagaggcctgggctctgttcactagcctgtgctgggactctcagccaagccttctcagaaaggaggtgtcctctacatgtggtcacaccatagcctaggaccacagagggaatcatggtggcagagcctccagcccccctgccctcccattgcccaaacacccagatgtggagatgccctgccccggggtgccgtcccaagcctgctttctaacatcaggaggtgggtcttgcctaaggctcctaaccaggacctcatttgttgtttacacatgttggggtcccaaggatatgtttcttggcccacagaatggtcataaacaactgccctgtgaaggagggggtgctgtcttgtgtacagatgaggcaaaatgacaggatcctgtccccagctgcagagtgtctgctgggcgtccccaacacctgggaagtctgtctgtccttccaagggaccaggccagagaaatggggggcacctggggctctgctttgcctcctcatggatgtcagtcccgggtttctgatggggtttgtgatgatggcgccctaaagggaagctctgtggagagccaggggtctcgagtatggccttcatggcagggaccccattgctctccttttttacacatggcctcaaaccaggttgactttttagcctaaagaaaatctcatgaagagaaagacagtggtgtgggggagggtgtatcacttgagcctacttcacaggctcttgggaaggagcagtaggaggaggaggggtgcaagtagtgaaccccagagggatgactctgctgtgatgactgttaatgaggcttgagacttcagctcatttgtcatgtgcagctggtgtattttgagtgatataagttgatgacagcctccttcctgaacccactgtcaaggctgcaagaaatttttgagatcccacatccaaccccttgtgtaacaggcaaaacaggcctcaggttctgaaccaaggtcacactgcaagtttgtggtagactcagaattagaacgcaggccacctgctcagggttctttctctgtactgcaggagagggaaccagcatcactgtgtgggagtcaaggggcttctcaggagtgagtagtcctttggccatgaccttgccttatgtgaatggaagttctgagcatagtgtgaactgtatgtctacagctgatggctgcctggcagggactcttggccatactgggtttctgggctggctcatttctggtgtttggtatctctctacttcacgttgaatggctcttccctgttgaaaggctctgccagtatcccttaatatcaggtaaaactgcacaattcaagatggtgccagcaagcatgatgtttcccccatggtgacacagggctgtaagtagggagatgaggagccaggcatctttggaattgagggctgacttatagggctgacttatctccgtaggtttggaatagtcataattaatggcaaagttaatggtccagccacttagggatatagcaaagcaagagaatcttggcttgttgtcttcaacttgttgaagaatatcatctccatttcatccacccattacttggcatcttgggatcatttgaaactgttccacctgtgaaaccttaatctttgtgtacctcgtatgcattctgcctcccatatctccaccatgtctgttcatagagacctcaggcccctgagccctagtttttctcctcactctgaatcaactcttgttcctattctatctgagctctgttgcttgtcacttcaactgcccaccattcaccacctggcctcttagtctcctacctcaaccttagagcagggtcactgcctgctttctctagtcctggtttaaaggtgtggggggaattccttcgtgaattgacattggtccaaattcatggcccgcagcctccagcgagcccccagcaatgcccagcagtcctgtgacctgggcctgctccaattcctccacaactatttcaaagctctcacattacccacttattgggatataattcatataccatacaagttgcctgtttatagtgtacagttcaatggttttaagttgtatgaccatcactacaatttattttagaacattttcattactccccccaatgaaaacccatacccatttgcagtctcccccttttcctacaccccccagccttaggcagccactaatctattttctatctttatagatttgcctattctggacatttcatgtaaatggaatcacataatatgtggtcttttgtaactggcttctttccttagtataatattttctaggttcatctgtgtcatagcatttatcaatacttcatttctttttattgctgaataatattcaattgtatggatataccacattttctttatctattcatcaattgatgaacatttgggtgtttccacattttagctattataaataatgctgatataaactcttgtgtccaggtttttatagggacatatgttttcactccttgggtatatgcctaggatctatgttcaaccttttgaggaactgtcagagtgttttcccaagtggttgctgcattttacatccccaccagtagtatatgagggtctcagttttttcatattcttgccaatacatgttattatctgcaattttaagtatagtcatcctagtaagtgtgaagtagtatctcattgtggtttggcttacatttccctgatcactaatgatgactaacaatgtgcttatggaccatttgtatatcttccttggaaaaatgtctattcatatctcttatccattttttaaattgggttgcctttttattattgagttgaagcattctttatatattctaggtaaaaacaagacccttatcagatatatggtttgcagatattttattctattctgtggttgtcttcactttcttgatggtgtcttttgcaacaccaatattttacatttttatgaagtctaatttatctagtttccttttgttgcttgtgcttttggtgtcacatgtaagaaactgtaggattttttacaaagatttttgcctatgttttcttctaagagctttatagttttggctctttcatttaggtctttgaatcattttgagttaattttgttattggtgtgaggtaggggtcccaactcattcatttgaatatggatattcagttgtcccagcaccatttggtgaaaaaaccattttacctccattgaatggtctcgctatcctgttgtaaatcagttgactgtaaatgtaagtttatttctgggctctcaattccactgctttgacctatatgtctatctttataccagtaccacattaccttgattactggagctttgtggtaagttttgagatcaggatgagttctccacctttgttctttttcaaggttgtttggctattctgtatcccttaattttttcttacaaattttagaatctgcttgtcaatttccacaaagaagccagccagtattctaatggagattggaccgaatctgtagatcagtttggagagtattgccatcttaatagtatatagtcttttgatccataaatacaggatgtcttcttgtttattatttaggtcttctttaatttctttcaaagaagtttatagttttcaatgtataatattgcacttatttttagcagtttattcctcagtgttttattcttcttgatgcttttgtaaattgaattgctttcttaatgcaagtgtatagaactatgtataactgattttgtgtaatgatcttgtatcctgcaaacttgctgaacttgtttattagttacaatcattttttagtggataacttagatttttattacacaagattatgtcttgtatgagtagagatagttttatttgttcctttctaatctggatgccttttgtttcattttcttgcctaatcatcttggctaaaacctccagtacaatgttgaatacatttgtctagaatgagcatctgccccaccccaccccccttcttctggctgctcttaagatttttctctttatcgttggctttcaacaattgattatgtgatgtcttggtatagttttcttcacgtttcttccactgaatgtcttttgagtttcttggatatatgggtatatggtgttcattaaatttgaagaaacattgggcattatttcttctaatattttttctgacttttcccctgaaactccaactatgtgtatgttagcttgcttaatattgttccagagtttttcatttttcagtatttttctgtgttttattttgaaatatttctacctatgcctttgaatttacgaatctttgctttgcagtgtctaattccatgaagtatatattttattttagatactatgtttttcatctcttgaagcttgacttgcatcttaattatgtatttcatttctctcctcatcatagtcatatttttctctatcttttttacgtggagtgagtttatcatagctcttttaacatttatgtctgctaattctgtcatctgtgtcttcctacttgtactgtttttacccacaacacttctaacactaaatgtgtggtttctttccacaccaacaaccaatttggcaactctctagatgccaactgagggtcctgcaatttaatttgattctggtactaattattataactgaagttaatgcagaccccacagtttaagggctcagtcccgcaagacttcccccatttcataagtcccaggttgtcacctatacttctggccaaccagctataaattgggggttcctaggacccctgctcaggtatgaacatttgctagaatggctaacagaactcaggaaagcactttatttactctttactgatttattataaaggatacaactcaggaacagccaaatggaagagacacctagggcaaggtatgcaatggcgtggagcttccatgacttctccaggtgtgccacctccccagcaccccgatatgtttacctgccaggaactctccaaactctgtcatttagggttttatggaggtcctgttacataggtacaactgattaaatcattgaccattggtgagtgaactcaatctctagcccttctcctttccccagtggcttaggggtgagctgcaagttctaatcctctaatcacatggttggttcctttggcagccagcctccatcattaagctatctaggagcccaccaagagtcacctcattagaataaactcaggtatggttgaaagtggcttattgagaataaaaaagatgttcctatcatgcaagaatttccaagggttttagaagctctgtgtcaagaactggggacaaagaccaaatatatatttcttcttgtgtgcactggtgattgatttttctcctagttatgcatcttctcctcctccttttttgaatgcctgggtaatttttgattagatgataaatgttttggattttacaatgttgggctttgttttatcctttaatagttaatggtgggctttgttctgacaaacaattaagttacaggttgagtatccggaatatccgaaacctgaaacgctccaaaatctgaaactttttgagagccaaatgacactcaaaggaagggctcattggagcatttcagattagggatgctgaaccagtaagtataatacaaatattccaaaacttgaaaaaatccaaaatctgaaacacttctggtctcaggcattttggataagggatattcatcctatacttggaatcagttggatccttctggggttttcttttaggctttgttagggcaggtccagagcagcccttggccgagggctaagttggcctcactactaaagagtgctcttctgaggaccctccctgatctgatgttctgtgtattaggaggtctttctgctcggactggtgggaacacagagtatttccacccttctgtgaatttctgagattgctctgcttacttctctctgtggttcattccccagccttgggtcgttttctcacaagcatgtgcagatcagtactcagccagagataagggaagccctctacaggcctccgaagcacatttgtgcgttatctccctcccctccctccatccctccttctctttctcagtctcttgctctctcactctctagctcttccttctggaaaccctttccagggaataatcagggcacttgcagggttcactttgtttgttctctttcctcaggatcattgccttgcaccaccttttgtccaatgtctgaactgtcgtttcatctatttcaccggtttttaaatgttaaggcagaaatgtaaatctaggccctgttactccattgtgactgaaggcagaagtctctccttagttttaggctcaccattttaagtgcttactctacattcccaactggatatcacacagacccctcaaactcaatgcatccaaactaacatcttctctcaccaacctgtccctcgtcttctatttcctatctcctgggggaaacccagccccaaatcttaaaggccactgtgacctctttttcaccattccctgatatttaattaaataaaatcctttcaatttcatattctttgttaggcccaaatctgtgcatctctttcttttctctctgaccaccagattacctaggtcctcacggtatttagtctaagtgactatatagcagcctgcaaactgcctctttgcctccagcctatcttactccaagccatgggccacactgaagccagagtcagttttccaaagcatagataggatcctatcatcccccacttaatgtatttcagtggattctctgaagcagggctgtccaattttttggcttccttgggccacattggaagaagaaaaattgtcttgggccacacataaaatacactagcactaacgacagctgcttcacttttttaaaattcgcaaaaaattttcataatattttaagaaagtttacaaatttatgttgggccacactcaaagccatcctgggctacgtgcagcctgcaggctgcagggtggacaagcttgctctaaagctttagcacagagcactgcattcttagtggagacaaaaggctgtttactatctggttcctgttatattctccagcatcgtctcctctcctgcctctccccactgccagctgcaccagccccccaaactcatgtactcttttccatttctgggcttcacctgtgactccttccatatgtagtgctcttccctgtcttcacctggtagacttctcaccagccttcaagacttggtatcacctcctccaggaagcctactcagatgtcctcaatcacatgcagtgctaaactctatcacaagtcttagtaaatttatatcaatcatgattccatccaaatctactactgggctgtgatctctctgagggtaagaacgtatcttgcttagctcagtaccctcagtggaaagccatgcacagaataggtactcattataagtgcactggatgaaggaatggaggtgtggagccatggctggtggaaatgagatccaaggccagatgccctcgagtggcctggagtcccaatagcagaagggctctgtgcagcagggccttcctcctagattcaggcaatattgagcttgagggtttgtgctgcctccctgctctactgcacaggggctagacttaaggaacttgccattgctgcatttataccttttgtttcaaagggatccctgatgaatcatccaaacctgcacggagcctgagccccagggagggtccttggggtggctgggccatctcctgcatgtgacttagaaactgtgccacaaagagcctgatgcatcacaggacatttttcttgaaaagagattttagaataggatgtgatgaaggtctttgatgactgtgatgtgccaccatgcaatataactctgctagaaagggtcccatttgctcatccattttaataattatttatatccttcactgtcatttgattacaagcaccatgaaggcagggctgtatcttttttttttcattgttgtgtcctcagcctacagtgcatgtacacagtgagcactcagtaaataattttcaaatgaataataatagctaacatttgttgaggacttataccacacatgagtctaggccatttacacacattaactcatttcatagtcacagtaaccctatgaggtgagtactgttatcattctcattttgtggaagaaaaattagacacatagtggttaagtaaattgcctgaggtcacatagttaataactggtgaggaaagctttcaaagacttcatgaatgaatgaataagtgaatgaatgttttaatttagagtgtccacaaaaagggactacaatagatgaaggtgctttttgttttgtttgttttcttttttagatttttttaatgagatgaggtcttgttctgtcactcaggctggaacatggtgatgcgatcatggctcactgcagcccagaagtcctgggctcaagtgatcctcccacctcaatctactgaggacctggaactgtaggaatatgctgccagacccagctaaatctttgttttcttttttgtggagacagggcctcattatgttgcccaggccagtctggaactcctggtctcaagcaatcctcccaacttggcctcctaaagtgctgggattacaggcatgagccactatgcctggctgaaagctgtattttttaaaacaatcatcagagcatcagactttccataatttggactattcatactcaatatcaattaatatatttctctatataatatgtaatgttgtaatgttatgtaattatatgtaagattaaatatatgcaattaagtataatattacatatagcatatatcatttgacattactgcatgccagactctgtattgttttacataaattatcatatttaatattcgtaattctgtcaaagagatatgagaatccctatgaattcccatggtacagctaaagctcaaagtggttaacctcaaacatagagagcttactgcaaggcaggatttgaacccaagtctatttgactccatattcgtgctcttacctgctttgccatcctctctcttctgtagtcggcccaaagcatgggctaccttgtgctttccaaacccttgcccttctaggaagctaccaaaccctatggcatagtcttcatttcacagcctaacccaaggggactttcagtgccccaggcaggttttcccaacccccatccagtaggaagagctgaggcttccacagctcagaccccatggtgtgtcatcctgctattttagaacttgaagggtgccgtattggaggccatcctagaccaactaaatcagagtcattgagagtagggcccaagaatctgaattttaaatagatctccaggtgattctgatgtccaggcagatttgagaaccactggccgaggcccagcaaagagacaatgcatacccctcaggaaaagaagtagtggcttattgcccaggccaccttcacagcaccttttagaaccatggtggtattatgtggtatatatatatatatatatagatagatagatagatagatagatacacacacacatacatataaaataaaatcacattacttttattgtgtaattttattatgtaattttattatataaccataataacatatgtatgtaatcactacatattcattgtagtaaatttggaatacataaaacaatataaggaagaaaaataagatgacctatagttccaacacccagaggtaattcctactgacattttgattaattttcatctttaaatttttaattgaagtatatatagtaacatggaaatacacaaattataagtggacagcttatgatgaatttgcacagctgaacacagacagtcatgttaacactacccagaccaagaaacacaacatttgccagccccctagaagcccacgttgagcccttttctgataaatgcaccctcccaaagtagtgatcccgacttttaacatcatagattaattttgcctgtgtttgacatttatataagtgggataatttattatctactctttgaggctggtttattttgttcaatattaatttgcaagatgcatgtatgtcaggtatgtagttatacggtagttcatttattattgctgtatagtattcaattgtgtgactgttgtagtttgtatatgcattctaccgttcatggacatttggaaagtttaaagtatttggcagttacgaatagtgctgctataagcattcttgtacatatcttttggtgcatgcgtctgtgtttccatgaggtgcgtacctaggagtggaactgctgaatcttatgttccattctagtggatgctgccaaagttttccagaattgttgtaccagtacactttcaccagcaatatatgaatcccagctgtcccatatctccaccaacacttggtcttttctgtctttttattttagctgttctggtgagtgtgttgcatgtggtcttgtggttttactttacattttcctggtgaataatgaagttgagcatcttttcattcatgtatttctttttaatcttttacttattcacccactcctggtaatccttaattcattttttttaaaaaagtgaataaggccaaaaagctttccataaataaaacggcctggttaaagtactattttatttttcccttcagcgaagtctgtcatcttaaaaataagtgccatctaactagaagatattaaagaaaatgtgttttctgctcttctgtctcttagctcttttttcctatgctttcaataatcttttaacttttactggttccacaataaaattgcatccttttgagggatgtaatcttatgagacaattgcacacatattctccaaagaaagactagtaggaccattaaaacagaggaaaagcttaaagtcaaggtgagacaggaagctttcaagtagctaacggccaggaccagttgttccactgggaaccgtcaggaggggagcccggggagtggagtagtgagcatctcagagtggatgctgaaaatgaagttgtttcttttatttgctttgtgttttgctctttgttactgaaaaaaaaatgggcttaaattcttaggtgctactttgaaaatgatctcgggtgttacctgaaaaaaatgtgcagtatgagtttgttcacaagtggcaattacatatgtttgtgtgtgcctatatcctaatgacattgtgtaaactgttttgtcatctaaatttttcatgtaacatactttcccatattgttaaatattatcgggaaaatactgtttttaatggctatataatagctcttttatggatttgttgaaatttaatcattcctttattttggttatttccataatttctaaattctcaatgatgaatatatttgtacataaatctctgtactcttgtgatcactttcttagaatagcttcagagaaatgaaattaatggctcaaaaagaatgaatctctttaaagttctttgatacattcatattatcacatttctttccagaaaggctatcaatccactctctccgcacagtatctgaagggccaccctcactgcatattcgccagctttgcactcacttcaattacagtgtctcttgccatatagaagacggtgatttttacctaataaacttttatggcttctggatttaggaacatgcttagaaaagctcccccactccctgcacatgactagaagaatactctctaacatgttctacttaacagttttcttttttgtaataaacctttaatcctctgttatttgtttttgtatgtgatgtgaaatagggatatagctttatttgccccaaatggatagcaagttgatctctaagccacttactaaataatccaatgtttcttcagtattttgaaaggccatctttattgtaaaccaatttcctctatatacatggtactatttctgtactgcattggtccattggtcattctcacgtcgataccactgtttttggtacagtttcctagtacagatgatttattggagattcatagcacagtttgataactggcatggcaaatgcctcctcattcttttacggttacaaaattgtcttggctaacttggaaaactggcttatttctccagatgaattttggaataaatttgtccagttgaaaaaaaattctgctgcatttatgattagaatgggatcacacctgtcaatttatttgacaaaattgcagttccatacaggaacaggggatgcatctccttttatcaaggatgttaatataagtaaaattttatagtttgttttattattaatagaattgtagtttgttttcatgtatgtcgaaggcatttcttgtgaagcttccctagataggttattttttctattgcttgtgtgaataggaccttttttttttttttttttttttgagacggagtctcgctctgtctcccaggctggagtgcagtggtgcaatctcggctcactgcaagctctgcctcctgggttcatgccattctcctgcctcagcctctcatgtagccgggactacaggtgcccaccaccacgccctgctaattttttgtttttgtatttttagtagagatgaggtttcaccgtgttagccaggatgatctcgatctcctgacctcgtgatccggccaccttggcctcacaaagtgctgggattacaggcgtgagccactgtgcccggccggacctttttaattatatttttaaattggatgtttctgatatgtagaaaagccatttatttacaggtagttattctgtattaatcaatgccactgacttatttattaattctaatagtttttcagttaattttcttagattttgctaggtagacagttggatatgcaaataatgatcagtttatcttcttttctaataattatgtgaaaaaataaattattgcattggctagaacttataaaacaatgcttagttatattctttatcctgtcaactatacttctgttcctagtttactaataaatttcttttaaccaaaaatgagtgctgagttttatccaagacctctttggtatctgttaaaacttacgacatttatcattaggcttattaatgtgatgtattagattaatagggttactcatatataaaccatctttccatttccggaaatggaatgagctctatatggtgcatgttacatttttcattcaacttacttctaggtttgatttgttaatcttttattgagaatgctaaatatatttttaataagtaaggctattaagtattggagttttaggtttctggggagttagatttttatatcagggtttgattaaccttgcagaattagttggttgcatctcatctttttttatgtattgctgagtgattcctctaactcaataattgtctgtttttatttatttatctttatttattaatttatctatttattttgagacagagtctcgctctgtcgcccaggctggagtgcagttgcacgatctcggctcactgcaagctccgcctcctgagttcacgccattctcctgcctcagtctccggagtagctgggactaccggcgcccgccacgacgcccggcgaatttttttgtatttttaatagagacggggtttcaccgtgttagccaggatggtctcgatctcctgacctcgcgatccgcctgccttggcctcccaaagtgctgggattacaggcgtgagccaccgtgcccggccaataattgtcgtttttaaaagtttgaaatacttggccgggcgcagtggctcacgcctgtaatcccagcactttgggaggccaaggcaggcagatcaagaggtcaggagatcgagaccatcctggctaacacggtgaaaccccgtctctactaaaaatacaaaaatattagccagacgtggtggcgggccctgtagtcccagctactcgggaggctgaggcaggagaatggtgtgaacccgggaggcggagcttgcagtgagccgagatctcaccactgtactccagccggggcgacagagcgagactctgtctcaaaaagaaaaaaaagtttgaaatacttgtcccaaaattcatcttggtctggcacctttcttgtctggagctgtttagcaacatttccagtttcttctatggttattaatctaatcaacttttctacttctttttaagtttagagatttatattttctagaaagttcattgtgttgagatttttaatttattagtctagaaatatagtaagattcagatgtgtacagtctcatctgtatctttgattacagccctttcttaagggtttgattcttttatggtcctctgactttccacatgcccctccttgggcctggcaggggcaagggctggagagagagagagagagagagacagagagagagcacaagtgggagtagggaacagttgtgggcccatgtccatttccatcaattggaatggatatgtgtgagcctgtagacatgtcctcacctgcatgccatgtcatctcccagcccgaatgtctgttgtggcatatctatgcatacaccttgatgtgtgtcctggcatatgtatgtgtgtatgtgttcctccatatatgtgtcagcatgcatgcacacatggtctctgcagccatggagatttccactttgtgtgaatattgtgtacatgttcctgtgtgtactgtacctgtgttcatacatgtgcatgggtgtatgttcctgtgttactgtcactgggaggcacatggcacatctggctaaagggatggtagagtagctcagcacagccttggtgcttacatggcttattctctgccattttaaacaatctctcaaagggccagaaggtgaagaggaggtgggcttgggcaagatggggtgtggaggctggcccgtcctagagtcactctgtcatgactaacccaagtctggagcccaggcctagatgctcagcctgtgtcccctggaaaccccctcagctagacagagaggagagggtttactgtaactcatcagtcagggcagctgtctgctgttgccatggaaatctgaaggcagcatcttctgcaaggaccaggatgtagagtctagagaggacaggctgcatcagcctggtgggatcagtctggagtggcctgtgtgtgtgcgtgtgtgagagagagagaggtgggaggagaatgcaagatagtgagtgagctttctgaagtgggtggcgcatacctcaccattgctctctaaggcctcagccattactctggattatcgctgggtggcgctgtaagaaggggtgtacccctgagatggcttccctgtgcccatcaggacccggtctggcctgaggctgctcttagagtgtcctgggaccacctagacagatgtgctggcatctgcccatcatgggccccagagcccacccagcatctgctgcacactggctcctccttgctcagatgatggggtggtccaggaggcaggcccttaccctggccgcacagatgctgggtgatgggagcagacagacagaggcccctcaccccaggactcagctctgctgctgatgggctgggggtgggggcaaggacagggcaagagtacaggatgatgactgggggacaggatagagtccaaccttcaggtggagctgagggctgggacagccaatgacagtgtgtgcctctgccaccgcctcagtctggcaaggcataggaaaggagcacccccttggagtcctgacagcacctgtggagttggaagcaggagccctggcctccctgctcaccttcccactagccccttcgctcagggccctgtgacttctgatccctccctgtgacaggggagcctgggctcagcgttcactgcagcctgggcaaggcccttaagcccccaagagtcccgctctcacagggcatgggaggagcttccagaagcagatgggtgtccttgtttgggttgggggtgctggggagagcaggaaggagctggctgctggagccgcctgaggctggatctggaggacacagaggtgtttagccaacagttctgtcctatcccttctcagctctctgaagtcctccctgcacctcaagccagggcctgacctccagggaagcaagctgtcaccacgaggaagtgcaccctagctttcccacctcgtgctaccaggatgcccctcactctccttaatccagggcatgggctcagagggctggctggggtctcctgtcctggaatgtgcggccatatgggaatgccttgagtgtgtgagggccatatgggaatgcctgtgcgtgggggtggcatgagtgtgtgctgtgaggtgtgagtttggagagaagtataaataaatgatgggcacatgtgtgtggtgcgcatgcttgtgctgacaggggaaggcagggggacgtctggagtgtcagtgggttgtggtgggcagggtgaggcatccatttctgtgaaatgcctggggggagggaaaaggtatttggcacagtacatgtgggtacaaagcacacgaaggaattttgggtacatatgcgcatgggagcctttgtggggtgtggtttgggtatgcaggtaggctgtgtgtgaggtagagctggaggaaaatctatctgtggagtgtctgaggtgatgtgtgggaggcagctgtctacaggtgagcttgtctctgagtggtatatggggtgacatgttgttgtgtgtgatgtggtttgggagggtgaggggtgtgcaggcatgtccccaaaacaagcacatggtgtgtctcaagtaaggtgtgggggcagtgatgggaacgaactacagtatgtaggccaagtgtgtgggggaagggcaagtgggcgtttcattctctccacacgtcacgagttaggaggcaccattttccccctcaaagttgaggaaactgaggcccacagagtggaaacaagctggctggatcacacagcagggtctgttagactctcaggatcccagctctggcagctcacaagctaggctctggagggctggggaggggactggccctctgggtaatggcagtaatggagggtcccattcagttctttagggtgactctcctggaactggcccacagacagctcatgagaatcgattgcgcaataaaggaaaatgtttgtaagccctttgctcaacatagctgttattaagcatcaaactggccgggcacagttactcgcgcctgtaatcccagtgttcctggaccaaaccgagggtcagctgcttattctcaaggcccagtaacgagatgcagatgaactgggagagaggggagtttttatttctgtaaccggtcacagggagaaggcctggaaattattgccagaccaactcaaaattacaaagttttccagagcttatatatcttctaaactatatgtctatgtgtaagtgtgcattcgtctaaagacataagtgattaacttcttttaatctataactaagattcgagtcctgaagaccttcctctggggcctcagtaaatttacttaatctagatgggtccaggtgccaggggtaattaccctccttatcttgtcccctgcgaagtcacggaggtttggggagttccttcagccctccaataaaacttatttgtggaggcctggggagtttcttcagacccccaataaaacttgtttaaccttaaacgaggcctgttaagaattccttcattattttgtcatgctttaaggcccaggaaaggcctaggcaaaactcttggtgggcttttgttacatcccagcctttgtataagggcactggttctgtcagcttttaatatttgacttaaccactcagtcagtactgaaacagttgttatggaggcctgtgttagtgatgcctggcctgccgcaccagcactttgggaggccgaggcaggaggattgcttgaggccaggagttcgagaccagcctgggcaacatggtgagacccccatctctacaaaaaaatacaaaaattagccaggcatggtggtacatgcctgtagtcccagctactcaggaggctgaggtgggaggatcacttgagcctaggaggtcaaggccacagtgagccgagatcacaccactgcactccagcctgggctacagagcaagatcctctctctcaaaaattaaaaaaaaaaaaaaaaagaagcggtataaatttaacattaaacaagttatgtttacaaaggtaatatactgaaaactcaccacttcgtattcattttactgcctttccctgcgcttgtctgttgtgtctgcggggtggaactgccacgtgaccgtgcactgctgagcatctcctcgcacttcgatgctcagtcacatcacagattggccatggcgagggtggctagaccaggggagtcaacaggtgctgcacattaagacctggtttattgttttgttgattgtctagacctgagaaagtgatgggaaaaaatactactaatgcagattacattttaaagggtgtcatgtttatagttgctccatggtgaatagcagaaaacaaagatttttccagtattcagaaactattaacctattcagcaaagaagtcactccgaccaccagtgaaggagtgaagttctgacatgtctttgttgtttcactttcaacttacttgttaacataaatgaaaatatcaagcagcattaagctggaactacagtaatttgtcattgcaaccgtaggttggctacagataaagagttaggcgaaactcattgaatgggttgatttctgggacagtcatctggctatatggaatttacaataaagaatattggatatttcattagtatttgtaaattatgtgctatacatcctttgtgtcagtaaaatttataataaacttattgagtctacgcatgcagacattttctggagagcttgttgttaaatgtcactgttaacaccccgtaggccctccattacacatagtcccaacatgtctccttactgtgcagacggtgaggtagggtggggtggagggacagatgtaacttgcagagaccctgggagcagtgtcttaggtttccagacaagctgtggcttgtcactagatcagcctgacctcctcctggccgggggcactggggctcaggtgggggtcccgttcattggtcccttctctgtagcaggctcagggatttacaggtcagaggaagaagacgtggtcactgcctgtatggagctcacagcccagcagaggagacatccagtcgcagttagttacaccctggagagtacaggggcaaaaaaagaagaaattgcccagctgaggcaggagcgaggctgggacaagaggagctgctcagcggaacagtgcctctcgacatttagtgtgcagcatccacagatttgtgttaaaaatgcggagattctcttttggcaggtctgggcagggtggtgcccgggagtatgctaggggatggtgaagcaggtacccaagggcacactgggaaaagccttgatctgaggagacgagagggtgtgtgctgaggcaggagatgagaaagaagttctgcggggagatctgccgggagtttaggagtggctggagctaagccagcctggaggggagacagcagagcaaggcaggagaggggtcagggggcaggtcctgcagcctcgtaagcctcatggaagagcttggtttgtatcctttggaacgaggagcagtggaaagagccttgtcagcagacaagtgacatgctcgggttggcttttaaaagtgtaatgttcctggagcaggcagaactgcagtcaaggagaccagaaggaggctggggacatgtgaggcctcgatccgggcagaggcactggggacaggggaggggaccgataggagggcttcatgggtggagccacaggcgagatgaggagggttagggtggggcctgggtttctggggtgatgactgagcgaatggcaggactatgcacattgccagaaaacaggaggaagagcaggtctggagtaaggtgagttgctttgaacctggagacttagaggtatccctggaggggcccagaggcatttggggctcaggggagccatcaggaagtagatttgggagccccatggataggtgggaaagccaagagagtgaagaggtcacctgcggagaacacagtcacaagggtccagaactagtgctgaagggccaagaactcaggcctgcctggaccttgtttctggaaggggtgccagatgccaggtccctccgtacaggaaaaccagagagtgggcaggagaaggttggaggaggtcagaaccatgggtcgggttgctggccacctctgacttaggagttggaggccacagtggttaggagtcatggggcctcagttctagctccagccctggctctgctaccaacttgctgtgtgacctttggcagatctctacccactctgggcctcagcttcttcatctgaaaataagaaagctggaccataccagtgattttcaaatgacatttggagccccagggtcacccagaagcatctccaggaagcaggagttgagggtgatggggagggagagactgagagtgtggaaatctagtcccaccctgtccccagcttcatccagagccacttgcatttatgttttctgttagcctcttcatgaaaggatgttttccaactgataactactgggccagaggatcccttatactgttgtacgtatttggggtctgtgaatccttgccaacatagaagctgatggagtctgaggaatgacacacactgagaaaaccaagcatcatcattacagacactgtgtgaactccctgcctgccacccacacagcacagtcatggttatgtccatgcttatgtaggcctgggctctgcctagctgcgggtgatttcatcagtggatgccgctcagtttgcccctgcctgctggctggctcgtccccagccccaggcatcagggtgccccatggtggggcctgtgtggccctggcccttctctgctgccccagggctgtgaagccacaggtcggccccctcgttccttgatgctctctgtccattgtctctacaaatacaaagagagtctctgaacaggacaaagcacatttcctccttccttgggcctggcatcagcgacgatgccacctgtgtgggggaggactcagtgggtagtgtcctggcttcccttcagccccacagagcttccctcaaaccttgctgacagctgggcgctctcagtaaactgaggcaagcctgggcctagaccagtgtgtgggggcgtgtgctgtgggcagggaggatgagagagctggcctcaggatgggggtggaaacaccctgcggtgcctctacagggaaaaccaggtccttcaagtctgtgtgacctcagatcccaaataagtcaatgccggcctcccctccccgtccctcagagcagggcctaggagttggggaggggcagctttgcacaccccttgccctgggatcctggggtgcaagagtaggacgaggacagtcggctcagaggggacagagatcttgctagtttgctctgtgcccctttagcccacactcatgtccctgcatacactggaccctcctattgcctggaagttgtcctgcctcctgccgctgcccctacccgctaagagatccagatccccaaataaagccacactggaccccaggatcccaggcttggagacagtgcttttggggaactccaaggtcccccagctctcttgctacttcaggaacagtttggaggggggcccagtagaagtgaccccctccctgtcacctactcaacatcccagatagggctcagaaagttgctccaaaactcctgggaagagaccccacccctggagttccttcctgctcctcctcctctgttctcgctcccccaggactatggaggcttcagcccgttctcactcggcagggtggttggtggggcagggtgacgactctcggtgtttcctgacaacaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgtaagtatggcctgggcaggtgggggccgcgggcccccactgccccacctgggaccacgggcatggaccaagagctcctgcagcaggagaccctgccacaggacgtggggaaccagaaagcttgggaggttgcagtcctggggagatacacatgcttgggctgaggcggaggctggctcttggcctctagggatctagggagccaggcgctgtcaggggcctgtggagggctctcccagatgctctaggctactgggcagggccttcctctgaaggtttgtgtgcgtgtgtgtgtgtgtgtgtgtgtgtacacatgaggggttgcagtttctaccatggctgctggctcatgataagagccttttgaacccaagaccccaggaaggcaggctcacaaccttctttcttaggcatcaaaggctctagaacagtggtttgcatcatgagaagccctaggaatatttttaaaatgcacattcccaggctctgcccacagggactctagggcagggcccaggaatctttattttagaaagctccctgggtgattctgacaggctgcagctgggggaggaaaccactgctcttggcggacacctacccggggccaggaagcccaggctctgcctacagggccaccttagacactcagacgttgtctctggaaggtgttcaggtcatctgcactctcgtgggaaggagaggccgacatactcttcggtaaccttttcctgaggcacaggagaaagcatggagcacagagtgggccccagaggaaggaaggctcaggaaggggtgcgacagagcatcagggccagggactgccccatcacagtgtctgggcctgctgaggccggggaccctcacatctgtctcagggcccagcgcctccggtccacagcagcccctgtccagccacgtgtgtgagcccaggtcctcctgcatagacacgaggaaagagagatgagatgtcagaaaggactccctggagatgagcgcacacaaggacagttatgaaatctcctccacggagttccttgtgagcattttaaatgtcttcttaaaaaagaattcagttaattcaaaatgacctttagaaaaagaaagtaaaataaatgacctttaaaaccctcataattgacatgaagtttactgacttaactgaattaacatgaaggcagcatgaagtagccgactgcacgtttgcttccatggttgaagctggagtcaggccatctgattcggtttatttcccgtcttgccggcccaaggatgcacattcattttgccccagactgcacatgtccacacctcctggctgtaaagcatccgggagtgttcactcgacccagtttgctttagtcaatccccaagtgctgaacctttgggctccttccaatttcttgctattataaatatcatggctatgaatatctctgtacaaattactttcttagtattttactgggaggcattccccaagtggaactactaggttaaagggcatgaacaattttatagttcttgtcacatattactagatggttctccagaaatattgagcccgtttactgtgacaccaattatgtatagctgtccccacagccctccagtataaaggttcatcatttttatttatttatagctgttttatttactttcttttttctcattttgcgattttggtcaggagtggtgtggcgagttgttttaatgccgttgtttcaatgattggtgacattggacattctctgaaggactttgagaacctcataggcgtcatttgtcccacagggatatggcaggatcggttctgagtctaagagctggatcaggactggaaaatggatagctctgagttttcagacttactcagttctcagtctcccaccaataggccagaatgtacgtcagggccatagtttccaaagctctgaggctgaacgatgaatatggttttaaaacagcatcacttgccccagggagaagactgagatgaaggggagaaggagaacccgtggccccatgcttgtccccaccttgatggactgtgcctgagctccactggacaggctgcacagcctcttaccccagatgtgaccttctgggtacacagattaccatgttatgcttgtggctgtggccatagggataaaccaaatttggggcttgtagtacacttgcctgttgatcctaatgagcatccaggagctgcaccaagagtttacccagtacctgtaaaaccagggctctgatggtggctagagaggcctggctgggtaagatcagtaacatttgctggggtctgggccctcatgtcttggctgaggtctaagcatggggagttgtggaaaaggagactgttagggaactttgacgtaagtggggtcgaagactgtggccttcagataatgacaggggcctcctcagtgataccaggaactcaaggcagagacagtgagggtcaggggcatgaaacccagtgatagaaactaggtgccatggctgttgcagacagggccacagggcctcctgggatctcagagcaaagaggccagatgatgaggacagtaagtcagggcagacatggctggtggggcaggaggaactagcataggatttgaagtcagcaatttaaatcgtggtatcaaaggactccgcaaacttgggaacaaataagcagttatggatactcaaagatattgttggtaggagcagaagagtgatttgtgcaaccaaaggaggtcttggagtcccaggggcctctccatgttgaagcaggatgctaggggatgagaggacacagggccaatgtataatataggtagcaaggcccagcctcttggaggagaattggtggaagctggctgggggatcatcactccagactacacctggacttgggaaggaccctgtctacagaggccaagccaggatcatgaccatcaggctaaggaggaagtgtgcatgttgctggggtagcaggtgtcttgggcccactaaggtcctccaggctttgggaaggaagcagactccctttccctctcattcctggcctgctccccatggggccagggcattggtggtgctggagcgggtggtaatggacagaggagacatggtgtgtgccccaggttcaacaatgggagtgacacagagttaagaagtggtttcgtgtgagtcttagattcaggtagacctataccttactgtgtgacctcagttcttgagcctcactttcttttctctaaaatggggatagtcgtacctgccttatagggcagtcaagaagattgaatgagaaaataatacatgacagcactcagcaagaatagttgttaacaaatgtcagtttctttccatttgcctcttttagtacctagagcagagttgagtgtatctgtgggcccaaataggcctccactctagacgaggtggagggtaaaggaaggggcagcatgccctctggtaagcctaggagcagagctggaagagcagctctgcttcagggtttatctgacccaagggtaatgatgaatttggtgacgtggaatagttaaagtctggcaagtttctgagcctcgatttccttatctgaaaaataagttgtgtgtggccttgtgacagtgcatggaaagcccctagcaccactcctgcacatagtaggaggtccacacatacatgacagtgtggattctgtggttgcagacactcctcttgccctcagagtcatatcgcggtgaagcgtttctctctgtgagctcagagtccagcctgggattggtcagacatgaaataggttgtgcatggtggtcagtgcttgggcggtggctaatcatgtcaccccagagttggccgaggaggaaggggcccggggggaggctgccctgaggctgtgggggctccaagggtactgccaggggaagaatgggcactctgcagttctctcctctagcccagggtgttctgagagtgtccagaaccaacaggtctgctcagacgctggacatgaggttccacttggcacacagcatgacagccttttcccctgcaggagcgttaccagaggcaggcaggcagcatggaggtgaagggaattggaagggcctggcatgagtcaggaatgagtgaggatgggggcgaaagcaactccgtgcagtccagagggagctggctctgggttcagcccctgtacagctccacagcctgtgccctgacccggatcccagtcccagccagttactgtgcacaggggactaagtgatgaacctcgttctctggaggcagcagggctgtacagagggtccagacaacctggagagagagaggctgaagctgcctcagacttccctgggcagccaccctgcttggggcaacaccgctcagcagctagaggagttcagggttctgaatcccaatctgtcgcctgcgagctggagacctggggcaagcctagcctgtctgactcctcctgccctcttcagagctcacgtctaggagaggtgtaataactgcgggtgtttgacgacttcagcactggttatggaagcaggttgaagagttgtgacgagacctgcatgaacagcctaccaggcgtgcagcccctgcactttgcaaatgacctctagtccttgtcaccctgggacaaccctggatctttctggacctgcctgaatcctctggataacctttgcagcccattacctcccccaaatgcacacacattcacacacacagccatcaccgtgtacagatggagctccttcctctcagtaagtttctgacctccatcctgcccctcccgctccaggcagctccactcccggctcctgatctgctcccattcctccaccgtctggcctcaccaaatactggtctgtgaatggcctcactccgtaagtctgacgccaatgaggtccagcttctccagctcattcttctggctccccacctcctccagcaagatttaaaaatactgcgcatatgagagccggcacagggcattgttgctccccgtttcctttcttgctgagtcagggtctaggagagcacccacagggagtcctgcagccccaggtttggcccctggctctgctcctcatgaggtgtgtgaactcagccagttgttttaccttttgagacctgcttcctgatctataaactggaaataataatagtaccttccctccaggctgtcgtaaagattaaatgggaccctatatgctgttagcatggtgcctggcacagggtaagcatttaataaatgttagctactgttattattttgtgcctaacaaaatacttagagtgaatgacaggaaaaattctcctcatgtattcacccgacaaatatttattaaactcctgttttcttccaggcactgtactaggcactggggatacagcagggagcaaaacagtgaaaacccctgtcctcaaggagcttctatgctggattccacagccacacactcaagtctttgttgtcagccctcctctcccttagtctgcaccctcccctgagcctctgcctcagcctcctcccgggctcaggattccctgaatttccctctcctcacacatcctgtctctaagctccagatgcgcttttccagtcacttgcaatggggtgacctgcagacgctcaaacctggcacatctgaatagtaactcacaatgcccaaccccttctcaaacctgctattcccactgggttccctgaggagccactgtccagacccctcttcctccaacatgcagctcttctatcgccatcgccaccatgaatagagcacttagtgcaggcaccatgctaaaagcttttatttattaaatcatggaatcccctgacgtccctaaaaaccattccacttgtttgcagataagaaaaccgaggcggaaatcgttaaacagccttaggttacacagttaggcagagcccggacaaagagcccaggctgtctggcctcagttgtgcttttcctgccgctgtgctgtcctgcctcgggtcccatgggcttgcctcagctgtaccactgacctcaggcccctcctgggccgcatctagctctgccctgggctattgaagagcctgctcactggtatctctaattccctctggcttcaccacagaccctgctgccagggctgcctatgatcccctcccttacaggcgggatcacttccccagcaccaccacacccctgcacccctgcaattttccattgtttacaggcagcctggccctgttccagaccaacttccccagtcccatataacctctccaagacccttcttctccctactcattccccacgtgttacagccaggcaggccgtccaccccaatgctttcctaactcccgtggcttcctcaccccgtctacctttactgagctctgtatcctttaatacccagcctcaaaggccgtctctgctgcaaagccctgcctggttccctgtcagactcctctggctctctctgctgtgcccccacgggtcttcacctctggctgggttgacttcataccacctgggattattgtttgttatctgtgtccatctgtgtcctccagtaacccatgatcttcacaggccagtgccctgtgttagtcatctctgggtccccgtgactgacggggctgggtgcagtgcgagcctcagtactgaaatgaacagggccggcctacgaggtcactccgcgatttggggcaggaaagatctgagtttctttctgcactcccgtcgagtcctgctgtagaaaccacaaatggggaatgatcgttgaatcccagaagactgagcaggaagggccgctgcaggtcatctgtgttaattctttatctttgaaatgttggagtgaggcccagaaatgagaaagacctagcccacgatcactccacagggaggagttgtggttggaattcagacccctggcttctagcccagtgtgctttctgctttgctgaaccattccatctttgctttttctctacacaaaccacctactacaataacaacaattgcttatgctgaaaatcagcccagtctcatagctctggaacctctctttgtccccttccagataaccacaggacactttattttacacttttgtcataatgattttacactctcatttttaaatttagtattctttgtattctttcggggggggggggtaattaaccctaaattcttgtagagaaattaagttcttagagtagatttctgggttgcttgttttcttccattgacgtttcacatgacattcctgtccaccgtcacactgcttcagttgttgcagatgtgtattttcctatctaatgggattggtgctcctctcattagccgtcatcagaaatgtcttttattttcctatctaatgggattggcgctcctctcattagccgtcatcggaaatgtctttgcttttcttacctgttttgtttgtttttgttttttgctgttgtttttttttccttccagataatctatacctgggttatctagaggaattaggggcagacgagtagcttatcccagtctgccctaatcatgggcatccacacaggtcagctgaattggccactcttaattcatggctctgaaaatggtaaaaacggccattgattgagagaaacaggcaaaaaagagagtagtgggggcaccaatgccctgactaccccaaactctcactgctgcccactaatctgccatcctgggatgtggggcaggatggccgcaccgtgtgggcatgctctcacgggaaaatggaggtggtgttgctgatcgacactagccagcgaggcaacatggccacactggctttcttatcacagagcccacgttcacaaaccatcttggggctcgccctcctttccttaaatcatcaccacagggaagcataaaaaaatctctgtacattatcaagtttcagaatccccttggaattttgctttgaactaaatgaagtctcatttaggaagaatgactgtctttaaaacagtcttcctatcatatagaaatacattaggaatctccatttcttcaagttctttttataaatctcagttgcattttataatcttctttatatgaatcacaaatcagtctcattggtattattttaaaacttttcatatgtagtcttgtaccactgtaaatgagatctttttcattctcattttgcaaatgataatttttttatagaaatgttcttggctatttttccatctttttatctggcaactttactcaactttctgattctgggggttttcttgttgattcccttacattttctcaggtccagtacagtaatcatgtgcaataatataaaccatgagtcctttctaacatagtagactaataactgttcatcaatgcccccctcaggaactttaaagaaatacaagtagttgggccctcctcggtccccactgaaccataacttcagtctcagccatagggctttggcttgcggggcagggatgggaagtggattccagacccaaaagtctgcaaaggtggagaaagcctggcttctctaaaagcataccagtatagctacagaccagaaacttcattgctttgtaggaactttttaaaattttggtctgtgagcaagggaagtgagtgaaggatttgaagcagcaggtgcaaggatagatttgcattatgaaaaaatcactctcactgccatgtgagaacagactgcaggggggctggagggaaagggggtgcagatcattatgtaaccacagctaactcttaccgcctgttttaagtggtttatatatattaactattaagtccccaggacagcccaaggcatacaggtggttcatggcagagcacatttgaattgttcctaagcactcatcacctcgactctttttcacggagagggtgggagggacttcagacccacttacggagtgcatcctgcgctgccatctgtcttctgggtgtgtgactgggtgagggtgggtctgtactcaccgtgcctttttcataggggtaggtctagcctgagtgttctgtacactgctctcccagggaagtgggagcgggaggtgagaaatgtgtatccttttaacataaattatcagatggggcccatgatgatggagctctagtgatgttgggtgccttggaccttatctaatccaaccccctcatcttatacactgacacactaaggccaaggaaattgggaaggcacttctttatggtcatataggaggctggggacttaggcctaaacttgggattcctgacatccaagacactaatggtgtttttagatcaagtgagaacatgggcctacaacatcagcaaatgtctggtcacctgtaaggagcaagggaagttttatatgagattcatgtccttcaccaaaccgcttcagttgtctgtcagagccaggaggatggggtggaatacagttcagaataggcaggctgagatgcagatatggggagccacagcatgacagagagagctggggtgtgtgcggtgcagggccaggaggctggggccaagcagaggatgacctgagctagaggaacacacagtggcccgaggcccctcccactggggaagagagacctctgaagtccatctgagggccaacccaacttgcctgtctccagggagaccccagaaatcctcagaagtgtaagggctgggacagggccacctggcatgagatgcccagctcagaatcccagggcctcgtcctgctaagctgagcccccatcctcagagctcccacctgtgccttcctcaggatggaggtacaggaaggggccactctgcagcagcggagagggtggtgacagctcagcagacacagagacatggagagcaggtgggctgtgatcggaccaggagtcgggagagagacacagtgatgcaaaggacgcagagggggaaggaggcagaggcgggtactgccccacagccccaccacccctgggcgtgatctcacctgaggaagcctagaaggagtcttcacgcgtcgcctcctccaggccagagctcagcttggagatgcagagggggaagggaccctctcccttccttcccttcctccctcctagagcctaggcagggcagcagtggtgggaccacctgttctcaccctcatctgcggtgggcggcggaggccccatgccacaggcttggtgaggctgagtaaatccttgctgctgtgaccacccacagtgcttctgcttccttctgtataatagctcctcggggagctgccagcaatcaatgagacaatacaagcgagcacttagcacagtgctggccctgtgtgagggctcagtgagtgggagctctaagtactaaatgttgtcccatctccgtggtgctttggacttccagcacagcattcacagacacacgtcccttctcagttcatcctcacacactatgtgcagtaggcaaggaatacgttgtctccaatcaacagatgaggaaactgaggcgagcctggggaaagtggtctctggtcacccagtgagttagcagcagagaggataagaattcagctcccctcagtcttgtgtgttttcacagctgtgtttcttacataaaatacaagaatgctaacacaaaaaacaataaagcgagaattctcaccttatttcagagttgagtaaactataatcatcttcttttgtctcctaacagccctgctttaaagagtcaaagtatcagagaacgtttagtgctaaaaggagccttagagacagtcccactctctttcatgaagcacagagagaggacatcctcacttaaggtcacacagcacattagcaacttagccaggattggaacctggcactggtgttctttcctctatagctgctgcctccataggtcttggaacttttatccccacttcagagtctggaaaactcagctcacagcttgactccaatcccatagcaccaccttttttgggactctgcctcctcagtggtggctctagagtctgatatttagaatcagcagcagcaaaagggaagggccatggagcaaaaaggtggtgtgttgggagtaataaattttcaaagagtttaaattgcatttcagggactgattcctcttgttggagagattggtttgtgaattcagaataggattgtttaatatgcatttcacattttaaataatcatggttttcttagagcagggagaaaaacaggtcaaaaacacaaactcataggcttttctgaaaggttacaaaataaaatgttctttgctggaggatataaaggaaatggctcttgtttgacaaaggagagggctctgctagataaattctgcatttatgaataaatgaaagctctctcccgctcttcctgatcaccttaattccttgttgcctatctgcaaatccaataatgctggtgaaacaaacccctcctggaggctgagcacaggggcctgagcgctcagcctcagaaccactctttctatttataatctcagcctgtgctccccagagagctgggcttagatgccccctgggcaagtgggcaagaggacttgctgggaacagaaccttccccgggtcagagaccctgtactccagccctgggtctccctgcctaggaagcactcagcaaatgcctcagaataggtaaagagcaggtaaagagcagaaccgtagttcagcatcatccttcctgcacttcctctgctcccttccaagataaataaccaggctaagaattgcaggtgtttcttgcagccagttggctattgtcttagtgacacaccatattacactaggcaactgaggatatgtcaactcgtaaggcgttactatatatatgggtttttgtggtttttttttttaccaaatctattttgtaccaatagtgtgtgtttatcgtctgtcttctcttaacattgggggtggggatgttgtctgcactgttcagggatcactaggaggtcttaggggccaaagctggagctaagaggaggttcaaacacctggaagaaggggccacctggaatggaggatgtggcccctagggtggcaaagctgagacactggactgtgtctctcactctaggcatctttgtatgaaaccacatatgtgtcagctggtggggcttttttatagagcattatactcacctaaaatattgtattccatctgataaatccattactttgtcattaaaaattctctataaggctgggtgcgatggctcacacctgtaatcctaatgctgtgggaggctgaggcaggagggttgtttgactgaggagtccaagaccagcctgggagacatagcaatactcaatctctacaaaagattttttaaaattagccaggtgtggtggttcacacctgtagtcccagctactctggaggctgaggcaggaggatcacttgagcccaggagttcaaggctgcagtgagctacaatagcgccacttatactccagcctgggtgatagagtgagacctcgtgtctttttttttttttttttttttttttgagacggagtctcgctctgtcaccgagactggagtgcagtggcacaatcttggctcactacaacctccgcctcccgggttcaagtgattctcctgcctcagcctcccaagtagctgggattacaggtgcccaccaccacgcccagctaatttttgtaattttagtagagacgggtttgccatgttgcccaggctgctcttgaactcctggcctcatgtgatccacccacctcagcctcccaaagtgctggggttacaggcaggagccactgtgccaggccaaccctgtctcataaaaacaaaaattccccataaaggatgcttagtgatccatcctatgaacactgaattatttacttaaaggagtcctaattaatagacattttgtttatcttcccccagccaatttcccctattagcaataaagtttccatcagtatctttgtacataaacttttgacttcgttttcaatttcctttgactagttttctagaataggaattaatgagtcaaagggctaaggcgcccatcatctggttttctctggaggaaggtagttctctgggctctacaatgctcatctgcctgaatctgaatttgaactctatcacttcttatcagtgtgactttcagcagattatatataaccttttagttgcttcatttgtaaaatggggattataatagtacctaccttgaagtgttgctctgaggattaaatgggagaagtgatgtgtaattgttaagttgaataggcataggcatgactcatgagatgtaatcataaagcaaactttatttttgtctcccacagtctctttaaatttattctatagggctgttttcccttctaaaattatattaaatttagggtaagtcccatgacttttctgaccattttcaggtaaccagaggttgtcttgtcagtaattaatgcatcctgtctgctgtaataaaaaaaaaaatcttgaaacgtcagagttacaccatctctttcccagcacggtctgctgtaggccagctgcctgtggggaccttgcacatgacagtcctgaccctttccagggtccaaggtggaggggcaggtaggtaggagaggagatggttgggaaaggtcttcaacgactgtactctgatgagttgctgtcccgttgttctctgggccctttctctcactgggctgtttttgtgggttggtggagaccaccccatcgctggagtctcaccctgcacctcccttgatgagggtgatactttctccccgtagccgatcctatggtttctttctcaggctctgggaaacctggtctccctcagtgtcacctcctcccttggaggagccctcttgtcctggatctaagacagtcacatctggctctcttgctgggtgctacctctgtccacaagagacactcatgtgtgctttgccctgcaaaccagggagcacaggctggtcctgaagcagcagcactcttgctgctctttggatttctccactgtggcaccaagaccattttggccacatatcaactgacttaggggtctcctcaaggccccactgtctggctttgaggtgaaggtgatagcaccctgtacccctcccatttatttgggatcactggaccccaaaggctgtctctgaaattcattctaaacctccaacaaccttttttcaacctctctcccattttgtatgcattagagatgggtgtcagctaatggcatggacccaggttttcgccacctcttttccaagaggtgtatcccacttcactttggaatgtggtatctgttcatttggagccccaagtggatcctagactggaagcatcccatctcatcctcccattgccatatttgtctttatgaaacacacagaggagcacctggcatagagcatgcactcaacaaatgatagctgtgtatgatccaggctcacggactctctagttacattcacctcataaccattcgatctggttttattcctattactttgttttatgccctatgcattttatgtttcctgtagattatgcttttgtgtgtttgtgtgtgtggaaatgatttgctattattttcagcagtgatttggaaaatagacattgcttttaattttactagtggttgacctacattttttttcagacattgtaagcctatttatctcaatcatcaacagtggtgcaatggtctttgtatattctgcagttatttaaatgggaattacagagggctttatctggccacccatagttatgctaccatcttgccatgatgtctacccacagcttcaaaatggcacttgactctgttttagggctggctcatctttgtcctggactttactcatagctgtctagcagtttgccataccactagcctttctcccgcaatcctccattctgctcccaattatttctttctaaaggttacatctgggcagattattcttggcttaaaaccctctagtggtcccccactgggaaccacatccttagaacagagtctataggatatttccaaattataggataattgcaaacgccctagcttgatgttcaggatgacatatgacctggccctgccttaactttctaggcccatttcctgccacaccgaaccattcacctattggttgaatgctgccatgctggtttgcaccttggttttcaagtgcattgggcatgtactctcatgtctgcgtaactttgctcatgtcatcctctgtctgtatggccctttggtaaaagaccctagcacagtgcccggtcaattgtagaatctcagtaactgttacgtttccctcttcctttgttatcagcttatcaatatcctattcatctttcagggcccaacacaactatcatccttttccactcttgggaaggcttgtcctaaccttatctccccccttctagggacttccattgactgcctcttttctgtgtccccttgcccccagcacattgtacacttgtgttgtaacaccaacaccttaatgtagggtacagtcattatttcttcctatctcccttgccagaccgaaagctccctgagagcagccatgcacctgacccccactaaggccactgcagccctgcatcagcctttgaggggctagttgatgtttgattgatttgaattgccttcctcagactgcaaggtcacaatgccaagccaacagacagggcccaatttgaatggatatcatttatcattcatatccctttgcttccaaaattgactagagatggcccacactcaataaaaatgtcaccttaagtatagcacatataagactccatataggtggctaagtcccaaaatgctaaccttcttccctgggtgaactgattctgcttgggagagggggtggccctggggtcctcaagctcaggtggcagatgtgagggtctctgttgggctgcttcactccccatgcattccttcactccccctcacaaacatttcatcaccacgtttgaaaatgcctaaaatgcaaacaggatgatttaaattcatagcaaatatcttacccttgcaggatttgggcaggtggtgagggaggcatgttgggattgctgtgtggtggtgtttcagtccagataaccttgttcctggggctaaatttgaaaagcttatgcccttcttcgagggtcatggttatagtgcagttgtaaaaatataacttttgatcatggcctagtataatatacatcatatgactttctggagtagctttttgatggaagccaaggacgtaaacttaaaatgtcaaccacggaagtcatttgagtggaaaaagccatcatgcattctgagtagaatgttaacactcatgcactccatagaactcgaagaagcacacacgtcattctcctgcacgcgtaccatccaacaaatgttcttgtgcagtcctgttcagactgcagggccatctctcacacacatacacacattgctgcgtacactgaaacagtcctgctgcccccaacttcccatgcacacacacactcaaggcatacactggcacacagtcccttgtgtgccagtgtatgggactcacacaacccatgtgcatacacacatgtacacacatacacactcatattcatgcgtacactggcgctcagtcccactggctcccccacatgtacacacactcacactcatgcatacactggcgctcagtcccatggttcccccacatcccatgtacctatgtaacttctgcagaaagagacttggaaagccatcttacttctgcacctcactctgcctccagattttgctcccttaggacagagcctaaactgtctatttaatagattcaattactccaggctcctgagaccttccaactaaattctgattgctttaaggtgtcaggtaatttgggaataaagggaggaaaacagcttcaaattcttgaagggaaagtcttttagactctagctgtctctgacatggtagctactaattgcaactcaggaaggggtggcctggagggcgcggcctccaggggtcaaagcttctgatctctaggcaaggttctgccctgaaggacagaggcctctggggcaatgctttgctgctctgctgcggtctccagggtagggaccaatctctgctgcccttcctggaaggccagcagagtccaggccaagcatcccagcaggcaacaaaacagccctgctttctgccttctgcaccccactcccaggtgttttattttgtctgctctctgtccccagtgacagtgacagctcttggaggttgataaataatcagaggtcatagtgttcagagagcatcaatgttgtgcccgacagagatggatctgacctgtcctgagctccagaagcctggagagagaggccatgtgtgtgtgcatgcatgtgtgtaggtgtgtgtaggtgtgcgtgtgtgtgtgcatgtgtgtaggggtgtgtgtgtgtgcactacatgaactgtgattggccaaaaggaggctgagggtaagtgctgtagacccagaccttttgtgtgtgaatgctagcttcatcattgaccagctgtgtgactttgggcaagatccttgccttctctgtgactcagttcctctgctgtgaaatgggtatgctaatggtgcctaccttctagggtggctatgaggattaaacgaattataatatgtacgtagcacctaacacagctcctgacgcccagcaaataatccaaatattgtgggttattgtgttttataattaatgggcaagagaaggcaaggctgaagggctgggagagccctggggtgggggtctggctgtagccccagggcagcaggatgagccccctccctcagcccccttggctgttctcacactctctgcggggcagtcctgaccgcctatttatcatcagaagatccccgcacaacactcttctggcgcggttggcgcggcagaatccaggatgcacacgaggacgcccacggggcgtgtggggaccgtgcccctccgcagacctctcccggatcacctgctccacacgcaggccttggtgacccctcagcctgctgctccttgcttccgcccgccctgctgtgggtcccgcaccttctcagtgtgccatgccttgcattcaagctggtcctagtcacagccaggacctcctcagcgcgcagagactttcagatgatctttgtaggggtttttgcctccggtcaactgcgccccttaggaagggctttggaggacacagatcacagaacagtttcagctccaccacttcctagctttacggccttgggcatctcagcattcctattctctgggttatagggatatgatgtttgtctctcaaggctactgtggagattacatactagaaatttgcaagggctgggaatgcaatagaccgtaaatgttccccttcccttgacgctatagcttagatgggagggagccactgctgaggaaacacctccttaacccaaagacagagggttccccaggcgggggtgtgggaactcggaggtgggggtgagggaaggccaacctccacgcttcggcccggaggttcccccgcctcttcctgcacgactggattccttctccatccgcgcctccggcccggtccctgccccgccaaatccgcgcatcggtttcccatcccatagcgcagataggtagggcaggtacacagggaggtgttcgaatgatccccgtttcacagaagacgaaactgaggctgggaggcctggggactggcccggctgcagcgccgccgttagccgaaggtgggagccggcgcggtcacgcgcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggggatacgcggccggggcgcagggcaccgctgccctccccacctatcccagcactggggcgcgggttggagtcgctggtccttcctccctcaactttgagggcccctgcggactgctcccgcctgccccgctccacccccttatctgccagggttgctggaaggggcctgtgtgggccttgttgggtcaggcagcaccatgtggccgcctggggaaggagtccacactgctctgagccccctcctaggcccagaaccccagtcacacgcctgtgcagggtgcgcgcacacgctcatacatctgcacgcatgcacccacaggacgtccctgccttgggccaaagacgctcctgctggtcggttcacactctcaaagcatggatccgtgaagacagttattctgaaccaagagcacaccagtggtcatgtggacatgcacccgtatattctacacacaagaattcttgggctcacaaagacacatgcctgcatatctgtgcacgtccacctcctgtatctggagaataactgacacctgcttctcactcacaagtgctactcagtctctttcagacactgaataatctacttgctagcaggtctatacctagacacacaccagctcacagtacatagaactgccctcacatgcagaaaggcactcaagaatccaggcacactcagggaagccccccaccctctgctgccaggcactgtggtctatctcaaggatggctgggctttcccatttgcctgggaagggggcggggaggtggtctctggggggcccctcacaggtgcaggtctttccctatccactctactccattctattaccagggaagggagctcatcgccatggcagcgccagattcttggccacccattggctccttggttgccatgggctacggggctgtctctgtggaaaatgggtgctggactcctaaggcccactgtgttattgtcgacccaggtgcacgtgctagcggacggcaggatgagatcctcaggtcccgccttgtaacacagcttgctctctgttagagcctcataccagtcactgatagaaaatagttctgacagggctcttctctgagtctgtccagacagcgtcccaaatggaaaccagctgaaaccgcccaaggcttcttaaaagcagatccttctgaaaacaggcacgtggcctgggaactcagggtttctcttgagaattgttacctctaatctcagctcctgtgggggattcaggggtttccaggttattttgtgtctctccccacaaccaccagcaacaccctcacacgtgcgcacatacaggtcacccacaggctctcctgcagacacatgtagtcacacttcagtctcacatggattagggagctgtttccatcatggaaccagggactggggctgtgctgactgagaagagctgctgcgccagacagacgtccaggctggggcacaggtagtttctggaggatcctggcctttcttggcacatgtgggctgaggaccttctagaagacagtgcagccccatggagcgtcatcaaccttttctagccacgcggcagaggtgcctgggcggtgcttgtgggctgagtggactccggtgctgtggaagtacctgtgtgcgggggtccagatggcagggtggtggccatggaccgaggagggtgggaggggcagcacttacggctgtggagattatgacgtggttaggatctggcaaactggaggttgggccaggccaagacatggttctagaaagcttctcccagggagccagggactaaagccacttgtagagagtgtgcaggggtcttagagaaaatatgcctcaaacggaatggcttaagcctgttcctgggaaaggtggcccaggaaggtagaactgtctctaggaaatgatcctgttctagcaagtgcctagggccctggcatcctgcaaggagtgatttggcacttgcctcagcccaggtccaactactatctcccctccaccgccacccctccaattcctttcctgggccgcagactcagccctgaagcatagaatcctgcctccctggaagcctggccccgaggagcgtctcaacacccttatagccctgcactgcttgctttccccatgcctgtcactccacctcctcgttctgttgtagagaggggggtgtgtagctggaggcaggctatgtcagcagttgccaggatcccccctgccctgctggggtctttctgggcacgcactgagtgtggcaaagtactggaactggggtgcagacttccaaaatgggagacttgggctgagaggaggagattcaaattgcctcttgcattaactgggctgctgattgcagtcaaagccacatgctgtctgatcacagagaaaactggggcagaagacagacaaagcattttacttgcagatgggagtgggggcagggggtggcatgcacgtgctttgactggtgtgaggtttccctaatgtcacagcatgtcagagctggaatgtggcatttggtttgggagagaggggttggctggcttcttgctggttctgctggtgagggttttactccctctctaatggttacaccttgcattccctgggcccagcttattttctttagagaaatgatagttggtgataatcttcttatgggtaattttggctcagtgtataatgatcatggattaatctcacattctgagttcaaagggagccattgagtttataaagtttaacaattggaatgtttttgtcttttgtttctgttagtactaataatttctaattctgccagtttctctttacctgtgttcttgaggaatattaaatgcccttagtacatttacagccttttataagttgtaagtggagcagtgagagtcaggaaggactgcggcccacggcgtattggaggactatgctgggtgggattggggtggccccgtcctcagtgcccttgtcctcatggtcctgaggccattgcctggtgtttctctcacttggtcatgaactaattgagatcagggaacttatctggttcctggtcatgtccccagcacagacaagacgtccacttctttgaatcaaagtggcatcccgggatagcctctagggcttccttggctttcccagccccacacctgggttctaagcacacctgagggatacagtactctcacatcaccatgggacctcctggagcactgcttgaaaagcattctgtaggtcacagaaagagaatctcagactggaagagcctttacaggtcatctagttctccgtgtggatgctccctgtagcatccctgccacacggcctcccatcagatggctgtgatttctttcaagttcttccttaggttgaacctaagcaagtctccgggttccccctcctcctggcccttgttaggatcctcccaccacttcctttgttttgtagggagtagtgggactcctgacgccttccgttctgctgctaggttcggcctccgaggtgccctgggcacttggacccaccactttacttctggcagccttataacgactccctgattttcttgttgttctttagagatcaccagctgtggctcgtggtcgcatttgcatggctgagcattagaatcacccatggcacttgcttttacaaagagagagaggagtgggttgattctgggggatgttccccagcagttctgaatgaccaagtcagggcttagtcccgccagcagtttgaatgcacctgatacatttgggaactgctggctggaatggggacggcacatcctgggaggctggaactcctgtgagcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttattcaccagggagagttgttgcgcacttgtcgttagctaggaacacccacctggtacaagcttgtcactgctaggtaatcgtggtcccatctcgtccccttgcagctcttctagaacactgctttaccaggaatcgtgcccactctcagagcctccccattttagtagatttagtgtagaccctcctagctgggtcttgctcagccaggcacaggtggcttctccccggtggccgccccccagctgtgcatgctcctttccttctgtgtgcttgcacatgcccgctggtgggtgaggtggtaggtggctctctaggtactttggggatgtctgaggtttctggagcctcttcagtagcctagcccttgtgttcatccatatttctctgaaggccagtggttaagtcctttctccctgttatcttacctagtaatcagggtcaccgaagcctgtggctctttatcattctcccccatcaggaaatggaggtggaggcagaggaggagaaaggaatgttttcatggaaagcagcctcctgcctctggcataactgtgcatagtccatggcaagtgggatggtggcctctggtagggaaatgtgccccctgcatggatgagagcattaaaaggcactgggcagtgaggccactatggctggaaatacctttagtcagttgagcagctgctgtgacccagcatttccggaggtggcattgctgatgtgagtcttacctctcagctggatgtccccttttctaaatgactctagatgtgagcgtcagcaccatggaagtcatcttctttgtcttgctcagccaagcccagggctggggatggcccaggtgactgcccagtccctgccctctgaaagtgtgagtggcttgcgacaacctagaaaactgtggaatggcccctcctgctggcacaaagggaagccagcactgtcttgtggaggttgcacaggggccaggccactggcttatgacagtggggtttatagctgccctgtgcccaggcacagagcttggcaagcggagggagcacagttggattccagaccctgttgctcctgtcagccaggggccactgtacagagcttagactgcatttttcacgtgtgtcctgaaagttgtgatgtgtatgcactgtgcgtgtggctgaccacgggggacactggtgttcgggtctgaccctttcaagtccgtctgtgggcaaatgctttgactttgcttattcagtcaggctgttggcttgagctgtagagatgggagggttgtagcctctcaggcctggcagggccctcaggcattttgcgctctggtcctgaaccctttcttcagaagtcttcactgcagtcctccagcctgggtgtgtgccttccacaatgggatgcccagcctctcagccagctggaatatttagggacctggttgcatcctgtggtcctggcaatgccctcagggagccccaaatgcagctgtgccctcttaggcagatgggctgtttcaagaagaccaaggcctagaagtatggctcttgagcggtgttttctcctgtgctctggcagctgagggtttggtgaatgaggctgttgtgcacacagccccagatcacagctggggctcctctgacatgcagagcagctcgtgggtacaaggaaagaccttcccagatgtcaagtaggcaggacacctgctagttaaaaaacatgcatagtcctcatagatcgtggccaaggtggtgggcagtctgtgttatgggggcttccttctaccctctgactggctcccttggaggtgcaagtagttgaaggctcatgtaggtggtcaatgattgttccagctagaaagggctagccatcaggaggaggtgaaagtggcttcactttgtcctcagggtgatgtgacctcctgtttcccctttgcacgcacactgcgctcaccttcacacgagcacacccacttcttcacaggtgtctgcatgcacatgtgcacacacatgagatattcacacacttccttatggcctcacacaaacctaatgcactcgggcacgcctgtgcaggaacctggacacagtctggttcaggggcagcttcagaataactgggccagggccgcctggggcttccccagagctcagatcctcaggctccaacctcacctcatgcagctgtccacaccttggcctttatagcatttgggcctaggtctcatgcatgtgtctctggctagcaaaaagctaagtgatttgagttaccagttccctacttgtgccctgccttcctcagaggcatggccagtgcgggtgagatgaggctccctgtcccaagactggtggggctcaagaatttgatgtccccagggctgcctgtgccatgtctgcagcccgggaaggacctggtagctggttgctgggctgtacattgatgtgttgtgtccaccctgcagacacctctgtgtggcccaaaccctgtaggctgagggactggttggtctcttagcttcattctctcaaatgagaaggaggaccctctgccctctttaagtggggaaggggagtagacaaagtcaggactctactctgcccacctggaaagctaggagtttgctttcaacggatggggaaagggtctgccccagaggacgcagcctcctctagaatggtgggaaggaaggaaaaggctggggctggtgagatcccagtagggagctggagggagcagccccctgggtttgtttgaagcctggcctcgggcctggcttgttgctgggatgcctctggatagttctcttggatctcagtcaggcccggccctgctcagggatctgaggggagggtctcatccggtatttactggggagtccctggggaaacaggggtcctagcaggcttccaaagtggcagctcgagcccttttggttcaagctggtttcaagatggcaggctccacccttcctccttctaccatgtgggctcactgagtcccagcagccgtgatgggatgggtttaacgggcccagatatgctgggggtgggctctgggctgtatatcctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggctgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaaggtataccttgcctgctgccccacatcccgtcactgcttcggggagcccgtcacttcctgcccacctaggcaggtgcggactggtcctgacgggggatgcccaggctgtgtatggcttccagcccaggcagacagctgagtagggagggcagagggaaggtggacctgtagccttgggcgcctgtgtatgctccagctgacacctcctgaatcaggcactgaggccagaagcctaaaccttttatgaggccaggagttcagaagtccaagttttgatctggagcatttcactgagtgcaggaggtagcttctaagagtagatgacctgctccccaccagtattctacattctgagaggaatccgtctcactgtcctgccccatatcaaccagtgtctcagtacaaacacctttttccttccctctctgcaccgtgtctgcctggcttctgacttgcagatccctctctctggctcacaactccttaagagctgtagtgacctggagcctgcagctcccatccttaaatgttccaggtctcggcagagcccagttgggagaaattctctgcagctcatcctggagagagcacatctccagagatggctgcagcacatctctgttctcaggaccctccttcctgcttgggttaggtgaagagtaggccaggccagactgaggggttgggggtctctgagcttgaaaggaggactcagactcagtctccactgccccctgctggtgctagtaatccaggctgctacttcatcaaatagtaattctaaaaaggttgcaggcatctggcttttgcggttaggaagaaccttagcagtcgtggtgctcccctccttctgtggcttcgttatgacctggagcctccagatacatcgaactactggtagttgcctcacctcagggctgagcttcttcatctaactgctggcccataccctgcctcgcagtattttaggttcttctctgggttccactgacccatagctccctgagccctttgtctgcacattggagggcagcaggtgggtctcacttgcctggtgcccagtttgtggctgggcacaccatacaggctcggtcccctgtgtgcatgtgtaccctccgaggaagcctactccgtttcttctaacaaaggctggctgtacatctgccagtggctaagtacagtgctagaggctttacctgcattatcttgtttcatcctcacaggaactcattatcctcacatcatcagtaaggatgtgggctctgaggggctcagtgacctgctcatagtactctgctagtgagcagcagggctagaatttgaacccagacctaacagacgccaaatggtctctcctccatattatgttgcctccctgatgaaaagctccttcatgctaattcccctgtgtgtgtgtcagttcagcaccctggccatacctggtatgcctgtactctacttgagaggccttcagaaaaggggaccagggacctcagcccagctgtctcacagaggcagccccagctgctcctcacagagctggccccagccccaccctttgctggcagccagctcctccacttcctttgtgagtgccatcccaagggtggtagtggtaccctgccaggaaggtggccaatgttctgggtcatatggcgtgtggcctgtggctgtgtggcatcacagccccagctctgccaagcctggcacctgggcgagtgaggctgcatacagaataggggcctgcacccaggattgtgggccctgccaatttgtgccagaggccaacatcgtgagaggtcattgacgtgcagtcgttttggaaggtatttcttggcagctgtgttccagatgatgtcaggacatcagaaagactgtggtacaactagcgcctctggcgtaagtgcaggactgaagtcaaaagacagtttctgtgctaggtggctcacacctgtaatcccaacactttgggaggccaaggcaggaggattgcttgagggcggaagttcaggactagcctgggtaacatagtgagaccccatctttaaaaaaagtgagcagggtgtggtgacacctgcctgtagtcccagctacgtaggaggatcacttgagcccaggagttcaagactgcagtgagctatgatcgtgccactgcaatccagcaagaaaaaaaaaagaaaaagatagtttctggtcgtgccactaccagttagttacctgctcgcttgtgactggggcaagccatttaccctctctggatctgtttcctccattataaaatggggaaacttctctgtcttagggctttggaactcgaaggagccacggtgtgttccaaggtccaaaatcagggaattgctattccctgacattccagagtgggctgggcctccacgacctttttcacagaggacatttgaacatgtgacatttgatttctgggaggtgcctactgcttctctaggggcccagtctttgtccaggttcaaatggtggacaaagctctggggaggctgctgcacacacgcgtggcctacccaggaactggtgtttccaggccactcccaccccgcctacagcattagttgcctccctgtctgccctctactggctacaggcgttaaattcaggggatcattccaagaggaaaaggagggagtctgatacacatcagacctcacagtttatcctggtttttgacctgctggctatactcattcatgttacacattcattcagttcttaaatatttattgaggtttgtgtcaggctctggattagaggctgtaggtcccaagtgagcacaaatgggtgtggtccctgctttcacggaccttacagtctaggtggagagacaatgttaaacagatggtcacggggttgctttgtggaaggaagccaaattctgtgagtagatgacaacacctgctctgacgagggaggcaggcacagcgtccctcgggaggtgacatccaagctgaaatctgcaggatgagtgggagttgatcactgaggggggcgagggggagggcagtgcaggcagcaggagcaagggccctgtggcaagagggagtgcagtgcatgtgaggcaacagaccagcctggtgtggctgcaactcttggtgccccagaggtggggagtatgtgtttattttagacctaggggaagggagagaatgttggtcttcagcttaagagcaatcagaaaccattcaaggattttgagcagattggggttctgcagtatggagaatttggaggccaccagctgggacccttctgagacctcactgttggtgcctgtagcttcttgtgtcccagagttgttgttctgagcactcctacaccccagcctcccatgggctcatccccgcagagccccctcgtaggctccctggagtgcttgccctggttgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggtcagctcacattctctacagccctccccagcaggcctggcctccactgtagggctggggaaggtttgtcctcctgacttggaggggagggataggatgaacagcctcagggaagacacagactgccactctgggcaccccctcaggtggctcacaggcctcatctagcttgggaggtgcctgggctgcctctgggtgtgggcatgcctaccacactgccaggaagtgaagtcctgctcagctgtggcccagaaccaccgtcccccacctcagctaccttggcctgagcaccctttatcatgacccctcaaggaggatctcacccagcctggactaggacactcactgcactgggggctgactgcttcccaggcagcttgccccatccttatgcagccctcgccgtcagctcttcgtataatgtggacttcccttgactccatattctagtccaggttccaccctctggaccacagaccagcctgttccctctgctcctctttctccagaaaagacccctaaagattaaggacagtgattggcggtacctgccccaggtcctgtctcttggctacacaccccgtttcctcaacttttgttcacggacagtggtttccaggccactgcgtcacggttggacagtgatgtgtcacaggccatgggcttctggagctggccgagcactctgggcatagctcagtaggcgggcagggtggctgccacctgtgtgggtcaggccttgcttctgttgctgaagctctgtggtaacgggcaggaaagctgacgtaggatgggagatgctccatttgggaaggcgagtgtatgccaattgcaatctttctcaaggggcccacgtttttaatgatgtatgtgagttactgcacgtgtgtatgttgtgtctgtttgtggaagaaaacaccagcattgatggcttgtagctggtcgtgtccatgaatgattgctggccttgcctatggtctggatcagtccttgttctccatcttgtttttccactgtgcagttggttttgtagatggctgccgtctgctttaaggacgtgaggtgttgtaaaccaaccctcggcaattaatttgggggaagagcagaagaaatgaagcccacatcccttactagcttaccagttgttaacaggctggtgcaatcattagttttataaaaatcacttttgcaaataaagttttgcagagggtttccccactcttccctcatccccttcatggacgtctgagaatccaggccctcctctcctcctcctggatgtaactcaggcgtgtccgtggcctgcaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggtgagccccatggggacccagtgatacccccaaaactcagtcccaggttctcagatgcacctttctctgggagcatggccttcctgtgtccaaacccctccctggcaatggtgggtgagggtggggcacacttcggagacaaatgagaaactcttaggcagggcccctgctaaggccccagggaggccctgatttgggggcagatttccttttccttttgctccttagaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgcatccacagcagtttttggaggactgctcatccgttagaggtggactgcatgtgaagagatggactcgtatgcctttaggagcttctctgctggcctcttatgtccctctaccttgcctcctaacctcttcagctaggccagcagggtgatgtatggggggagatgcagttggacaggatgacctctgaggacctcccgtatctcccatctccacctctaggaactgttgagggcagggctgggaagatagcttctgaccccaggcccaggctggccaggccccaatcccaggatccttccctctctcccaccgccacgttaggaggcagatttggatcccagaccaccaatttgggctgcttagggtccttggggctcaggcacctattctgcatccccataggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtaaggttggtctgggcatgttatcatctaggctttacagccctttgaaatcctaggggctgaaatgtgactggaagtctcatatctaccactgacctctcagttcctcaaagaaactgccttcgtgtctggtctgtgcacatctttgtgttttccagtgcatttgtgtgtgtgcacatatgtgcgtttgggagctgacgcaacggagagagtctgtgtgagtggctctcatgactgtgtgcagaccagaggctgagtctggaatatgacctcattccactccccaaggtgttcctcctggcgggaaggaagagaaagaagagtaaaacttccaattacctcatctctgtggacccaacagacttgtctcgaggaggggacagctatatcgggaaactgcggtactagcattcccccaggaagcaggcgggagtgggagggaggggcaggggcaagctgtctgtagagggcctgaatcttcctgaaggagatctaggccagggatggatactctcccaggatcctctctgataatcacatccaactggaggcctatgtctatgccagcctagagccagacttggagatgggaatcacacacccgaccccaagctgttcccaggaggtgggtgcaggcccaccaagagtgatggatccaaccccagggtgtcactgataacgcaggccaccatggaagagttgccttggctccatggtcaatgccaagggacagggctgagagtgagctcttgagggaagagacacacagcaatcttgggggtggggggcagtggtgaaggggcaggaaggctctgagcctaggcctccaggtgggggcagtggggaggtagggtttgctgaggaactgagtaccagatttggggagcataaataaagatgagaggtcaggagctaaagctggagatggggctggactgagacttaggctggctgcgacagaggagatctcatcctctctccacgggtgctaagcctcttccactgtcttatcagatgccattctgtttgctcacctcccatgaggagaactcccatgttcccccagataaatcttctgaagaatcctgattgacctccctgaattgctctcactgaactgaaatgcactttgagtcaactcagagcaagtccaggccttctgcccacgaagtgtcttcaaagatgtggattcagtgagcagtatgcctccctgggcctgctcctgttccagcccagaatgttttgcaggctcctcataggacagacgatgagctgttccctgctctggggcagagggtgcatgactctatactgattgtgcctttatttcaggtccaacttgatgggcaccaagttcactgtttatgacaatggagtcaaccctcagaaggcctcatcctccactttggaaagtggaaccttacgtcaggagctggcagctgtgtgctacgtgagtcctaggttcgggggtctctgatttccaaggtagatatgaaatccaggacttgatgcctgatctaggggctatcccatccatcttagtgggtagacaaggctgtgtggagaggggctgtcctctgtggagtgttcctggcctaggacaggggctctggctctctcctcctgacttcagagctcacaccacagccggccatctgcttggggagctcagaaaaccaggcctggctctctgcagtccaggccaggagtctcttagacagaaggagacggtcgccctgggttcttgtctgtgcatttcccagatcatccctctggcatgccaggttctacatggattacacggcactttgtcatctcactgaacgttcaacctaagaggtagatcctattttctttatagatgaggaaactgaagctcagctgcagatgtcacacagctcaaaaacgaccaaactggaatataaatataggggattactctacccctttgaacctttttcttcatttttaaaatcaggggtgggtatctcatcaacctgggcatgggcacttcttggaggccatcagtaagtaatccacagctactttgtatgatcctgtggtgccacctgctgaccagttttggggaggcagcctgagtcttcaagttcttactgagctccaactaagcatattgtttgaggcactaaggatatagtaatgaacagacataaatgtatacctttatgggacttaaagccctagcagggcagacaagctatgaaacagatctatcagtgaagtaagtatgttctttataaacactaagaagaaaaagtaggggaggggagataagaaatgtcaaggtatgtgtgagaatttcagaatggcagggagggcgtcactgaggtagctcttgagtaaagaccagaaggaagtgaaaaacagcagtgtacgtgtctaggggacacagtgaggacaaaagtcctgaatgcctggcatgaagaaggaatggagtggataccaggcagtaaatggtgaggagaggaaggtcatggggccacgtgcaggtgaagtcacatctccagctttaacttggagtgagctggagagccactggagagttctgagcagaggagaaagatcatctgacttaatgtgcctgagcactggctgctgtgttgagaacagatggtgggaaggaggaataggagggccaacaacagaaaccaggagtccaggcaaaggctgttagaatgatcttggtgagagaagctagtggtgaaaagtggtggaagtctgggtataattggaaggtggagctgacagaaactgctgatggattagacgtaggatgtagaagagaggactcgagtgtgaccaagtagtttgccggagcgagtggaagaacagcattgccgtgagcagaagcaaggatgacgcataagaggagctagttctggcagggtagagacccaggggctcagttctggccgtgttaggtttagagggatgtgtgttagacttcggagtggagatggtgggaactagctcttcctctttattcccgtcccccccaccttctccagtaggtaaatagacgcctcaggtggccagtgttgcgttctctttcccaggagacaaacgtcttaggcttcaaggggcctcggaagatgagcgtgattgtcccaggcatgaacatggttcatgagagagtctctatccgcccccgcaacgtgagtgtctaccccttcctcccctctttccccatcatcctagtctctgcatgagcttctaagggcagaactccagctgatgtgtgtatgtggaggggtaccatgtgagaaagccctggaggtctagggaaatccaaggacccccattcccgggatagatccctttctggggtggtcatggtgccaaaggcctgggcctggctcaggtgaggctgccctcccaggagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccgtgagtgtttctgtccctactcattatggtccgtaggatacccaaggcccttagcgtagggttcagcccacctagccctgcctacactggctagagtttaagaatgtgagctatacagctaaggttagatgtatggaactttctaaccctaatgactgggaggtcctggaagaaccttctttgcagccctggtcctagattctgtgtattcaacggagtctcaggcacgggaacaccctttaaaaggacttttcctcttttctgtcccctggtgttcacatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctgga

SEQ ID NO: 576 - DNA, 24746 bp, Homo sapiens
tggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggggatacgcggccggggcgcagggcaccgctgccctccccacctatcccagcactggggcgcgggttggagtcgctggtccttcctccctcaactttgagggcccctgcggactgctcccgcctgccccgctccacccccttatctgccagggttgctggaaggggcctgtgtgggccttgttgggtcaggcagcaccatgtggccgcctggggaaggagtccacactgctctgagccccctcctaggcccagaaccccagtcacacgcctgtgcagggtgcgcgcacacgctcatacatctgcacgcatgcacccacaggacgtccctgccttgggccaaagacgctcctgctggtcggttcacactctcaaagcatggatccgtgaagacagttattctgaaccaagagcacaccagtggtcatgtggacatgcacccgtatattctacacacaagaattcttgggctcacaaagacacatgcctgcatatctgtgcacgtccacctcctgtatctggagaataactgacacctgcttctcactcacaagtgctactcagtctctttcagacactgaataatctacttgctagcaggtctatacctagacacacaccagctcacagtacatagaactgccctcacatgcagaaaggcactcaagaatccaggcacactcagggaagccccccaccctctgctgccaggcactgtggtctatctcaaggatggctgggctttcccatttgcctgggaagggggcggggaggtggtctctggggggcccctcacaggtgcaggtctttccctatccactctactccattctattaccagggaagggagctcatcgccatggcagcgccagattcttggccacccattggctccttggttgccatgggctacggggctgtctctgtggaaaatgggtgctggactcctaaggcccactgtgttattgtcgacccaggtgcacgtgctagcggacggcaggatgagatcctcaggtcccgccttgtaacacagcttgctctctgttagagcctcataccagtcactgatagaaaatagttctgacagggctcttctctgagtctgtccagacagcgtcccaaatggaaaccagctgaaaccgcccaaggcttcttaaaagcagatccttctgaaaacaggcacgtggcctgggaactcagggtttctcttgagaattgttacctctaatctcagctcctgtgggggattcaggggtttccaggttattttgtgtctctccccacaaccaccagcaacaccctcacacgtgcgcacatacaggtcacccacaggctctcctgcagacacatgtagtcacacttcagtctcacatggattagggagctgtttccatcatggaaccagggactggggctgtgctgactgagaagagctgctgcgccagacagacgtccaggctggggcacaggtagtttctggaggatcctggcctttcttggcacatgtgggctgaggaccttctagaagacagtgcagccccatggagcgtcatcaaccttttctagccacgcggcagaggtgcctgggcggtgcttgtgggctgagtggactccggtgctgtggaagtacctgtgtgcgggggtccagatggcagggtggtggccatggaccgaggagggtgggaggggcagcacttacggctgtggagattatgacgtggttaggatctggcaaactggaggttgggccaggccaagacatggttctagaaagcttctcccagggagccagggactaaagccacttgtagagagtgtgcaggggtcttagagaaaatatgcctcaaacggaatggcttaagcctgttcctgggaaaggtggcccaggaaggtagaactgtctctaggaaatgatcctgttctagcaagtgcctagggccctggcatcctgcaaggagtgatttggcacttgcctcagcccaggtccaactactatctcccctccaccgccacccctccaattcctttcctgggccgcagactcagccctgaagcatagaatcctgcctccctggaagcctggccccgaggagcgtctcaacacccttatagccctgcactgcttgctttccccatgcctgtcactccacctcctcgttctgttgtagagaggggggtgtgtagctggaggcaggctatgtcagcagttgccaggatcccccctgccctgctggggtctttctgggcacgcactgagtgtggcaaagtactggaactggggtgcagacttccaaaatgggagacttgggctgagaggaggagattcaaattgcctcttgcattaactgggctgctgattgcagtcaaagccacatgctgtctgatcacagagaaaactggggcagaagacagacaaagcattttacttgcagatgggagtgggggcagggggtggcatgcacgtgctttgactggtgtgaggtttccctaatgtcacagcatgtcagagctggaatgtggcatttggtttgggagagaggggttggctggcttcttgctggttctgctggtgagggttttactccctctctaatggttacaccttgcattccctgggcccagcttattttctttagagaaatgatagttggtgataatcttcttatgggtaattttggctcagtgtataatgatcatggattaatctcacattctgagttcaaagggagccattgagtttataaagtttaacaattggaatgtttttgtcttttgtttctgttagtactaataatttctaattctgccagtttctctttacctgtgttcttgaggaatattaaatgcccttagtacatttacagccttttataagttgtaagtggagcagtgagagtcaggaaggactgcggcccacggcgtattggaggactatgctgggtgggattggggtggccccgtcctcagtgcccttgtcctcatggtcctgaggccattgcctggtgtttctctcacttggtcatgaactaattgagatcagggaacttatctggttcctggtcatgtccccagcacagacaagacgtccacttctttgaatcaaagtggcatcccgggatagcctctagggcttccttggctttcccagccccacacctgggttctaagcacacctgagggatacagtactctcacatcaccatgggacctcctggagcactgcttgaaaagcattctgtaggtcacagaaagagaatctcagactggaagagcctttacaggtcatctagttctccgtgtggatgctccctgtagcatccctgccacacggcctcccatcagatggctgtgatttctttcaagttcttccttaggttgaacctaagcaagtctccgggttccccctcctcctggcccttgttaggatcctcccaccacttcctttgttttgtagggagtagtgggactcctgacgccttccgttctgctgctaggttcggcctccgaggtgccctgggcacttggacccaccactttacttctggcagccttataacgactccctgattttcttgttgttctttagagatcaccagctgtggctcgtggtcgcatttgcatggctgagcattagaatcacccatggcacttgcttttacaaagagagagaggagtgggttgattctgggggatgttccccagcagttctgaatgaccaagtcagggcttagtcccgccagcagtttgaatgcacctgatacatttgggaactgctggctggaatggggacggcacatcctgggaggctggaactcctgtgagcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttattcaccagggagagttgttgcgcacttgtcgttagctaggaacacccacctggtacaagcttgtcactgctaggtaatcgtggtcccatctcgtccccttgcagctcttctagaacactgctttaccaggaatcgtgcccactctcagagcctccccattttagtagatttagtgtagaccctcctagctgggtcttgctcagccaggcacaggtggcttctccccggtggccgccccccagctgtgcatgctcctttccttctgtgtgcttgcacatgcccgctggtgggtgaggtggtaggtggctctctaggtactttggggatgtctgaggtttctggagcctcttcagtagcctagcccttgtgttcatccatatttctctgaaggccagtggttaagtcctttctccctgttatcttacctagtaatcagggtcaccgaagcctgtggctctttatcattctcccccatcaggaaatggaggtggaggcagaggaggagaaaggaatgttttcatggaaagcagcctcctgcctctggcataactgtgcatagtccatggcaagtgggatggtggcctctggtagggaaatgtgccccctgcatggatgagagcattaaaaggcactgggcagtgaggccactatggctggaaatacctttagtcagttgagcagctgctgtgacccagcatttccggaggtggcattgctgatgtgagtcttacctctcagctggatgtccccttttctaaatgactctagatgtgagcgtcagcaccatggaagtcatcttctttgtcttgctcagccaagcccagggctggggatggcccaggtgactgcccagtccctgccctctgaaagtgtgagtggcttgcgacaacctagaaaactgtggaatggcccctcctgctggcacaaagggaagccagcactgtcttgtggaggttgcacaggggccaggccactggcttatgacagtggggtttatagctgccctgtgcccaggcacagagcttggcaagcggagggagcacagttggattccagaccctgttgctcctgtcagccaggggccactgtacagagcttagactgcatttttcacgtgtgtcctgaaagttgtgatgtgtatgcactgtgcgtgtggctgaccacgggggacactggtgttcgggtctgaccctttcaagtccgtctgtgggcaaatgctttgactttgcttattcagtcaggctgttggcttgagctgtagagatgggagggttgtagcctctcaggcctggcagggccctcaggcattttgcgctctggtcctgaaccctttcttcagaagtcttcactgcagtcctccagcctgggtgtgtgccttccacaatgggatgcccagcctctcagccagctggaatatttagggacctggttgcatcctgtggtcctggcaatgccctcagggagccccaaatgcagctgtgccctcttaggcagatgggctgtttcaagaagaccaaggcctagaagtatggctcttgagcggtgttttctcctgtgctctggcagctgagggtttggtgaatgaggctgttgtgcacacagccccagatcacagctggggctcctctgacatgcagagcagctcgtgggtacaaggaaagaccttcccagatgtcaagtaggcaggacacctgctagttaaaaaacatgcatagtcctcatagatcgtggccaaggtggtgggcagtctgtgttatgggggcttccttctaccctctgactggctcccttggaggtgcaagtagttgaaggctcatgtaggtggtcaatgattgttccagctagaaagggctagccatcaggaggaggtgaaagtggcttcactttgtcctcagggtgatgtgacctcctgtttcccctttgcacgcacactgcgctcaccttcacacgagcacacccacttcttcacaggtgtctgcatgcacatgtgcacacacatgagatattcacacacttccttatggcctcacacaaacctaatgcactcgggcacgcctgtgcaggaacctggacacagtctggttcaggggcagcttcagaataactgggccagggccgcctggggcttccccagagctcagatcctcaggctccaacctcacctcatgcagctgtccacaccttggcctttatagcatttgggcctaggtctcatgcatgtgtctctggctagcaaaaagctaagtgatttgagttaccagttccctacttgtgccctgccttcctcagaggcatggccagtgcgggtgagatgaggctccctgtcccaagactggtggggctcaagaatttgatgtccccagggctgcctgtgccatgtctgcagcccgggaaggacctggtagctggttgctgggctgtacattgatgtgttgtgtccaccctgcagacacctctgtgtggcccaaaccctgtaggctgagggactggttggtctcttagcttcattctctcaaatgagaaggaggaccctctgccctctttaagtggggaaggggagtagacaaagtcaggactctactctgcccacctggaaagctaggagtttgctttcaacggatggggaaagggtctgccccagaggacgcagcctcctctagaatggtgggaaggaaggaaaaggctggggctggtgagatcccagtagggagctggagggagcagccccctgggtttgtttgaagcctggcctcgggcctggcttgttgctgggatgcctctggatagttctcttggatctcagtcaggcccggccctgctcagggatctgaggggagggtctcatccggtatttactggggagtccctggggaaacaggggtcctagcaggcttccaaagtggcagctcgagcccttttggttcaagctggtttcaagatggcaggctccacccttcctccttctaccatgtgggctcactgagtcccagcagccgtgatgggatgggtttaacgggcccagatatgctgggggtgggctctgggctgtatatcctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggctgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaaggtataccttgcctgctgccccacatcccgtcactgcttcggggagcccgtcacttcctgcccacctaggcaggtgcggactggtcctgacgggggatgcccaggctgtgtatggcttccagcccaggcagacagctgagtagggagggcagagggaaggtggacctgtagccttgggcgcctgtgtatgctccagctgacacctcctgaatcaggcactgaggccagaagcctaaaccttttatgaggccaggagttcagaagtccaagttttgatctggagcatttcactgagtgcaggaggtagcttctaagagtagatgacctgctccccaccagtattctacattctgagaggaatccgtctcactgtcctgccccatatcaaccagtgtctcagtacaaacacctttttccttccctctctgcaccgtgtctgcctggcttctgacttgcagatccctctctctggctcacaactccttaagagctgtagtgacctggagcctgcagctcccatccttaaatgttccaggtctcggcagagcccagttgggagaaattctctgcagctcatcctggagagagcacatctccagagatggctgcagcacatctctgttctcaggaccctccttcctgcttgggttaggtgaagagtaggccaggccagactgaggggttgggggtctctgagcttgaaaggaggactcagactcagtctccactgccccctgctggtgctagtaatccaggctgctacttcatcaaatagtaattctaaaaaggttgcaggcatctggcttttgcggttaggaagaaccttagcagtcgtggtgctcccctccttctgtggcttcgttatgacctggagcctccagatacatcgaactactggtagttgcctcacctcagggctgagcttcttcatctaactgctggcccataccctgcctcgcagtattttaggttcttctctgggttccactgacccatagctccctgagccctttgtctgcacattggagggcagcaggtgggtctcacttgcctggtgcccagtttgtggctgggcacaccatacaggctcggtcccctgtgtgcatgtgtaccctccgaggaagcctactccgtttcttctaacaaaggctggctgtacatctgccagtggctaagtacagtgctagaggctttacctgcattatcttgtttcatcctcacaggaactcattatcctcacatcatcagtaaggatgtgggctctgaggggctcagtgacctgctcatagtactctgctagtgagcagcagggctagaatttgaacccagacctaacagacgccaaatggtctctcctccatattatgttgcctccctgatgaaaagctccttcatgctaattcccctgtgtgtgtgtcagttcagcaccctggccatacctggtatgcctgtactctacttgagaggccttcagaaaaggggaccagggacctcagcccagctgtctcacagaggcagccccagctgctcctcacagagctggccccagccccaccctttgctggcagccagctcctccacttcctttgtgagtgccatcccaagggtggtagtggtaccctgccaggaaggtggccaatgttctgggtcatatggcgtgtggcctgtggctgtgtggcatcacagccccagctctgccaagcctggcacctgggcgagtgaggctgcatacagaataggggcctgcacccaggattgtgggccctgccaatttgtgccagaggccaacatcgtgagaggtcattgacgtgcagtcgttttggaaggtatttcttggcagctgtgttccagatgatgtcaggacatcagaaagactgtggtacaactagcgcctctggcgtaagtgcaggactgaagtcaaaagacagtttctgtgctaggtggctcacacctgtaatcccaacactttgggaggccaaggcaggaggattgcttgagggcggaagttcaggactagcctgggtaacatagtgagaccccatctttaaaaaaagtgagcagggtgtggtgacacctgcctgtagtcccagctacgtaggaggatcacttgagcccaggagttcaagactgcagtgagctatgatcgtgccactgcaatccagcaagaaaaaaaaaagaaaaagatagtttctggtcgtgccactaccagttagttacctgctcgcttgtgactggggcaagccatttaccctctctggatctgtttcctccattataaaatggggaaacttctctgtcttagggctttggaactcgaaggagccacggtgtgttccaaggtccaaaatcagggaattgctattccctgacattccagagtgggctgggcctccacgacctttttcacagaggacatttgaacatgtgacatttgatttctgggaggtgcctactgcttctctaggggcccagtctttgtccaggttcaaatggtggacaaagctctggggaggctgctgcacacacgcgtggcctacccaggaactggtgtttccaggccactcccaccccgcctacagcattagttgcctccctgtctgccctctactggctacaggcgttaaattcaggggatcattccaagaggaaaaggagggagtctgatacacatcagacctcacagtttatcctggtttttgacctgctggctatactcattcatgttacacattcattcagttcttaaatatttattgaggtttgtgtcaggctctggattagaggctgtaggtcccaagtgagcacaaatgggtgtggtccctgctttcacggaccttacagtctaggtggagagacaatgttaaacagatggtcacggggttgctttgtggaaggaagccaaattctgtgagtagatgacaacacctgctctgacgagggaggcaggcacagcgtccctcgggaggtgacatccaagctgaaatctgcaggatgagtgggagttgatcactgaggggggcgagggggagggcagtgcaggcagcaggagcaagggccctgtggcaagagggagtgcagtgcatgtgaggcaacagaccagcctggtgtggctgcaactcttggtgccccagaggtggggagtatgtgtttattttagacctaggggaagggagagaatgttggtcttcagcttaagagcaatcagaaaccattcaaggattttgagcagattggggttctgcagtatggagaatttggaggccaccagctgggacccttctgagacctcactgttggtgcctgtagcttcttgtgtcccagagttgttgttctgagcactcctacaccccagcctcccatgggctcatccccgcagagccccctcgtaggctccctggagtgcttgccctggttgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggtcagctcacattctctacagccctccccagcaggcctggcctccactgtagggctggggaaggtttgtcctcctgacttggaggggagggataggatgaacagcctcagggaagacacagactgccactctgggcaccccctcaggtggctcacaggcctcatctagcttgggaggtgcctgggctgcctctgggtgtgggcatgcctaccacactgccaggaagtgaagtcctgctcagctgtggcccagaaccaccgtcccccacctcagctaccttggcctgagcaccctttatcatgacccctcaaggaggatctcacccagcctggactaggacactcactgcactgggggctgactgcttcccaggcagcttgccccatccttatgcagccctcgccgtcagctcttcgtataatgtggacttcccttgactccatattctagtccaggttccaccctctggaccacagaccagcctgttccctctgctcctctttctccagaaaagacccctaaagattaaggacagtgattggcggtacctgccccaggtcctgtctcttggctacacaccccgtttcctcaacttttgttcacggacagtggtttccaggccactgcgtcacggttggacagtgatgtgtcacaggccatgggcttctggagctggccgagcactctgggcatagctcagtaggcgggcagggtggctgccacctgtgtgggtcaggccttgcttctgttgctgaagctctgtggtaacgggcaggaaagctgacgtaggatgggagatgctccatttgggaaggcgagtgtatgccaattgcaatctttctcaaggggcccacgtttttaatgatgtatgtgagttactgcacgtgtgtatgttgtgtctgtttgtggaagaaaacaccagcattgatggcttgtagctggtcgtgtccatgaatgattgctggccttgcctatggtctggatcagtccttgttctccatcttgtttttccactgtgcagttggttttgtagatggctgccgtctgctttaaggacgtgaggtgttgtaaaccaaccctcggcaattaatttgggggaagagcagaagaaatgaagcccacatcccttactagcttaccagttgttaacaggctggtgcaatcattagttttataaaaatcacttttgcaaataaagttttgcagagggtttccccactcttccctcatccccttcatggacgtctgagaatccaggccctcctctcctcctcctggatgtaactcaggcgtgtccgtggcctgcaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggtgagccccatggggacccagtgatacccccaaaactcagtcccaggttctcagatgcacctttctctgggagcatggccttcctgtgtccaaacccctccctggcaatggtgggtgagggtggggcacacttcggagacaaatgagaaactcttaggcagggcccctgctaaggccccagggaggccctgatttgggggcagatttccttttccttttgctccttagaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgcatccacagcagtttttggaggactgctcatccgttagaggtggactgcatgtgaagagatggactcgtatgcctttaggagcttctctgctggcctcttatgtccctctaccttgcctcctaacctcttcagctaggccagcagggtgatgtatggggggagatgcagttggacaggatgacctctgaggacctcccgtatctcccatctccacctctaggaactgttgagggcagggctgggaagatagcttctgaccccaggcccaggctggccaggccccaatcccaggatccttccctctctcccaccgccacgttaggaggcagatttggatcccagaccaccaatttgggctgcttagggtccttggggctcaggcacctattctgcatccccataggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtaaggttggtctgggcatgttatcatctaggctttacagccctttgaaatcctaggggctgaaatgtgactggaagtctcatatctaccactgacctctcagttcctcaaagaaactgccttcgtgtctggtctgtgcacatctttgtgttttccagtgcatttgtgtgtgtgcacatatgtgcgtttgggagctgacgcaacggagagagtctgtgtgagtggctctcatgactgtgtgcagaccagaggctgagtctggaatatgacctcattccactccccaaggtgttcctcctggcgggaaggaagagaaagaagagtaaaacttccaattacctcatctctgtggacccaacagacttgtctcgaggaggggacagctatatcgggaaactgcggtactagcattcccccaggaagcaggcgggagtgggagggaggggcaggggcaagctgtctgtagagggcctgaatcttcctgaaggagatctaggccagggatggatactctcccaggatcctctctgataatcacatccaactggaggcctatgtctatgccagcctagagccagacttggagatgggaatcacacacccgaccccaagctgttcccaggaggtgggtgcaggcccaccaagagtgatggatccaaccccagggtgtcactgataacgcaggccaccatggaagagttgccttggctccatggtcaatgccaagggacagggctgagagtgagctcttgagggaagagacacacagcaatcttgggggtggggggcagtggtgaaggggcaggaaggctctgagcctaggcctccaggtgggggcagtggggaggtagggtttgctgaggaactgagtaccagatttggggagcataaataaagatgagaggtcaggagctaaagctggagatggggctggactgagacttaggctggctgcgacagaggagatctcatcctctctccacgggtgctaagcctcttccactgtcttatcagatgccattctgtttgctcacctcccatgaggagaactcccatgttcccccagataaatcttctgaagaatcctgattgacctccctgaattgctctcactgaactgaaatgcactttgagtcaactcagagcaagtccaggccttctgcccacgaagtgtcttcaaagatgtggattcagtgagcagtatgcctccctgggcctgctcctgttccagcccagaatgttttgcaggctcctcataggacagacgatgagctgttccctgctctggggcagagggtgcatgactctatactgattgtgcctttatttcaggtccaacttgatgggcaccaagttcactgtttatgacaatggagtcaaccctcagaaggcctcatcctccactttggaaagtggaaccttacgtcaggagctggcagctgtgtgctacgtgagtcctaggttcgggggtctctgatttccaaggtagatatgaaatccaggacttgatgcctgatctaggggctatcccatccatcttagtgggtagacaaggctgtgtggagaggggctgtcctctgtggagtgttcctggcctaggacaggggctctggctctctcctcctgacttcagagctcacaccacagccggccatctgcttggggagctcagaaaaccaggcctggctctctgcagtccaggccaggagtctcttagacagaaggagacggtcgccctgggttcttgtctgtgcatttcccagatcatccctctggcatgccaggttctacatggattacacggcactttgtcatctcactgaacgttcaacctaagaggtagatcctattttctttatagatgaggaaactgaagctcagctgcagatgtcacacagctcaaaaacgaccaaactggaatataaatataggggattactctacccctttgaacctttttcttcatttttaaaatcaggggtgggtatctcatcaacctgggcatgggcacttcttggaggccatcagtaagtaatccacagctactttgtatgatcctgtggtgccacctgctgaccagttttggggaggcagcctgagtcttcaagttcttactgagctccaactaagcatattgtttgaggcactaaggatatagtaatgaacagacataaatgtatacctttatgggacttaaagccctagcagggcagacaagctatgaaacagatctatcagtgaagtaagtatgttctttataaacactaagaagaaaaagtaggggaggggagataagaaatgtcaaggtatgtgtgagaatttcagaatggcagggagggcgtcactgaggtagctcttgagtaaagaccagaaggaagtgaaaaacagcagtgtacgtgtctaggggacacagtgaggacaaaagtcctgaatgcctggcatgaagaaggaatggagtggataccaggcagtaaatggtgaggagaggaaggtcatggggccacgtgcaggtgaagtcacatctccagctttaacttggagtgagctggagagccactggagagttctgagcagaggagaaagatcatctgacttaatgtgcctgagcactggctgctgtgttgagaacagatggtgggaaggaggaataggagggccaacaacagaaaccaggagtccaggcaaaggctgttagaatgatcttggtgagagaagctagtggtgaaaagtggtggaagtctgggtataattggaaggtggagctgacagaaactgctgatggattagacgtaggatgtagaagagaggactcgagtgtgaccaagtagtttgccggagcgagtggaagaacagcattgccgtgagcagaagcaaggatgacgcataagaggagctagttctggcagggtagagacccaggggctcagttctggccgtgttaggtttagagggatgtgtgttagacttcggagtggagatggtgggaactagctcttcctctttattcccgtcccccccaccttctccagtaggtaaatagacgcctcaggtggccagtgttgcgttctctttcccaggagacaaacgtcttaggcttcaaggggcctcggaagatgagcgtgattgtcccaggcatgaacatggttcatgagagagtctctatccgcccccgcaacgtgagtgtctaccccttcctcccctctttccccatcatcctagtctctgcatgagcttctaagggcagaactccagctgatgtgtgtatgtggaggggtaccatgtgagaaagccctggaggtctagggaaatccaaggacccccattcccgggatagatccctttctggggtggtcatggtgccaaaggcctgggcctggctcaggtgaggctgccctcccaggagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccgtgagtgtttctgtccctactcattatggtccgtaggatacccaaggcccttagcgtagggttcagcccacctagccctgcctacactggctagagtttaagaatgtgagctatacagctaaggttagatgtatggaactttctaaccctaatgactgggaggtcctggaagaaccttctttgcagccctggtcctagattctgtgtattcaacggagtctcaggcacgggaacaccctttaaaaggacttttcctcttttctgtcccctggtgttcacatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctgga

SEQ ID NO: 577 - DNA, 32949 bp, Homo sapiens
gcatttcctctctagctgttcctgaggctggcatctgggtaagtccagctccgcggggcagtgtgggcgacaggaccgggagagcagtgggggagattgtgttcagagggcagaacttgtcctggttaatgcactaggaatttcttctggcgtctccaaggttgtgcttcaacaacatttctggaatgttcttttatcattatttgggctctacgtgtgcaagttcgtgtgtgtgtatgtggcggggggaagcggggaggacagcggcagcaaccatagtttacacccacgacttcagcagatttgcccagtatccctcccaggggagaagatggatgggatatacagaaggaaacaaacctccttaaagaccaaagggcagcagatttttgtgctggtgttagggtggaaggagcacagaagaaaggcagaatcctgatgcagatggaaggactgatggggcaggagctgggagggtatgcggagctaatagggctgtctggagagcagtcacctcaggatgggcaggagctgggagggtatgcggagctaatagggctgtctggagagcagtcacctcaggatgcacagggctgggtttgcagggctcaggaggcgaggagtagataggcaggaatggagatgggacgggagagatgagtgagtctgaggcatcttgacattgaactgcagtcacagaaattccaatttggagagctccaccgttttccaggctctctgcctcccttgagtgttatttatggctttaggttgaggtgctttgccaaatagagtataatcaagggatcaaggagggaacaattccaaacaaagccaacttgttcatccatccggactctaggagatatggaagatctaaagatacagcaggtgattgctagtttttgtggaactcacagtctagttgggaagactatgttggtgaatgctgcagtgatacacctgtgataaatgctggggaagtgtgtcttttagtcatctattttgttgtctttgtctttgtctgactgaaacaagtgatggaagacatggtctcatatctctggtcaaaatcctggctctgttccttcctggttctaaacccctcggcaggcttcctagtccccctaagactcagtttatgcatctataaaatggggctaggaataggtgcacctcatagagctctgtgcaggttagatggggaaaaacatcagtgagtgcctagcctgtggaaagctctaaattaatgtgaattataatgataacaattgcgaattttgcaaggagacattaaaggatgtatgtttttatttattttattttattctattttattttttgagatggagttttgctcttattgcccaggctggagtgcagtggtgtgatcttggctcatcgcaacctccgcctcctgggttcaagcgattctcctgcctcagcctcccgagtagctgggattacaggtgcctggtaccatgcccggttaatttttgtatttttagtagagacgggatttctccctgttgtttggtgagcctggtctccaactcctgacctcaggtgatccgcccacctcggcctcccaaagtgctgggattacagggatgtatgtttttattattctccattatgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggtgagtggaaggaagacttttaaaaaaaattgtggccaagtgcacatagtgtacaattttccatctttatatatatatatatatatatttttttttgagacggagttgctcttgttgcccaggctggagtgcaatggtgagatcttggctcactgcaacctccacctcccgggttcaagcgattttcctgcctcagcctcccaagtagctgggattacaggcattgcacctccacgcccggctaattttgtatttttagtagagatggggtttctccatgttggtcaggttggtctcaaactcccgacctcaggtgatccacccgcctcggcctcgcaaagtgctggaattacaggtgtgagccaccgcgcccggccgtaataatttttaaatgtacagttcagtagtgttaggtacactcacattgtgcaaccagtctccagaactgttttcatcttgcaaaactgaaactcctcacccattgaatgataactcctcattgcctcattctcccagccctggtaaccaccattctatttgccatctctgtgaatcttactactctgggtacctcatataagtggaaacatacagcattttttcctttatgagtagtttatttcactcagcataatgtcctccgggttcaactatgttgtagcatgtgtcggaattcccttcctttaaaaaagactgtataaatactccatggtaccatataccaaattttgtttagttatctgttgatgaacacctggattacttctacctttttgttattgttaatgctgttatgagtgttggtgcacaaatatctcttcaagaccctgctttgaattctctggggtatatactcagaagtgaaatttctgaatcatacggtaattctgttaaatattttgaagaactgctctactgttttagataccatctgcaccatttcccaccaacagcacacaagggttccaatttctccatatcctaagaacacgttatttttatttattttttcttttttatagtagccattctaatgagtgtgaggtggtatctcactgtagttttgatttccgtttccctaatgataagtgatgctgagcacattttcactgcttgttggccatttatagagcttcttcagagaaagttctgttcaagttcttttctcattttcagaccaggtttggcttttgttgttgccttgtaggagttctttatgtattctagatattaaccccatatcagatatatgatttacaaatattttctcctattctgtgggttgtcttttcatttggttaactgtgtcctttgatgcacagaagttagtatgatttttttttttttaaatcatggccgggcatggtggctcatgcctgtaattccagcactttgtgaggctgaggtgggtggatcacctgaggtcaggagttcaacaccagcctggccaacatggcaaaaccccatctctactaaaaatacaaaaaaaattagccgggtgtggtggtgggcacctgtaatcccagctactcaggaggctgaggtaggagaattgcttgaacatggggagtggaggttgcagtgagctgagattgcaccacggcactccagcctgggctaaagagcaagaccctgtttcaaaaaaaaatttttttttcttgtattgtcttggttttttctcttttcccctctcacggtagtgctatgagaaggtggaggcaaactgtttgctttctctaactcctttaaaaagctgatgcagactgtacctaccccctgggcacctgccatgattagtccctctttatctgaatctcagcagtgcctagacctgcctccaattctccatccagcttctcagaccacatgttttgtccagtatctgctgtgtggtcagcaggcttgggcctctgcttcctatggcccagagggcagcctctctccttgaagaaccgtggagtttggggcagaagcctttcctttcaccaccactttgggaattggaatgtaaaagaaattctcttaatccccatgtacacattggggataaggttctttcttttgtcttgtgttctaggcaaaggtagggctcagagaagggcagggtattgcaggatgatgatgtagagctggtggtgatgggaaggaggagtacaaatgagtcagtggatagggagacacatgttaaggcagggcagcagtgtgggtgtaatgacactggggaaacagacagcagtgtgcagccgggggaggtcagaaaccagttgctgcaatggctctcacctgtagtcccagctactcaggaggctaaggcaggaggatcgcttgagcccaggagctcaaaaccagcctgagcaacatagggagacctcatctctaagtaaataaagcaattatcattgtgtcagtacttatatactcacatacccaaatgaaagtgtcataatcacaactgtagaagtactttgctaagcagtttttatggattttatggcacattcaagaaacccatgaaacagcttctggtattatccctcctgcaagtgaatgaggtgagcctggaagagatcctaactggcccatggtttatttctagccataaccagagctggggtaaaaagcagggcatgtctctgatcaaagcctggctcttaaccactacaccgtctttgcttccatatctggattttgaggcagaaaagttataactagggttagaagtttgtttgtttgtttcctggggtggggttaggttttaggtaatagactttggctaatttactgtcatggctcctacctgagtcccagttactcaggtggctgaagtgggtgcatcacttgagctcaggagttccaggctggagtgagctatgaccatgccactgccctccagctttggaaacaaagcaagactctgtctcttaaaaaaaaagaataagattttggttttggcttagattttttggattttattttgtgatatggttaccaagtagacagctgtcagaggtcttttatgggctgggcgcagtggcttatgcctgtaatcccagcacttcaggaggccaagatgggaggattgcttgagcccaggagtttgagaccagcctgggcaacatagtgagaacctgtctctacaaaaaatgcaaacattagttaggtgtggtggcacgtgtcaatagtcccagctgttctggaggctgaggtgggaggatcacttgagcccaggaggttgaggctgcagggagccatgattgtgtcattgcactccagcctgggcaatagagtgaggccctgtctcaaaaaaaaaaaaaaaatcatttatgttacttgtagattcctgcccacctgaagttatctgtcttatatatttcccctagtgactaactcttgttttacctaacctgaatttctcctatagaatgccttcttaagatatgctatctagtgactgtttggatttgtgattctcaacacagatgcatgttggaatcacctgggagcttttagtatgtgatggttcctgggcctcacctcagagggactgaaaaagaacctctgggcgtgcagtcctgaagtccatatttttaaagcttcctgggtgattctaaagtcagccaggattcccaaccactagattaggcacgaaatagactggtcgttctcactcttgaagaaccagacatctagacttgacaatagaagacgtgtgtaaaatggattgcagggaactgcggtcagggaagggtgacctttcttagcccacagccgtgttggggatataggagagcttggagatgccctcacaatcaggctgccaggggcaggcaaaagcaaacgagggtaaaagaaacttagcctgcttcgcatgtttgctgattgatttccaggcctgaggaagagattctgagactggggacagtgggaacacatgcttggcaggtggacagcagaagttgttttgaaactaggagtgcagaaatgctcccaaccagacttttgactggatacctgtcctctgcaactcagagccatgttttgatttgggggatgtttggggtctcctctctcatgccaaatattaggccaggtttcaattgcatcctctgtgataatagttctgggttttgacaccttttttttcccttttaggttcagataatgcacgtgtttcgaatcccactgtgatatgccaggaagacagcattgaagaggagtggatgggtttactggagtacctttcgagaatctctatttgtaaaatgaagaaaggtaagcgactggggtggtgcttctagttgagttttaagacctggttcaggaggctctgggaagctgagcagctgggtaacttggccatactataggttcctgctctttggaatgcaaaggcctgtctcaggaaatccattgtcagttgaagaaacaaattcatgtttgtgtggctcttgcagtcccagagccagcggcggtgattaagcgtttcaagtttgataaggcataggatgcagattacttaaaggaataagattgattcaaatgatctttgggctggtagctacacatagagatgggccttctgctcagctgtgtatcttaaaaacttgacaccagagattctcggcacctttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcgcttgcctcctctcatctcttttcaactatcttccaaatactgttgccacagctacatcataatgccaccactgtctgtttgagactccttcatgagcaaagattgatgtatggtaggtggataaatgggatgaggaaaaaaaaaataaaacaaggaacaaatgtttggggaatgccagtttagcacaaggtattaagtaggatgtaggattgcctacaaatatttgtcaactgaaatttcttgtaagctacttggagcactagtgcctaagagtcagtcaatgtctgtggggcagaacaatgccagagagtctgtgtcccaggagcgaggggacagagggcctcagagctggaggctggggggatgtttcttagaaatgtgcaatctaagcctcctttaaggaatggtgggacctgggcgcatagagaagaaattaaaggaattctgcactgaagactggtatgagccaaatcatgaatgcagtctgagaaaaagtgtgtgcaggtgacagtggagagagacacagtttccttggaaaaaaacatgatgaaggtaaatcaagggaaatagagcagaaatgtggagaccctctttctaggcccccatgttgctctgcactgggcattgccaaaaccccgttttcgggtctgttcacacacttgctgggtggttggaagctagtggccaagtctgtgcaatgaagtggttgagtcacctgacttctgagtcccttttgggtttatcgttcagtgcctcctgcagaaggaccacccacagtggttgtaggaaggtggccaccctgtgatgtgtgagtttagcctggatagaagacacttgacgtggggcaaaattaagggaaacaggaggcttggcccttccacaggcaacaatgagtttcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtgggtgtccccgctcagccagcttccggaggatgggcagtgagagagtgagagaaggaaaggggcagccaggctgggggcttacggtgttgagagagagggcaggtgtgggaaagcagggtacggtttctacggcagcaaacagttccgagtgactggaaaaaagacagttgtcttcattcatcaggttgccataacaaaacactgcaggctggttggcttataagcaaaaggaaggttcaccttacggttctggaggctgggaagtccatgatccaggctctggcagatctggtgtttggtgagggcctgttccctggtcgatggtgccttctcactgtgtccttacatggtgaagaggcaaggcagctctctggggtccctttcctaaggacagcaatcccactcctgagggctccaccctcataacttaaccacacctcaaaggccccatcgcctgatacgtcatgttgagggttaggatttcagcgtatggattttggggcacacaaacattcagaccatagaaatgggagaagaagagtaagacagagagaaaagtaggcagaactactcattaagagtgaggtggaaggtggagagggcagggagaccttatgaagatcacacatctgtgaggaaggtttgcacactctcactgaagccccggtaggaggctcagcacccatttctctagatagcaccttccttcctctgaggacagattctgactggagccctggtagggggctcagcacccatccctctagatggcacctgccttactctgaggacagactctcactgaagccccggtaggaggctcagcacccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctctgaggacagactctgattggagccctggcagggggctcagcacccatccctctagatggcacctgccttactctgaggacagactctcactgaagccccggtaggaggctcagcaaccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctcaggacagactctgactggaaccctggtagggggctcagcacccatccctctagatggcacctgccttactctgaggacagactctgacgggagccctggtagggggctcagcacccatccctctagatggcacctgccttactctgaggacagactctgactggagccctggtagggggctcagcacccatctttctagatggcagctgccttactctgagggcaggagcttgctttgtatgttccagtcccttctgagaaccagaagcctgagcatctattagaaatgcaggattgtggacccaatcttagacctagagagctagactttgcatttgaatgagagctacaggtgattcaaaggtgactgcatgtgtgggtgcagtggctcttgcctgtaatcctaggttttgggaggccaagatggggggattgcttgaagccaggaattcaagtcctacctgagcagcaaagtgagagcacctctctacagaaaaacaaaagcaaaaatgtgactgcatgttggagccacctggctttttttaaataaaaaagatccatatagctggacacagtgactcgtgcctgtaacctcagctactcgggaggctgaggcaagaggattgcttgagcccaggagtttgaggctgcagtgagctatgatcatggcactgcattccagcttgggtttcatctgaaaaaaaatttaaaaaattcatctagttccacctcagagcttctgattttatttccatggatgtggcctgggcttgcgattttctttttcttttttttttttttgagatgaagtcttgctctgttgcccaggctggagtgctgtggcatgatcttggctcactgcaacttccacctcccaggttcaagtgattctcctgcctcagcctccctaatagctgggatgacaggctcgtgccaccacacccaattaatttttgtatttttagtagagagagggtttcaccatgttggccaggctgatcttgaactcctgacctcaggtgatctgcccgcctcggcctcccaaagtgctgggattacaggtgtgagccaccatgcccagcctggcctgaggatttttgtgagcactcctgatgctgttgtgtagccaggagtgaggactgccctctgatcacccagcacagaacgttcagggccatgttgggacagtggactggtaagggcgagaggaggacactggggagcaggctgtagggtgccacagtccgccacagtcacaggctcatgctctccgtccgagaggaggcagaactgcttttaccaaggctcatccagccctcttcatttctctgggaacaatttttggtttcgtgacccatttcttaatccccggaaggcatttctctgaactggtgccaggcaccccggcccccagctccagttagttattattcgaggctgatttcttttctgtctgtcttccttctaattcctagattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggtgagtccccgtgcatgtgatctgtgtgagtgcaagttcatatgagagagagagagagaaacagactggagaaagatcttcaggaccaggttgctggtgtggtttctttcttttctttttctttttttctttttttgaggcagagttttgctcttattgcccaggctggagtgcaatgccgtgacctcggctcactgcaatctctgcctcctgggttcaagtgattctcctgcctcagcctcctgagtagctgggattacaggcacccaccaccatacccagctaattttttgtatttttagtagagatggggtttcatcatgttgtccaggctagtctcgaagtcctgacctcaggtgatccgcccgcctcggcctcccaaaatgctgggattacaggcatgagccaccgcacccggccggtggtgtggtttctgctgtaacaaagtgccacagactgaatggcttcaacaacaaaaattcattttcttgcagttctgaggccgaaagtctaagatcaaggtgtcagcagggttggtttcttctgaggccgccctccttggtttgtagatgcccccttctccctgtgtactgatgccatcttgccttggggggaagagtggcctagtctcctcttcttacagggacagcagtcctgatggattaggcacagtcaggcatgactacacaagacctaatgttaatctagtcactcctttaaagaccccatttcccaaaacagccacattatgaggtcttgaggattagggcttcaacatgtaaatttttgggggggcacagttcagcccagaacaagtgagaaggtagaatgggttggaggccagctggggaagttttgtgtggggaagaatgaatgaggaactaaaaaaaaagtcatttcttgaaacaaccatgatgctcgatatattccatttcctcatgggccatgttcatagatgagagttggagaatttgccatttacaacaatggcaacctcacctaaaaactatgaaaatactttttttttttttctttgagacaggacctctctctgtcacccaggctggagtgtgtgatcacagcttactgcagcctcgacctcccaggctcaagcaatcctcccacctcagctcccccgagtagctgggactacaggcatgcaccaccatgctggctaatttttgtattttttttgtagagatgtggtctcatcacgttgcccagcctggtcagaatgctttgtatgggttgaaatgtcacagggaatctcctgtgactttattaataatgtgcttgctcacacctgtagtcccagctactcgggaggctgaggcaggagaactgtgtgtacccgggaggcggagatggcagtgagccgagatcgtgccattgcactccagcctgggtgacagagcgagattccatttcaaaataataataataataataataataaaaaatgtgcttgctttctcccacaccatgaatcagattcacacgccccaccgcgctggtgcctgggccgcctcactagctctgtttcattccctgctctgtggacgcatgcaggcgtctgcatttttgaggagctgcacagcaagtgttaaagtccgccactctaggacattttgctacctccctctccggctcaacacactcaccttgtcaccagtcttatcaatttttcctcctacccgagctgttttccacttttcctcgtcctcaccccaccagcccaggtccagcaactgtcaccacttgcctggacacgcagtgacctcctagaccatcagctccccggggatggggtttgcgtttgtttgtcttgctgtcatctttgccacgcctggacagacatcttagtacccatcagtggtcaaaagcacgcactgaatgaatgttggctctttggtctccctgtgtctgcctttttccctcacccgaccattctctgcacaaaagtaagatggtcctttagaaaattctgattcgattgtgctgttcggtggcttaaatgctttctgtctgctctgctctttattttttactttatgtatttatttttgtagatgtagggggcgcaagagcagctttgtttcatggatatgttactgcacagtggtagtgtctgggcttttactgtaactacccctttttttttgagatggactctcgccgtgttgcccaggctggagtacagtggagtgatctcggctcactgcaacatccacctcctgggttcaagcaattcttcgagtagttgggattacaggcatgggccaccacgcccagctgatttttgtatttttagtagggacaaggtttcaccgtattggctaggctggtctcaaactcctgacctcgtgatccacccgcctcggcctcccaaagtgctgggattacaggcgtgagccaccgtgcccggccttagtgtaactcttacccaaatagtgaacattgtacccaataaataattttccagccctcacctggctcccaccctcccacccttctgaggctctagtgtctatcattccatgctctatggatgttaccctttgtttagctcccacttgtaagtgagaacgtgtggtatttgactctgtttctgagttgtttcacttaaggtaatggcctccagttccatctgtgtggcttcaaagatgtgacttcattcttttctatggctgagcagtattccattatgtatatagatcacactcttcatctttgctcttttggtaaatttcaaatcgtagtgccatggagactggttgtttgggacatttaaccttatttctccaacttcatgcccaaattctctccccactgccattgcccctgtatgattctggagaggcagacacaaacagggaagggtaggggacagtgagatgcttcgcagagaagtagagatccatttgtccatttgcttgaagttggtgtaaggatagggacagaaaggaaggtggtctaacaggctccaggacctatgaactattgccctggaaagaagctagaatgttgttcttgcccccatgacagggataaagtatagtttttgttgctggtggtggtggtgacggtggtagtgatgtgcgtgtgtgtttgtgtgcatgtgtgtgacggggaaactaatcaagaatcagagctgcagcgggatgtggaatcccagcactttgagaggctgaggtgggcagatcacctgagcccaggagttcaaaaccagcctgagcaagctggtgagaccttgtctttagaagataataataataataaaaataaaatataaataaaataaaatggctaagcatggtagcacatgcctgtatttgcagccacttgggaggctgaggcaggtggatcccttgagcccaggagttcgaggtggcagtgagctatgatctcgccagtgcactccagcctgtgcaacaaagtgagaccctgtctttaaaaaaagaaaagaaaagaaaagaaaaagaatcagagctgcttttcctttcaatatagatggagggctgggatgaaatcgtcaaacacaatggggtgacaatgttggtgaagacaagaaatagctgagtgcagcactggcgagggcagtgccgactgcgggcacgtcaatggttaggaacacgagggaaggaggtgggtgcacaggcccacaccgcccgcttcacttacaaaccaggagcgcaccattcacatgtctggggggtgatctcaatgcacccggcactgtttacggccgggagttcactgacaggtgatccctctgctgtgactggggagactgggggctgacctcccaatgtgccttgtgctgtattccggagctctctggtcaggtgtattctgatgctttctctattccagagctctctggtcaggtgtgtcctgatgctttctctattccagagctctctggtcaggtgtgtcctgatgctttctctattccggagctctctggtcaggtgtgtcctgatgctttctctattccggagctctctggtcaggtgtgtcctgatgcattctctattccagagctctctggtcaggtgtgtcctgatgctttctctattccagagctctcttgtcaggtgtgtcctgatgctttctctattctggagctctctggtcagatgtgttctgatgctttctctattccggagctctctggtcaggtgtgttctgatgctttctgtattccggagctctctgatcagatgtgttctgatgctttctctattccggagcttcctgatcaggtgtgtcctgatgcttcctctgttctggagctctctggtcaggtgtgttctgatgctttctgcctctgttcttggcatgaaggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggtgagtcgagcccgttcccctaaggaagttctgccagcgaggcgtgctgcgcactctggcttcagtgaggcccggtgggctggggtttgagtgagaatggccttggcggctcgggtgactgcgtgtgcttgtcttggggtgtctagcattgcggtcagtgagtgtttgtcgtggggaaagccacacactcaaccctgacaaggagcataaataataacaaaaagaagatgtctgcctttagggtgcctactgcctagctgacaaaaagaaaaaatcagtgtaatgcattgctttagaggagttttagaacttcatgacaagccctgggtcctcatattgtataagaaaaatggtgctaaagcaatgcagaccctcgatgttgtatgcagcccttccctgagtgcttctgggagacttgcattttgaaggagagaaaaaaccacttaaaaatggaagggccatttctcacccattaggatggctattatcaaacaaaagcaagaaaactagaaaacaacaagtattggtgtgggtgcggagaaatggaagccattgtgtgttgctggtgggaatgtaaatgatgcagccactatggaaaacagcacagcaattcctaaaaaataaatacagaattactactggagccagcatttccactgctgggtatatctgcaaaagagttcaaagcaggaactcagccaggagcggtggctcacacctgtaatcccagcattttgggaggctgaggcaggtggatcactggaggtcgggagttcgagactagcctggccatcatagtaaaaccttgtctctactaaaaatacaaaaattagccaggcatggtggtgcatgcctgtaatcccagttactcggggtggaggcaagagaatcttttgaacctgggaggcgggggttgcagtgagtcaagatcccgtcactgtactcccgcctgggtgacagaggaagcattaaaaaaaacagaaggcaggaactcaaacatgttatttgtacatctatgtccatagcaacactattagaaatagccaaaaggtggaaataaccaaacgtccttcaacggatgaagggtgttgaaaagtgctatatatgtacattcagctttaaaaagaattctagtacacactacaacatggatgagcctcggggacattatgctaagtaagataagctagactcgaaagggcaaatactctgattgtccttataggaggtgtctagaacagacagattcatagagacaggaagaaacgtggttgcaggcaatgggagggcggagagtgggaagacattgtttaatggttatggagtttcagttctgcaagatgaaaggagttctggagatggtggtggtgatggttgcacaacaatgtgaagtgcttaaggccattaattgtgcacttaaaaatggttaaaatggtaaattttattttacacgtattttaccacaataaagctgaatgtagggagctgggaagatgtagtattggtgggagcttggagaatgcttacttgttattccaccaaatggaaaaggaaatcagaagtgtacatagagcttgtgtccactccctttccatgtgtaaactggagtagaggcagtggcaggtacgggtgcttccttgtccatggtggagcgtgggtgagagacatgactgacattctgccatctctatggaaggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggtaagtcttcatgggtgtcttaccagaaaagtaacttcttttcagaggtgaattatttggaaaatgtggatgggggttactttggtcaggcagagctgaaggtagagtaaggaggtaaaaacatcagaaatgctttgaaggactggaggcatataatgtatactgctgctaataagataatttatgctaatttatgattatagaactagagtttcttagtgttggaagaaaccttagagatggtgcagcccaattgcctgttgagggaaaaacttgcttccaagacactcacatgaatagtcacccattttatgtgtgcatgcttgcaagcatgcaagttatcgcatagtgcatgcagcctctacactaggaaagagctctcaccctgcagcctctacactaggagaggactcttacactgcagcctctatatcctcaacagtgtcatggctcagcaccttcacctatgtagccatgctctcccaggtacacaggctggtttgttagtgtctgtctttgaaatgtggtgcccagacctgatgatgcatggtggatgttttacctcctgttgcagagaactatggtttcactggtggaatctctgatttccttgttttttttggcagttacataagccttttgattcatgttggaattctgcagtaaacagtagtagggaatacccactaataatcatgcactttccctgtaccactttcctgtatcactttccctgtatcacctgctctttcatgttcttacatggattttctcagttggcttcagaaagatgctatagggtagggtatctgtgtctccaatttaaagaggagaaaataaaattcagggagcctcataactttgtccaaggacactcagagagaaggtagtggaactcagtgtagacaaacgtctgtgacctcccaagccactgccttaattcccagtgcattgccttaggagatgttgctaatgggctctctacagggcttcttcatctggctctcagcttaagggtgggacctccaatttagctttgctaaacctcatcttacctgtcttttgacccattgactaggcagttttgaatcttcattctgacaataatatctacaaatacaataagcaaattggataggtcttcattcattcacattattaatatatataccagccagatcagcattcaagacaaaatttggcaggaaaggtcttcccagaggagtaatccactaatccataattaacaaccaacctctgttcacaaagctctgatacttccttggacctctcccatcagccaatcctcagatgtgaccatatctctttctatgaagtcttcctgcagtgccttcatttcctcgccttagggtattacccttccttagcaaatcgccttagaatattactcttccttggcaatttgacttctgcttctctaagtttgttcaacagacatgattttgtcccttcattttgcaggccctctgggggctctgtggtgggcactgacagcagcagtgagtaaaacagaccaaaatcctgttttcacaaccgttcttttagggaagtgataacagataatagacatgctaaacaatataccctgtgtataagagctataagaaaaactggagtgacggcgaggggtgcttctctgctcacgtttggcgagtgcctctccgagcgggtgacattggagcaggtgctcagtgaagcgtgggatgggctgtgaaggagccggaagagccctccaggcaaagcagatggaaccgaagaggcccaggcgtaggcactcaggtgactctcagtgatcctggttccaaattccacatgacaaacaagccaattacaaatgtgcctgatgcatctgtaatatgctctatgtagttactattgtcaatacctaacctggtagagctgctgtaataaagtatcacaaacagagcggcctaaacaacaagagtttattgcctctcagttcaggaggccaaagtctgagactgaggcatcagcaggctgggtccttataggtcgtacaggtccttcccagtccttactttagttgacatctgctgcctttaattcatttcactcttcctctttggaagccttcttcgctcttatttttaggtcactacttagtctttcctgctaatgttatagcttccccctccctggatcctgcattggcttctcttcctgtggtctggggatttcacgactggtttagttgtgtttttttttttttttttttttttgagttggagtcttactctgtcacccaggctaaaatgcagtggcgcaatcttggctcactgcaacctctgcctcccgggttccaacaattcttctgcctcagccttctgagtagcagggactacaggtgtgcactgccatgcctggctaatttttgtatttttagtagatacggggtttcaccatgtttgccaggctggtctcgaatttctgacctcaggtgatctgcctgccttggcctcccaaagtgttgggattacaggcgtgagccacacacccgcctggtttaccttttttgttgttgttgttactaaatatttctaaactccctgagaattctcatatacctctcaatttcaacaacagtaggtctcaaacccagatatcattcacaaactttttattagaaaagtaacacatgcttggtgtaaacatatcatagtacagacaaagtggaaagtgaaagctccttctcagccctcttctgagagagccatttacaatagtctgatgaacaaccatccagactttttttaatacaatagattgttatataatccattcatctgtccatccatccatccatccatcatccatccctctattttccatccgtcaatccatccatccatccatccatccatccatccatccatccatcaatccatccaagggagtatcagagctttgtgaacatatattggttgctaattatggacaaatggatttcctgtatatgctgatctgggtggtatttatatcagtaatgtgaatgaagacctatgtgattttcatgttgcatttgtaatacattgttatgtagtattttaaatgcctagtctgttagagctactgtaataaagtatcacaaacagagcagcttaaacaacagaaatttattgtccctcagttctggaggccagaagtgtgagattaagatgctagcaggctgggtccttctgagggctgtggggaatctgttcatgcttctctttggcttctggtggaatgtcatcttgctgacacattttgccattccttgacctgtagatgcctctgccacaccattgcctttatctctacgtggtgtcttccctgtgtctgtgtgtgtctttctccatgtcccaagtttccctgtgaaagaacacaagtcatgttagatttgtaacgacctgatcttaactaattacattttcagtaaccgtatcaccaaataaggtcacaatctgaagtactggggcctaggacttccacatataaagtcttagaggaaacaattcaatccataacaccctatctattgaaactagaaccataatataaatatttttctgtgatatccttttttcatttatcatggataaatttccatgctgatttgtgtagatctatcgattggggcataatatcccatagtgtgctttaccataatttatttaatcaaatcatgcattttgggataactgttcttttccactattacaaacaactctgcaaaaagcacatttgtatatatagttttatgcatgtgtatttgctttgagataggtatctataagtggcattaatcagtcgagacttttatgcattttatgtgttaggtacagccatacatgtggctgtgtgttaggtatagcctatgggttaggcatagcctgtgtgttaggtatagcctatgggttaggtatagcctacgtgttaggtatagcctatgtgttaggtatagcctatgtgttaggtatagctacatttttttctctcgaactttgggtcctcatctctggctgcatattgtgtactgcctgtctcaatactgctcaagggtcacacatgctgagcatttgcaacattggtttaattatcataccccaccttccacccccgttctctgacctgctcctgccctcttcctcctgcctcattgaatagtggggctttccaggaggctgctgagtgagtaaacgggggacggtcctaaatgctctgctttcggttccctctaccactcatcactacaccagagggaactttttaagatgcaaatttgaaaatattgaccctttgttcaaaaatcttcaaaagttcttctctgcagtcagagtgacatcttagcttggcacacaaggctgtccctgatactgccctctctcctgccataccttgcactccattttgagtcatattggatgagttttgttttgctgttttagagatggggacttgctatgatgctcaggctgaatttgaattcctgggttcatctacagccataccacccagagtgcctgatctcatctgcactcctgggctcaagcaatcctcccgtctcagccgcccaagtagctgggactataggtggacatcactgtgcccagctatgaattagttttgaaacatcttggtggttcttttaatcttccttattcttgctactcttttccttttgcctggaaggttacccccactttcccactttctactatccatctaagaagctcctacttattttttaattactgtgatcctcattttgtccatttaaaagcagggataaaactaacattcccatcttgaggttgtgatcattcaatgagataaccctgtttaaagtcgtcatccatgtcaagcacacaataaatactcaaaaaatgtttgatcttcttcttcagattccttccttccttccttccttcttcctcctcctcctttctttctctctttttctttttctctttctttctttctttctctctctctctctttctttctttctctttctcccttcccttcccctcccccccccctttccctttcccctttcctttccttattttcctttcttttcttttctttttttaagacagggttttgctctgtggctcagactggagtgcagtggtaggatcatagctcactgtagccttgaactctcctgggctcaagcaatcttcctgcctcagccttctgactagctaggactacaggtgtgtactaccatgcctgggtaatgtttaaaatgtttaaaattttttatgtagagacagggtcttgctatgttgcccaggctggtctcaaactcctggcctcaagtggtcctcccaccttggcctcccaaagcactgggattcagttttcattatgagacagttttgtgacataggcaggtagttaataaataaaaatccccaaccaattaacttaatacagtacatggcaagatatccgtgcttggtaaatgtagagctcagttaggtggattggttgaaatcgagatgtcaatcacattcctctaatccaaggattggttggtgggacatggttgtttgattctttaaacattttattatgtgttcagtgtaaccgttgcttaatagttaccagcattttcacaatttggatatgacgttttcttaacaaaactgcaccgtctgttgcaatttctactactactgtgtagtgctccccaaacatctgttgaataatccattctactcctttttggaaatagtggtaaagcctgcataactttaattacataatttaaaaaatattttctcttttcctctttgaagaccatccccattctactagaatgtccctggcctttgccaggaatgctactaatcccttctgcatgttaattaacaacaaccctctgatagaattcttaccggggatgagagcttagtagaagccactcaaaacttgctttgtttttgtctgtctctcttgggcttcatttgcctattagtcttacttactgtgtcttttcagtttgactcttccttaattgggaagatagaaaccagtggatggataatcactttttcctgctggtcatctgttcatgctttactgtctgaatacactttttctgtatttctatttttcctgcctcgtagacaccaaagagcttaaaaaacatgccattgccaaggactctggcaggaaggaggcaatcacctgcgctattcctggcttcatggaatagaagcatctgtgctcctaggaattacgccaccagtgattttagagctcttatgctcttcctgggtgatagaatgggcttaatttgactcaagaatagtacatcaaaactcttaattccatcgagattgatgcatttttggggttttatgctctaaaaggccttttgctgtgcagaaggaagagagaggtggacagaaagggcagtggggagaagatgagactaaaaggtggaaagtccaggtctggatccctccccaccacacacctgctctgtggccttgagagaaacatgtaatttttataagccttagatttctaatatgtaaaatgtatgtaatagttttagctgcactccttccttgccaggttgatataataatcaaataagactggtctctgggtcaggcacagtggctcatgcctgtaatcccagcactttgggaggccaaggtgggtggattgtctgagcccaggagtttaagactgcagtgagctgtgcacttggcctgggtgactgagcaagagcctggctttttctatttatttatttatttttgagacagagtctcactttgttgcccaggttgaagtgcagtggcaatctcggctcactgcaacctctgcctcccaggttcaagcaattctcctgcctcagcctcccaagtagctgggattacaggtgcccaccaccaccctaactaatttttatatttttagtagagatgggctttcaccatgttggccaggctggttttgaactcctgacctcgtgatccaccctcccaaagtgctggacctcccaaagtgctgggattacaggcataagccactgcacctggccttatttatttatttatttaggcagggtctcactctgtcacccaggctagagtgtggcagcgcaatcatggctcactgcagcctcgacttcctggactcaagcgatcctcccacctctccaacgtggttgagggctgcagcgagaaagatgtgaaaggggcatttgggggcgcaggaaggcgggaggtggcaattgctaagggccccgccgtgttcctgtcacagccctagctacagcttagaaggtcacaatggacgttcacctgttgtctttgatgtttaaatcagcaccgacttcccatgaggaggatttttttttcctgtctctcttaaaaaaaaaaaaaaaggcccctgcagtgtgggtgtctgcagtgttacggggattattagttgaggataaccactgggatgtgtttctggaagaagtggtgctgaggagcactcctggccggaggaaagctgtgtgaggaggaggaggagtatggggtaactggctcagtttgccttggctctttctgtcggactcatacagcaaagcatctgctgagacatcatttgtgtctcctgtgacagccagagacagcaggtcttgctctccccagatcatatctgagatgctggctcctgctctctgagctgaaggctgcagctgctgagagaggacgaggcactgagtcaaagcagctgcacaatgttggggaacagctgggtactgaggactcttctccctgtccttctacaggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggagtaagtcctttggtttattacagcaatgagaacacatggtggccaagggtggagggacgtttaggcagagtggccacaagataatctgtatcttagaagtgaggtgtcttcttagtgtttgccttgttacaggatcatgggactgggaggagtccttccagatgatatagatgtaggaacttgagtccttaccatcacagttttctgtaccacaaaacaaggagggcagtatgacacttacattttatggaaatgtagggaaaggcacagaatttggtaaatcaatgaacaaaccactgttactaatttgatctgtgcaatgcagtggatttgaaaaagagagagaagaataattaccagcatacaaggctgcttgaagctagttagtcctgtgctcctgtgctttttttttttccacctgaaacaagacaggctaagatgctaaaatcttggggagctagggggatggttaaggggacattttctttaaatcaccccctttttgcagattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggtgagtgtgctctgcagagatgcccgtggtgggactctgagttctcaggaaacgttgactgttatcaaaatccaggatggctctcgcttcatttgcagccactcaagattaggttgggcctgggtcagttgtggtggatattttaaaatagagaatatggggttaaactacacattccacttcactgagatggttagaatcaccaaggctaagctggatttcacccacattccccaaagaaacacaagccctcatgcgatcatggccaaggaggattctgttctacacaaggaaccgaacttcgtagaactcgtctatgggtcatccaaattggaagggtctttacatagtggggatcttgttgttttgtttctgaggatttattttttttttccttgagacagagtcttgctctgtcgcccaggctggagtgcagtggcatgatctcggctcactgcaagctccgcctcccgggttcacgccattctcctgcctcggcctcccaagtagctgggaccacaggcgcctgccaccacacccggctaattttttgtatttttagtagagttggggtttcactgtgttagccaggatggtctccatctcctgacctcgtgatctgcctgcctcggcctccccaagtgctgggattacaggtgtgagcctccgtgcctggcggtttctgaggatttctaaatgggaaaagagtgctccaggaatagcaagatgggaaattacacgaaattcgacagtgtgtcaggatattgccagcccacctctgtgatactactgaggtagtcgtctcctctctagcaagagcttcctggcgagtcccacggttctgtcagccgtgatgattgcacttttccctgaagacgttttcactgcttggctttaaggccaacatgctctcctgggttttctcctatttcatcagatccttctactcagtctcctttctggcctcttcttcatcatcctgacccttatgtgttgaatcctcagagcttagtcgctgggctaatttttcttccctacactttctccctcatttaaattatctggtcttctggcttcatgatatgtgtgctgtggcctccagattatatgtccataaattctgtgtctccgtgcttggctgatctttcttcttgaaggtttaataaacctctcaaacgtcacatctagatccacacccttgctactctcttctacccgaaacctgattcttccccatttcagtcgatggtcacttcctccaagttgctcgggccaaaacatttctggttctgtcgtcactgtctctttttccttataatcatgtccaatgtgtcagcacatcctgtgagctctgccttcccagcttggccactccctgaccacttcaggccagcttcacggcttcttccttggctcaagccaccatcacctggtgtctggattgtcatggtggcattctgacaggtcaccctgcatctgttattctgattttagcagacaagggattcagctaaaacgtaactcgcatcatatcactcttgtcaacatcgtcttcttatcactttcataatcagagcaacaaactcatggtggcttccatgccccacataatccagcctctcctgcttccgaagattccgcttctcccaacccttgcttattctgccccagtacagtgatctccttgctgttttgcaagaacactgtcatctctggatttttgcacttgcttttcttctggcctagaactctctccccttcagtatccacctgcattattccctgtaccttcctaaattctctgcttaaaggtcttctctgcgaggctgtctttgactattctactgaaaatagaagcactttttcttctcttctcattctcctctgcagtgtagcacatcttatgtgctatgtcattttcttgtttatttattatctatctctgctcccaaaatataaattccattagtccagggacttctgtccatattaatgatctcaaggctgagaacttgttggaatgcaggtttgaataaatacaagtttgaatcagccttgcatccttgtgccaacataatggagcacatttgctgcaggacaagccaatattcccagagctaagagagatgggggaacaaacaaaggattggtcaggtcaaagctggggacactgctacatgtagcatcactgacctagccctgagggacattctggacccaggctgagggacaggctcaaaatagattgaagaatccatgaatgcaatcaacccgttttctcaggctgcgataacaagctgctttagactgtgtgactcaaacacagatttattatctcacaatactggaggctagaaagtccaaaatcaagtctctgatgaatttggttgctggcgagagtcctcttcctgatttgcagatggctaccttcttgttatgtgattgcatggagggaggggaggcaagggagagaagacaggggagaaagaacaaactctctgatatctctcctgtaagggcactcaccccatactgagggccccaccctcacaacttcatctaactctaactacttcccaagggcctcacctttaagtaccgtacattaggggttcgggcttcatcatgggaattgttaaggaagacaaacattcagtatataacaccaccaaattgagatggttataaatggtgcaggacaaatgggtggatttattagttaagttgcaagggaaactttattaaagaggaggaagaacttacatcgaagatgtgagaggcatcctgggcaaatgcaatgtgtagaattgatcaggttagtgactaaatgaacataaggtaaaaaaatttacaagacagttgaggaagcgtaaatgctgactggacatacagtgatactaagaaattattgttaaacgattttggtgtgatagtgacattgtaattatattttagtgtcacaaagtgaattattgatagatgcattaaatgcagtatttaaaataatccatgggtgggaggagtgggtgggcaatagaagaaacaagttgacatgacctgtttaattgtcgaacttgggtaatggacacagggggttcattatactattttctatacttttatgtatgcttaacattttcccaactagatagttaaaaatataacaggaaccacattgggcacttagagcttttttttttttttccccacatttttattgggagccgtgggaggggcctcctctgtcattggaggtgctcacagtttcttcagccactccaggctggggtcctgggggtctgaggctcccagtgacgaaggacacgacgagcaccggctccttggcccaggcattcttgaagaaggtgcggagtctcgcggccatcttggtctcggcggcggcgacggcggcgaggacgcggagcactctgggagttgtggtccctcttttttttttttttttttttttacattttagaagtgtgtggagtttagggaaatgaagagatgagacttttaaggttaacgactctgacagagttatctgaagagtgcaacccaggctttctatttgcttttacaggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaa

SEQ ID NO: 578 - DNA, 32949 bp, Homo sapiens; identical to SEQ ID NO: 577

SEQ ID NO: 579 - DNA, 31056 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggtgagtggaaggaagacttttaaaaaaaattgtggccaagtgcacatagtgtacaattttccatctttatatatatatatatatatatttttttttgagacggagttgctcttgttgcccaggctggagtgcaatggtgagatcttggctcactgcaacctccacctcccgggttcaagcgattttcctgcctcagcctcccaagtagctgggattacaggcattgcacctccacgcccggctaattttgtatttttagtagagatggggtttctccatgttggtcaggttggtctcaaactcccgacctcaggtgatccacccgcctcggcctcgcaaagtgctggaattacaggtgtgagccaccgcgcccggccgtaataatttttaaatgtacagttcagtagtgttaggtacactcacattgtgcaaccagtctccagaactgttttcatcttgcaaaactgaaactcctcacccattgaatgataactcctcattgcctcattctcccagccctggtaaccaccattctatttgccatctctgtgaatcttactactctgggtacctcatataagtggaaacatacagcattttttcctttatgagtagtttatttcactcagcataatgtcctccgggttcaactatgttgtagcatgtgtcggaattcccttcctttaaaaaagactgtataaatactccatggtaccatataccaaattttgtttagttatctgttgatgaacacctggattacttctacctttttgttattgttaatgctgttatgagtgttggtgcacaaatatctcttcaagaccctgctttgaattctctggggtatatactcagaagtgaaatttctgaatcatacggtaattctgttaaatattttgaagaactgctctactgttttagataccatctgcaccatttcccaccaacagcacacaagggttccaatttctccatatcctaagaacacgttatttttatttattttttcttttttatagtagccattctaatgagtgtgaggtggtatctcactgtagttttgatttccgtttccctaatgataagtgatgctgagcacattttcactgcttgttggccatttatagagcttcttcagagaaagttctgttcaagttcttttctcattttcagaccaggtttggcttttgttgttgccttgtaggagttctttatgtattctagatattaaccccatatcagatatatgatttacaaatattttctcctattctgtgggttgtcttttcatttggttaactgtgtcctttgatgcacagaagttagtatgatttttttttttttaaatcatggccgggcatggtggctcatgcctgtaattccagcactttgtgaggctgaggtgggtggatcacctgaggtcaggagttcaacaccagcctggccaacatggcaaaaccccatctctactaaaaatacaaaaaaaattagccgggtgtggtggtgggcacctgtaatcccagctactcaggaggctgaggtaggagaattgcttgaacatggggagtggaggttgcagtgagctgagattgcaccacggcactccagcctgggctaaagagcaagaccctgtttcaaaaaaaaatttttttttcttgtattgtcttggttttttctcttttcccctctcacggtagtgctatgagaaggtggaggcaaactgtttgctttctctaactcctttaaaaagctgatgcagactgtacctaccccctgggcacctgccatgattagtccctctttatctgaatctcagcagtgcctagacctgcctccaattctccatccagcttctcagaccacatgttttgtccagtatctgctgtgtggtcagcaggcttgggcctctgcttcctatggcccagagggcagcctctctccttgaagaaccgtggagtttggggcagaagcctttcctttcaccaccactttgggaattggaatgtaaaagaaattctcttaatccccatgtacacattggggataaggttctttcttttgtcttgtgttctaggcaaaggtagggctcagagaagggcagggtattgcaggatgatgatgtagagctggtggtgatgggaaggaggagtacaaatgagtcagtggatagggagacacatgttaaggcagggcagcagtgtgggtgtaatgacactggggaaacagacagcagtgtgcagccgggggaggtcagaaaccagttgctgcaatggctctcacctgtagtcccagctactcaggaggctaaggcaggaggatcgcttgagcccaggagctcaaaaccagcctgagcaacatagggagacctcatctctaagtaaataaagcaattatcattgtgtcagtacttatatactcacatacccaaatgaaagtgtcataatcacaactgtagaagtactttgctaagcagtttttatggattttatggcacattcaagaaacccatgaaacagcttctggtattatccctcctgcaagtgaatgaggtgagcctggaagagatcctaactggcccatggtttatttctagccataaccagagctggggtaaaaagcagggcatgtctctgatcaaagcctggctcttaaccactacaccgtctttgcttccatatctggattttgaggcagaaaagttataactagggttagaagtttgtttgtttgtttcctggggtggggttaggttttaggtaatagactttggctaatttactgtcatggctcctacctgagtcccagttactcaggtggctgaagtgggtgcatcacttgagctcaggagttccaggctggagtgagctatgaccatgccactgccctccagctttggaaacaaagcaagactctgtctcttaaaaaaaaagaataagattttggttttggcttagattttttggattttattttgtgatatggttaccaagtagacagctgtcagaggtcttttatgggctgggcgcagtggcttatgcctgtaatcccagcacttcaggaggccaagatgggaggattgcttgagcccaggagtttgagaccagcctgggcaacatagtgagaacctgtctctacaaaaaatgcaaacattagttaggtgtggtggcacgtgtcaatagtcccagctgttctggaggctgaggtgggaggatcacttgagcccaggaggttgaggctgcagggagccatgattgtgtcattgcactccagcctgggcaatagagtgaggccctgtctcaaaaaaaaaaaaaaaatcatttatgttacttgtagattcctgcccacctgaagttatctgtcttatatatttcccctagtgactaactcttgttttacctaacctgaatttctcctatagaatgccttcttaagatatgctatctagtgactgtttggatttgtgattctcaacacagatgcatgttggaatcacctgggagcttttagtatgtgatggttcctgggcctcacctcagagggactgaaaaagaacctctgggcgtgcagtcctgaagtccatatttttaaagcttcctgggtgattctaaagtcagccaggattcccaaccactagattaggcacgaaatagactggtcgttctcactcttgaagaaccagacatctagacttgacaatagaagacgtgtgtaaaatggattgcagggaactgcggtcagggaagggtgacctttcttagcccacagccgtgttggggatataggagagcttggagatgccctcacaatcaggctgccaggggcaggcaaaagcaaacgagggtaaaagaaacttagcctgcttcgcatgtttgctgattgatttccaggcctgaggaagagattctgagactggggacagtgggaacacatgcttggcaggtggacagcagaagttgttttgaaactaggagtgcagaaatgctcccaaccagacttttgactggatacctgtcctctgcaactcagagccatgttttgatttgggggatgtttggggtctcctctctcatgccaaatattaggccaggtttcaattgcatcctctgtgataatagttctgggttttgacaccttttttttcccttttaggttcagataatgcacgtgtttcgaatcccactgtgatatgccaggaagacagcattgaagaggagtggatgggtttactggagtacctttcgagaatctctatttgtaaaatgaagaaaggtaagcgactggggtggtgcttctagttgagttttaagacctggttcaggaggctctgggaagctgagcagctgggtaacttggccatactataggttcctgctctttggaatgcaaaggcctgtctcaggaaatccattgtcagttgaagaaacaaattcatgtttgtgtggctcttgcagtcccagagccagcggcggtgattaagcgtttcaagtttgataaggcataggatgcagattacttaaaggaataagattgattcaaatgatctttgggctggtagctacacatagagatgggccttctgctcagctgtgtatcttaaaaacttgacaccagagattctcggcacctttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcgcttgcctcctctcatctcttttcaactatcttccaaatactgttgccacagctacatcataatgccaccactgtctgtttgagactccttcatgagcaaagattgatgtatggtaggtggataaatgggatgaggaaaaaaaaaataaaacaaggaacaaatgtttggggaatgccagtttagcacaaggtattaagtaggatgtaggattgcctacaaatatttgtcaactgaaatttcttgtaagctacttggagcactagtgcctaagagtcagtcaatgtctgtggggcagaacaatgccagagagtctgtgtcccaggagcgaggggacagagggcctcagagctggaggctggggggatgtttcttagaaatgtgcaatctaagcctcctttaaggaatggtgggacctgggcgcatagagaagaaattaaaggaattctgcactgaagactggtatgagccaaatcatgaatgcagtctgagaaaaagtgtgtgcaggtgacagtggagagagacacagtttccttggaaaaaaacatgatgaaggtaaatcaagggaaatagagcagaaatgtggagaccctctttctaggcccccatgttgctctgcactgggcattgccaaaaccccgttttcgggtctgttcacacacttgctgggtggttggaagctagtggccaagtctgtgcaatgaagtggttgagtcacctgacttctgagtcccttttgggtttatcgttcagtgcctcctgcagaaggaccacccacagtggttgtaggaaggtggccaccctgtgatgtgtgagtttagcctggatagaagacacttgacgtggggcaaaattaagggaaacaggaggcttggcccttccacaggcaacaatgagtttcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtgggtgtccccgctcagccagcttccggaggatgggcagtgagagagtgagagaaggaaaggggcagccaggctgggggcttacggtgttgagagagagggcaggtgtgggaaagcagggtacggtttctacggcagcaaacagttccgagtgactggaaaaaagacagttgtcttcattcatcaggttgccataacaaaacactgcaggctggttggcttataagcaaaaggaaggttcaccttacggttctggaggctgggaagtccatgatccaggctctggcagatctggtgtttggtgagggcctgttccctggtcgatggtgccttctcactgtgtccttacatggtgaagaggcaaggcagctctctggggtccctttcctaaggacagcaatcccactcctgagggctccaccctcataacttaaccacacctcaaaggccccatcgcctgatacgtcatgttgagggttaggatttcagcgtatggattttggggcacacaaacattcagaccatagaaatgggagaagaagagtaagacagagagaaaagtaggcagaactactcattaagagtgaggtggaaggtggagagggcagggagaccttatgaagatcacacatctgtgaggaaggtttgcacactctcactgaagccccggtaggaggctcagcacccatttctctagatagcaccttccttcctctgaggacagattctgactggagccctggtagggggctcagcacccatccctctagatggcacctgccttactctgaggacagactctcactgaagccccggtaggaggctcagcacccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctctgaggacagactctgattggagccctggcagggggctcagcacccatccctctagatggcacctgccttactctgaggacagactctcactgaagccccggtaggaggctcagcaaccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctcaggacagactctgactggaaccctggtagggggctcagcacccatccctctagatggcacctgccttactctgaggacagactctgacgggagccctggtagggggctcagcacccatccctctagatggcacctgccttactctgaggacagactctgactggagccctggtagggggctcagcacccatctttctagatggcagctgccttactctgagggcaggagcttgctttgtatgttccagtcccttctgagaaccagaagcctgagcatctattagaaatgcaggattgtggacccaatcttagacctagagagctagactttgcatttgaatgagagctacaggtgattcaaaggtgactgcatgtgtgggtgcagtggctcttgcctgtaatcctaggttttgggaggccaagatggggggattgcttgaagccaggaattcaagtcctacctgagcagcaaagtgagagcacctctctacagaaaaacaaaagcaaaaatgtgactgcatgttggagccacctggctttttttaaataaaaaagatccatatagctggacacagtgactcgtgcctgtaacctcagctactcgggaggctgaggcaagaggattgcttgagcccaggagtttgaggctgcagtgagctatgatcatggcactgcattccagcttgggtttcatctgaaaaaaaatttaaaaaattcatctagttccacctcagagcttctgattttatttccatggatgtggcctgggcttgcgattttctttttcttttttttttttttgagatgaagtcttgctctgttgcccaggctggagtgctgtggcatgatcttggctcactgcaacttccacctcccaggttcaagtgattctcctgcctcagcctccctaatagctgggatgacaggctcgtgccaccacacccaattaatttttgtatttttagtagagagagggtttcaccatgttggccaggctgatcttgaactcctgacctcaggtgatctgcccgcctcggcctcccaaagtgctgggattacaggtgtgagccaccatgcccagcctggcctgaggatttttgtgagcactcctgatgctgttgtgtagccaggagtgaggactgccctctgatcacccagcacagaacgttcagggccatgttgggacagtggactggtaagggcgagaggaggacactggggagcaggctgtagggtgccacagtccgccacagtcacaggctcatgctctccgtccgagaggaggcagaactgcttttaccaaggctcatccagccctcttcatttctctgggaacaatttttggtttcgtgacccatttcttaatccccggaaggcatttctctgaactggtgccaggcaccccggcccccagctccagttagttattattcgaggctgatttcttttctgtctgtcttccttctaattcctagattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggtgagtccccgtgcatgtgatctgtgtgagtgcaagttcatatgagagagagagagagaaacagactggagaaagatcttcaggaccaggttgctggtgtggtttctttcttttctttttctttttttctttttttgaggcagagttttgctcttattgcccaggctggagtgcaatgccgtgacctcggctcactgcaatctctgcctcctgggttcaagtgattctcctgcctcagcctcctgagtagctgggattacaggcacccaccaccatacccagctaattttttgtatttttagtagagatggggtttcatcatgttgtccaggctagtctcgaagtcctgacctcaggtgatccgcccgcctcggcctcccaaaatgctgggattacaggcatgagccaccgcacccggccggtggtgtggtttctgctgtaacaaagtgccacagactgaatggcttcaacaacaaaaattcattttcttgcagttctgaggccgaaagtctaagatcaaggtgtcagcagggttggtttcttctgaggccgccctccttggtttgtagatgcccccttctccctgtgtactgatgccatcttgccttggggggaagagtggcctagtctcctcttcttacagggacagcagtcctgatggattaggcacagtcaggcatgactacacaagacctaatgttaatctagtcactcctttaaagaccccatttcccaaaacagccacattatgaggtcttgaggattagggcttcaacatgtaaatttttgggggggcacagttcagcccagaacaagtgagaaggtagaatgggttggaggccagctggggaagttttgtgtggggaagaatgaatgaggaactaaaaaaaaagtcatttcttgaaacaaccatgatgctcgatatattccatttcctcatgggccatgttcatagatgagagttggagaatttgccatttacaacaatggcaacctcacctaaaaactatgaaaatactttttttttttttctttgagacaggacctctctctgtcacccaggctggagtgtgtgatcacagcttactgcagcctcgacctcccaggctcaagcaatcctcccacctcagctcccccgagtagctgggactacaggcatgcaccaccatgctggctaatttttgtattttttttgtagagatgtggtctcatcacgttgcccagcctggtcagaatgctttgtatgggttgaaatgtcacagggaatctcctgtgactttattaataatgtgcttgctcacacctgtagtcccagctactcgggaggctgaggcaggagaactgtgtgtacccgggaggcggagatggcagtgagccgagatcgtgccattgcactccagcctgggtgacagagcgagattccatttcaaaataataataataataataataataaaaaatgtgcttgctttctcccacaccatgaatcagattcacacgccccaccgcgctggtgcctgggccgcctcactagctctgtttcattccctgctctgtggacgcatgcaggcgtctgcatttttgaggagctgcacagcaagtgttaaagtccgccactctaggacattttgctacctccctctccggctcaacacactcaccttgtcaccagtcttatcaatttttcctcctacccgagctgttttccacttttcctcgtcctcaccccaccagcccaggtccagcaactgtcaccacttgcctggacacgcagtgacctcctagaccatcagctccccggggatggggtttgcgtttgtttgtcttgctgtcatctttgccacgcctggacagacatcttagtacccatcagtggtcaaaagcacgcactgaatgaatgttggctctttggtctccctgtgtctgcctttttccctcacccgaccattctctgcacaaaagtaagatggtcctttagaaaattctgattcgattgtgctgttcggtggcttaaatgctttctgtctgctctgctctttattttttactttatgtatttatttttgtagatgtagggggcgcaagagcagctttgtttcatggatatgttactgcacagtggtagtgtctgggcttttactgtaactacccctttttttttgagatggactctcgccgtgttgcccaggctggagtacagtggagtgatctcggctcactgcaacatccacctcctgggttcaagcaattcttcgagtagttgggattacaggcatgggccaccacgcccagctgatttttgtatttttagtagggacaaggtttcaccgtattggctaggctggtctcaaactcctgacctcgtgatccacccgcctcggcctcccaaagtgctgggattacaggcgtgagccaccgtgcccggccttagtgtaactcttacccaaatagtgaacattgtacccaataaataattttccagccctcacctggctcccaccctcccacccttctgaggctctagtgtctatcattccatgctctatggatgttaccctttgtttagctcccacttgtaagtgagaacgtgtggtatttgactctgtttctgagttgtttcacttaaggtaatggcctccagttccatctgtgtggcttcaaagatgtgacttcattcttttctatggctgagcagtattccattatgtatatagatcacactcttcatctttgctcttttggtaaatttcaaatcgtagtgccatggagactggttgtttgggacatttaaccttatttctccaacttcatgcccaaattctctccccactgccattgcccctgtatgattctggagaggcagacacaaacagggaagggtaggggacagtgagatgcttcgcagagaagtagagatccatttgtccatttgcttgaagttggtgtaaggatagggacagaaaggaaggtggtctaacaggctccaggacctatgaactattgccctggaaagaagctagaatgttgttcttgcccccatgacagggataaagtatagtttttgttgctggtggtggtggtgacggtggtagtgatgtgcgtgtgtgtttgtgtgcatgtgtgtgacggggaaactaatcaagaatcagagctgcagcgggatgtggaatcccagcactttgagaggctgaggtgggcagatcacctgagcccaggagttcaaaaccagcctgagcaagctggtgagaccttgtctttagaagataataataataataaaaataaaatataaataaaataaaatggctaagcatggtagcacatgcctgtatttgcagccacttgggaggctgaggcaggtggatcccttgagcccaggagttcgaggtggcagtgagctatgatctcgccagtgcactccagcctgtgcaacaaagtgagaccctgtctttaaaaaaagaaaagaaaagaaaagaaaaagaatcagagctgcttttcctttcaatatagatggagggctgggatgaaatcgtcaaacacaatggggtgacaatgttggtgaagacaagaaatagctgagtgcagcactggcgagggcagtgccgactgcgggcacgtcaatggttaggaacacgagggaaggaggtgggtgcacaggcccacaccgcccgcttcacttacaaaccaggagcgcaccattcacatgtctggggggtgatctcaatgcacccggcactgtttacggccgggagttcactgacaggtgatccctctgctgtgactggggagactgggggctgacctcccaatgtgccttgtgctgtattccggagctctctggtcaggtgtattctgatgctttctctattccagagctctctggtcaggtgtgtcctgatgctttctctattccagagctctctggtcaggtgtgtcctgatgctttctctattccggagctctctggtcaggtgtgtcctgatgctttctctattccggagctctctggtcaggtgtgtcctgatgcattctctattccagagctctctggtcaggtgtgtcctgatgctttctctattccagagctctcttgtcaggtgtgtcctgatgctttctctattctggagctctctggtcagatgtgttctgatgctttctctattccggagctctctggtcaggtgtgttctgatgctttctgtattccggagctctctgatcagatgtgttctgatgctttctctattccggagcttcctgatcaggtgtgtcctgatgcttcctctgttctggagctctctggtcaggtgtgttctgatgctttctgcctctgttcttggcatgaaggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggtgagtcgagcccgttcccctaaggaagttctgccagcgaggcgtgctgcgcactctggcttcagtgaggcccggtgggctggggtttgagtgagaatggccttggcggctcgggtgactgcgtgtgcttgtcttggggtgtctagcattgcggtcagtgagtgtttgtcgtggggaaagccacacactcaaccctgacaaggagcataaataataacaaaaagaagatgtctgcctttagggtgcctactgcctagctgacaaaaagaaaaaatcagtgtaatgcattgctttagaggagttttagaacttcatgacaagccctgggtcctcatattgtataagaaaaatggtgctaaagcaatgcagaccctcgatgttgtatgcagcccttccctgagtgcttctgggagacttgcattttgaaggagagaaaaaaccacttaaaaatggaagggccatttctcacccattaggatggctattatcaaacaaaagcaagaaaactagaaaacaacaagtattggtgtgggtgcggagaaatggaagccattgtgtgttgctggtgggaatgtaaatgatgcagccactatggaaaacagcacagcaattcctaaaaaataaatacagaattactactggagccagcatttccactgctgggtatatctgcaaaagagttcaaagcaggaactcagccaggagcggtggctcacacctgtaatcccagcattttgggaggctgaggcaggtggatcactggaggtcgggagttcgagactagcctggccatcatagtaaaaccttgtctctactaaaaatacaaaaattagccaggcatggtggtgcatgcctgtaatcccagttactcggggtggaggcaagagaatcttttgaacctgggaggcgggggttgcagtgagtcaagatcccgtcactgtactcccgcctgggtgacagaggaagcattaaaaaaaacagaaggcaggaactcaaacatgttatttgtacatctatgtccatagcaacactattagaaatagccaaaaggtggaaataaccaaacgtccttcaacggatgaagggtgttgaaaagtgctatatatgtacattcagctttaaaaagaattctagtacacactacaacatggatgagcctcggggacattatgctaagtaagataagctagactcgaaagggcaaatactctgattgtccttataggaggtgtctagaacagacagattcatagagacaggaagaaacgtggttgcaggcaatgggagggcggagagtgggaagacattgtttaatggttatggagtttcagttctgcaagatgaaaggagttctggagatggtggtggtgatggttgcacaacaatgtgaagtgcttaaggccattaattgtgcacttaaaaatggttaaaatggtaaattttattttacacgtattttaccacaataaagctgaatgtagggagctgggaagatgtagtattggtgggagcttggagaatgcttacttgttattccaccaaatggaaaaggaaatcagaagtgtacatagagcttgtgtccactccctttccatgtgtaaactggagtagaggcagtggcaggtacgggtgcttccttgtccatggtggagcgtgggtgagagacatgactgacattctgccatctctatggaaggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggtaagtcttcatgggtgtcttaccagaaaagtaacttcttttcagaggtgaattatttggaaaatgtggatgggggttactttggtcaggcagagctgaaggtagagtaaggaggtaaaaacatcagaaatgctttgaaggactggaggcatataatgtatactgctgctaataagataatttatgctaatttatgattatagaactagagtttcttagtgttggaagaaaccttagagatggtgcagcccaattgcctgttgagggaaaaacttgcttccaagacactcacatgaatagtcacccattttatgtgtgcatgcttgcaagcatgcaagttatcgcatagtgcatgcagcctctacactaggaaagagctctcaccctgcagcctctacactaggagaggactcttacactgcagcctctatatcctcaacagtgtcatggctcagcaccttcacctatgtagccatgctctcccaggtacacaggctggtttgttagtgtctgtctttgaaatgtggtgcccagacctgatgatgcatggtggatgttttacctcctgttgcagagaactatggtttcactggtggaatctctgatttccttgttttttttggcagttacataagccttttgattcatgttggaattctgcagtaaacagtagtagggaatacccactaataatcatgcactttccctgtaccactttcctgtatcactttccctgtatcacctgctctttcatgttcttacatggattttctcagttggcttcagaaagatgctatagggtagggtatctgtgtctccaatttaaagaggagaaaataaaattcagggagcctcataactttgtccaaggacactcagagagaaggtagtggaactcagtgtagacaaacgtctgtgacctcccaagccactgccttaattcccagtgcattgccttaggagatgttgctaatgggctctctacagggcttcttcatctggctctcagcttaagggtgggacctccaatttagctttgctaaacctcatcttacctgtcttttgacccattgactaggcagttttgaatcttcattctgacaataatatctacaaatacaataagcaaattggataggtcttcattcattcacattattaatatatataccagccagatcagcattcaagacaaaatttggcaggaaaggtcttcccagaggagtaatccactaatccataattaacaaccaacctctgttcacaaagctctgatacttccttggacctctcccatcagccaatcctcagatgtgaccatatctctttctatgaagtcttcctgcagtgccttcatttcctcgccttagggtattacccttccttagcaaatcgccttagaatattactcttccttggcaatttgacttctgcttctctaagtttgttcaacagacatgattttgtcccttcattttgcaggccctctgggggctctgtggtgggcactgacagcagcagtgagtaaaacagaccaaaatcctgttttcacaaccgttcttttagggaagtgataacagataatagacatgctaaacaatataccctgtgtataagagctataagaaaaactggagtgacggcgaggggtgcttctctgctcacgtttggcgagtgcctctccgagcgggtgacattggagcaggtgctcagtgaagcgtgggatgggctgtgaaggagccggaagagccctccaggcaaagcagatggaaccgaagaggcccaggcgtaggcactcaggtgactctcagtgatcctggttccaaattccacatgacaaacaagccaattacaaatgtgcctgatgcatctgtaatatgctctatgtagttactattgtcaatacctaacctggtagagctgctgtaataaagtatcacaaacagagcggcctaaacaacaagagtttattgcctctcagttcaggaggccaaagtctgagactgaggcatcagcaggctgggtccttataggtcgtacaggtccttcccagtccttactttagttgacatctgctgcctttaattcatttcactcttcctctttggaagccttcttcgctcttatttttaggtcactacttagtctttcctgctaatgttatagcttccccctccctggatcctgcattggcttctcttcctgtggtctggggatttcacgactggtttagttgtgtttttttttttttttttttttttgagttggagtcttactctgtcacccaggctaaaatgcagtggcgcaatcttggctcactgcaacctctgcctcccgggttccaacaattcttctgcctcagccttctgagtagcagggactacaggtgtgcactgccatgcctggctaatttttgtatttttagtagatacggggtttcaccatgtttgccaggctggtctcgaatttctgacctcaggtgatctgcctgccttggcctcccaaagtgttgggattacaggcgtgagccacacacccgcctggtttaccttttttgttgttgttgttactaaatatttctaaactccctgagaattctcatatacctctcaatttcaacaacagtaggtctcaaacccagatatcattcacaaactttttattagaaaagtaacacatgcttggtgtaaacatatcatagtacagacaaagtggaaagtgaaagctccttctcagccctcttctgagagagccatttacaatagtctgatgaacaaccatccagactttttttaatacaatagattgttatataatccattcatctgtccatccatccatccatccatcatccatccctctattttccatccgtcaatccatccatccatccatccatccatccatccatccatccatcaatccatccaagggagtatcagagctttgtgaacatatattggttgctaattatggacaaatggatttcctgtatatgctgatctgggtggtatttatatcagtaatgtgaatgaagacctatgtgattttcatgttgcatttgtaatacattgttatgtagtattttaaatgcctagtctgttagagctactgtaataaagtatcacaaacagagcagcttaaacaacagaaatttattgtccctcagttctggaggccagaagtgtgagattaagatgctagcaggctgggtccttctgagggctgtggggaatctgttcatgcttctctttggcttctggtggaatgtcatcttgctgacacattttgccattccttgacctgtagatgcctctgccacaccattgcctttatctctacgtggtgtcttccctgtgtctgtgtgtgtctttctccatgtcccaagtttccctgtgaaagaacacaagtcatgttagatttgtaacgacctgatcttaactaattacattttcagtaaccgtatcaccaaataaggtcacaatctgaagtactggggcctaggacttccacatataaagtcttagaggaaacaattcaatccataacaccctatctattgaaactagaaccataatataaatatttttctgtgatatccttttttcatttatcatggataaatttccatgctgatttgtgtagatctatcgattggggcataatatcccatagtgtgctttaccataatttatttaatcaaatcatgcattttgggataactgttcttttccactattacaaacaactctgcaaaaagcacatttgtatatatagttttatgcatgtgtatttgctttgagataggtatctataagtggcattaatcagtcgagacttttatgcattttatgtgttaggtacagccatacatgtggctgtgtgttaggtatagcctatgggttaggcatagcctgtgtgttaggtatagcctatgggttaggtatagcctacgtgttaggtatagcctatgtgttaggtatagcctatgtgttaggtatagctacatttttttctctcgaactttgggtcctcatctctggctgcatattgtgtactgcctgtctcaatactgctcaagggtcacacatgctgagcatttgcaacattggtttaattatcataccccaccttccacccccgttctctgacctgctcctgccctcttcctcctgcctcattgaatagtggggctttccaggaggctgctgagtgagtaaacgggggacggtcctaaatgctctgctttcggttccctctaccactcatcactacaccagagggaactttttaagatgcaaatttgaaaatattgaccctttgttcaaaaatcttcaaaagttcttctctgcagtcagagtgacatcttagcttggcacacaaggctgtccctgatactgccctctctcctgccataccttgcactccattttgagtcatattggatgagttttgttttgctgttttagagatggggacttgctatgatgctcaggctgaatttgaattcctgggttcatctacagccataccacccagagtgcctgatctcatctgcactcctgggctcaagcaatcctcccgtctcagccgcccaagtagctgggactataggtggacatcactgtgcccagctatgaattagttttgaaacatcttggtggttcttttaatcttccttattcttgctactcttttccttttgcctggaaggttacccccactttcccactttctactatccatctaagaagctcctacttattttttaattactgtgatcctcattttgtccatttaaaagcagggataaaactaacattcccatcttgaggttgtgatcattcaatgagataaccctgtttaaagtcgtcatccatgtcaagcacacaataaatactcaaaaaatgtttgatcttcttcttcagattccttccttccttccttccttcttcctcctcctcctttctttctctctttttctttttctctttctttctttctttctctctctctctctttctttctttctctttctcccttcccttcccctcccccccccctttccctttcccctttcctttccttattttcctttcttttcttttctttttttaagacagggttttgctctgtggctcagactggagtgcagtggtaggatcatagctcactgtagccttgaactctcctgggctcaagcaatcttcctgcctcagccttctgactagctaggactacaggtgtgtactaccatgcctgggtaatgtttaaaatgtttaaaattttttatgtagagacagggtcttgctatgttgcccaggctggtctcaaactcctggcctcaagtggtcctcccaccttggcctcccaaagcactgggattcagttttcattatgagacagttttgtgacataggcaggtagttaataaataaaaatccccaaccaattaacttaatacagtacatggcaagatatccgtgcttggtaaatgtagagctcagttaggtggattggttgaaatcgagatgtcaatcacattcctctaatccaaggattggttggtgggacatggttgtttgattctttaaacattttattatgtgttcagtgtaaccgttgcttaatagttaccagcattttcacaatttggatatgacgttttcttaacaaaactgcaccgtctgttgcaatttctactactactgtgtagtgctccccaaacatctgttgaataatccattctactcctttttggaaatagtggtaaagcctgcataactttaattacataatttaaaaaatattttctcttttcctctttgaagaccatccccattctactagaatgtccctggcctttgccaggaatgctactaatcccttctgcatgttaattaacaacaaccctctgatagaattcttaccggggatgagagcttagtagaagccactcaaaacttgctttgtttttgtctgtctctcttgggcttcatttgcctattagtcttacttactgtgtcttttcagtttgactcttccttaattgggaagatagaaaccagtggatggataatcactttttcctgctggtcatctgttcatgctttactgtctgaatacactttttctgtatttctatttttcctgcctcgtagacaccaaagagcttaaaaaacatgccattgccaaggactctggcaggaaggaggcaatcacctgcgctattcctggcttcatggaatagaagcatctgtgctcctaggaattacgccaccagtgattttagagctcttatgctcttcctgggtgatagaatgggcttaatttgactcaagaatagtacatcaaaactcttaattccatcgagattgatgcatttttggggttttatgctctaaaaggccttttgctgtgcagaaggaagagagaggtggacagaaagggcagtggggagaagatgagactaaaaggtggaaagtccaggtctggatccctccccaccacacacctgctctgtggccttgagagaaacatgtaatttttataagccttagatttctaatatgtaaaatgtatgtaatagttttagctgcactccttccttgccaggttgatataataatcaaataagactggtctctgggtcaggcacagtggctcatgcctgtaatcccagcactttgggaggccaaggtgggtggattgtctgagcccaggagtttaagactgcagtgagctgtgcacttggcctgggtgactgagcaagagcctggctttttctatttatttatttatttttgagacagagtctcactttgttgcccaggttgaagtgcagtggcaatctcggctcactgcaacctctgcctcccaggttcaagcaattctcctgcctcagcctcccaagtagctgggattacaggtgcccaccaccaccctaactaatttttatatttttagtagagatgggctttcaccatgttggccaggctggttttgaactcctgacctcgtgatccaccctcccaaagtgctggacctcccaaagtgctgggattacaggcataagccactgcacctggccttatttatttatttatttaggcagggtctcactctgtcacccaggctagagtgtggcagcgcaatcatggctcactgcagcctcgacttcctggactcaagcgatcctcccacctctccaacgtggttgagggctgcagcgagaaagatgtgaaaggggcatttgggggcgcaggaaggcgggaggtggcaattgctaagggccccgccgtgttcctgtcacagccctagctacagcttagaaggtcacaatggacgttcacctgttgtctttgatgtttaaatcagcaccgacttcccatgaggaggatttttttttcctgtctctcttaaaaaaaaaaaaaaaggcccctgcagtgtgggtgtctgcagtgttacggggattattagttgaggataaccactgggatgtgtttctggaagaagtggtgctgaggagcactcctggccggaggaaagctgtgtgaggaggaggaggagtatggggtaactggctcagtttgccttggctctttctgtcggactcatacagcaaagcatctgctgagacatcatttgtgtctcctgtgacagccagagacagcaggtcttgctctccccagatcatatctgagatgctggctcctgctctctgagctgaaggctgcagctgctgagagaggacgaggcactgagtcaaagcagctgcacaatgttggggaacagctgggtactgaggactcttctccctgtccttctacaggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggagtaagtcctttggtttattacagcaatgagaacacatggtggccaagggtggagggacgtttaggcagagtggccacaagataatctgtatcttagaagtgaggtgtcttcttagtgtttgccttgttacaggatcatgggactgggaggagtccttccagatgatatagatgtaggaacttgagtccttaccatcacagttttctgtaccacaaaacaaggagggcagtatgacacttacattttatggaaatgtagggaaaggcacagaatttggtaaatcaatgaacaaaccactgttactaatttgatctgtgcaatgcagtggatttgaaaaagagagagaagaataattaccagcatacaaggctgcttgaagctagttagtcctgtgctcctgtgctttttttttttccacctgaaacaagacaggctaagatgctaaaatcttggggagctagggggatggttaaggggacattttctttaaatcaccccctttttgcagattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggtgagtgtgctctgcagagatgcccgtggtgggactctgagttctcaggaaacgttgactgttatcaaaatccaggatggctctcgcttcatttgcagccactcaagattaggttgggcctgggtcagttgtggtggatattttaaaatagagaatatggggttaaactacacattccacttcactgagatggttagaatcaccaaggctaagctggatttcacccacattccccaaagaaacacaagccctcatgcgatcatggccaaggaggattctgttctacacaaggaaccgaacttcgtagaactcgtctatgggtcatccaaattggaagggtctttacatagtggggatcttgttgttttgtttctgaggatttattttttttttccttgagacagagtcttgctctgtcgcccaggctggagtgcagtggcatgatctcggctcactgcaagctccgcctcccgggttcacgccattctcctgcctcggcctcccaagtagctgggaccacaggcgcctgccaccacacccggctaattttttgtatttttagtagagttggggtttcactgtgttagccaggatggtctccatctcctgacctcgtgatctgcctgcctcggcctccccaagtgctgggattacaggtgtgagcctccgtgcctggcggtttctgaggatttctaaatgggaaaagagtgctccaggaatagcaagatgggaaattacacgaaattcgacagtgtgtcaggatattgccagcccacctctgtgatactactgaggtagtcgtctcctctctagcaagagcttcctggcgagtcccacggttctgtcagccgtgatgattgcacttttccctgaagacgttttcactgcttggctttaaggccaacatgctctcctgggttttctcctatttcatcagatccttctactcagtctcctttctggcctcttcttcatcatcctgacccttatgtgttgaatcctcagagcttagtcgctgggctaatttttcttccctacactttctccctcatttaaattatctggtcttctggcttcatgatatgtgtgctgtggcctccagattatatgtccataaattctgtgtctccgtgcttggctgatctttcttcttgaaggtttaataaacctctcaaacgtcacatctagatccacacccttgctactctcttctacccgaaacctgattcttccccatttcagtcgatggtcacttcctccaagttgctcgggccaaaacatttctggttctgtcgtcactgtctctttttccttataatcatgtccaatgtgtcagcacatcctgtgagctctgccttcccagcttggccactccctgaccacttcaggccagcttcacggcttcttccttggctcaagccaccatcacctggtgtctggattgtcatggtggcattctgacaggtcaccctgcatctgttattctgattttagcagacaagggattcagctaaaacgtaactcgcatcatatcactcttgtcaacatcgtcttcttatcactttcataatcagagcaacaaactcatggtggcttccatgccccacataatccagcctctcctgcttccgaagattccgcttctcccaacccttgcttattctgccccagtacagtgatctccttgctgttttgcaagaacactgtcatctctggatttttgcacttgcttttcttctggcctagaactctctccccttcagtatccacctgcattattccctgtaccttcctaaattctctgcttaaaggtcttctctgcgaggctgtctttgactattctactgaaaatagaagcactttttcttctcttctcattctcctctgcagtgtagcacatcttatgtgctatgtcattttcttgtttatttattatctatctctgctcccaaaatataaattccattagtccagggacttctgtccatattaatgatctcaaggctgagaacttgttggaatgcaggtttgaataaatacaagtttgaatcagccttgcatccttgtgccaacataatggagcacatttgctgcaggacaagccaatattcccagagctaagagagatgggggaacaaacaaaggattggtcaggtcaaagctggggacactgctacatgtagcatcactgacctagccctgagggacattctggacccaggctgagggacaggctcaaaatagattgaagaatccatgaatgcaatcaacccgttttctcaggctgcgataacaagctgctttagactgtgtgactcaaacacagatttattatctcacaatactggaggctagaaagtccaaaatcaagtctctgatgaatttggttgctggcgagagtcctcttcctgatttgcagatggctaccttcttgttatgtgattgcatggagggaggggaggcaagggagagaagacaggggagaaagaacaaactctctgatatctctcctgtaagggcactcaccccatactgagggccccaccctcacaacttcatctaactctaactacttcccaagggcctcacctttaagtaccgtacattaggggttcgggcttcatcatgggaattgttaaggaagacaaacattcagtatataacaccaccaaattgagatggttataaatggtgcaggacaaatgggtggatttattagttaagttgcaagggaaactttattaaagaggaggaagaacttacatcgaagatgtgagaggcatcctgggcaaatgcaatgtgtagaattgatcaggttagtgactaaatgaacataaggtaaaaaaatttacaagacagttgaggaagcgtaaatgctgactggacatacagtgatactaagaaattattgttaaacgattttggtgtgatagtgacattgtaattatattttagtgtcacaaagtgaattattgatagatgcattaaatgcagtatttaaaataatccatgggtgggaggagtgggtgggcaatagaagaaacaagttgacatgacctgtttaattgtcgaacttgggtaatggacacagggggttcattatactattttctatacttttatgtatgcttaacattttcccaactagatagttaaaaatataacaggaaccacattgggcacttagagcttttttttttttttccccacatttttattgggagccgtgggaggggcctcctctgtcattggaggtgctcacagtttcttcagccactccaggctggggtcctgggggtctgaggctcccagtgacgaaggacacgacgagcaccggctccttggcccaggcattcttgaagaaggtgcggagtctcgcggccatcttggtctcggcggcggcgacggcggcgaggacgcggagcactctgggagttgtggtccctcttttttttttttttttttttttacattttagaagtgtgtggagtttagggaaatgaagagatgagacttttaaggttaacgactctgacagagttatctgaagagtgcaacccaggctttctatttgcttttacaggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaa

SEQ ID NO: 580 - DNA, 31056 bp, Homo sapiens; identical to SEQ ID NO: 579

SEQ ID NO: 581 - DNA, 31056 bp, Homo sapiens; identical to SEQ ID NO: 579

SEQ ID NO: 582 - DNA, 31056 bp, Homo sapiens; identical to SEQ ID NO: 579
